United States Patent 7,745,391 (HUMAN THROMBOSPONDIN POLYPEPTIDE) - sequence listing, part 289

SEQ ID NO: 918503 - protein, 231 aa, Homo sapiens
EDPGKKIKPTMRQLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDKIEKKGKGKKRRGRRSKKERRRGRKEGEEDQNPPCPRLNGVLMEVEEREVLQDSLDRCYSTPSMYFELPDSFQHYRSVFYSFEEQH

SEQ ID NO: 918504 - protein, 1159 aa, Homo sapiens
LIFCHLCPTWLIREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGVAITELRDVIATGRTYRHMLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGVAITELRDVIATGRTYRHMLSRELLDEKGPEVLQDSLDRCYSTPSGCLELTDSCQPYRSAFYVLEQQRVGFAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEENHVGFSLDVGVAITELRDVIATGRTYRHMLSRELLDEKGPEVLQDSLDRCSSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRAAGRRQHVTQDSAGAEYEQCHVLAENA

SEQ ID NO: 918505 - protein, 304 aa, Homo sapiens
MVLLIYIEKQLHTPMYFLLSQLSLMDLMLICTTLPKMIFSYLSGKKSISLAGCGTQIFFYVSLLGAECFLLAVMAYDRYVAICHPLQYTILMNPKLCVFMTVASWTLGSLDGIIVLAAVLSFSYCSSLEIHHFFCDVAALLPLSCTETSAFERLLVICCVVMLIFPVSVIILSYSHVLRAVIHMGSGESRRKAFTTCSSHLSVVGLYYGAAMFMYMRPASKHTPDQDKMVSAFYTILTPMLNPLIYSLRNKEVFRALQKKAPLIVHMQGQQFNNNPYTNNTFMRAKNQRGITDPSGQNLCSHKP

SEQ ID NO: 918506 - protein, 248 aa, Homo sapiens
SPLSVFPGPSRPPLLPPIGYIKGPGAPQGHLVFLHQSHLGPCPATTEATSVSTTATSEHSTGTTMIHEATSSSPHATRATSAMITTRGWEGWREEAFRLWSLTLVALCSPGEVLVSTTRIGTLPVSSLVLDVSSSRGVPSGTLGSSWREASSISSTASHVTHGSPRTSWASWTSAEWWWHPSALTGWHTTLHTVHWRPLPSKRDFKFAPLKIFPIKPFHGSFGSRLIRTFMLVGSCVLISGTRCPAKD

SEQ ID NO: 918507 - protein, 156 aa, Homo sapiens [sequence omitted]

SEQ ID NO: 918508 - protein, 408 aa, Homo sapiens
MWDLALIFLAAACVFSLGVTLWVICSHFFTVHIPAAVGHPVKLRVLHCIFQLLLTWGMIFEKLRICSMPQFFCFMQDLPPLKYDPDVVVTDFRFGTIPVKLYQPKASTCTLKPGIVYYHGGGGVMGSLKTHHGICSRLCKESDSVVLAVGYRKLPKHKFPVPVRDCLVATIHFLKSLDAYGVDPARVVVCGDSFGGAIAAVVCQQLVDRPDLPRIRAQILIYAILQALDLQTPSFQQRKNIPLLTWSFICYCFFQNLDFSSSWQEVIMKGAHLPAEVWEKYRKWLGPENIPERFKERGYQLKPHEPINEAAYLEVSVVLDVMCSPLIAEDDIVSQLPETCIVSCEYDALRDNSLLYKKRLEDLGVPVTWHHMEDGFHGVLRTIDMSFLHFPCSMRILSALVQFVKGLR

SEQ ID NO: 918509 - protein, 106 aa, Homo sapiens
MRPGAPRVAAGEAPCPGSITAFWTCPSNDPTPGLAGSPRPAQLSLPQTTAPEVLGVRSGLPFPACPVSRAPEEPLSATRSPLCGIKPVWARWGRAGQGLGWASLRG

SEQ ID NO: 918510 - protein, 187 aa, Homo sapiens
MEPRREAGAGPGPAGRASSMLGRQPRGRTGEGFRPESLAFSSSWRPGGRGLLAMDLLAGGTTLRVAFTRHLSTHPSLLLSDVKALRSLVNNPRYSDVCFVVGQERQEVFAHRCLLACRCNFFQRLLGTEPGPGVPSPVVLSTVPTEAFLAVLEFLYTNSVKLYRHSVLEVLTAAVEYGLEELRESRH

SEQ ID NO: 918511 - protein, 187 aa, Homo sapiens; identical to SEQ ID NO: 918510

SEQ ID NO: 918512 - protein, 187 aa, Homo sapiens; identical to SEQ ID NO: 918510

SEQ ID NO: 918513 - protein, 187 aa, Homo sapiens; identical to SEQ ID NO: 918510

SEQ ID NO: 918514 - protein, 187 aa, Homo sapiens; identical to SEQ ID NO: 918510

SEQ ID NO: 918515 - protein, 321 aa, Homo sapiens
AVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 918516 - protein, 200 aa, Homo sapiens
MQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 918517 - protein, 1048 aa, Homo sapiens
GSEAIPYDTTMADTRQYTFAQTHRMYTKSELKLKLWALDDKDAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 918518 - protein, 1048 aa, Homo sapiens; identical to SEQ ID NO: 918517

SEQ ID NO: 918519 - protein, 1031 aa, Homo sapiens
GSEAIPYDTTMADTRQYTFAQTHRMYTKSELKLKLWALDDKDAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 918520 - protein, 1031 aa, Homo sapiens; identical to SEQ ID NO: 918519

SEQ ID NO: 918521 - protein, 1031 aa, Homo sapiens; identical to SEQ ID NO: 918519

SEQ ID NO: 918522 - protein, 169 aa, Homo sapiens
MTTPPEKGRKPEGPAWTSLNTLRMLHSKRYGEHCACGKPTLAPATSVPQYHLLLSIHAGWLPWPHLQVVWVGTVLGPHILPKNPVEWRCDRARGHLKIVHRLLTGWGNSGSNCSGRESRCVNGRKRCIRGYRMKVSGKDENSGFSLIVRGKCGRDIIKDSDKDITTECT

SEQ ID NO: 918523 - protein, 311 aa, Homo sapiens
MAALYACTKCHQRFPFEALSQGQQLCKECRIAHPVVKCTYCRTEYQQESKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSQKTLSTSSIQNEIPKKKSKFESITTNGDSFSPDLALDSPGTDHFVIIAQLKEEVATLKKMLHQKDQMILEKEKKITELKADFQYQESQMRAKMNQMEKTHKEVTEQLQRWALAILPGLVLNSWLQAILPPQPHKVLGLQA

SEQ ID NO: 918524 - protein, 311 aa, Homo sapiens
MAALYACTKCHQRFPFEALSQGQQLCKECRIAHPVVKCTYCRTEYQQERLECNGTISAHCNLHLPGSSDSPASSSRVAGITAKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 918525 - protein, 204 aa, Homo sapiens
MAALYACTKCHQRFPFEALSQGQQLCKECRIAHPVVKCTYCRTEYQQERLECNGTISAHCNLHLPGSSDSPASSSRVAGITAKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNR

SEQ ID NO: 918526 - protein, 340 aa, Homo sapiens
MAALYACTKCHQRFPFEALSQGQQLCKECRIAHPVVKCTYCRTEYQQERLECNGTISAHCNLHLPGSSDSPASSSRVAGITAKTNTICKKCAQNVQLYGTPKPCQYCNIIAAFIGNKCQRCTNSEKKYGPPYSCEQCKQQCAFDRKDDRKKVDGKLLCWLCTLSYKRVLQKTKEQRKHLSSSSRAGHQEKEQYSRLSGGGHYNSQKTLSTSSIQNEIPKKKSKFESITTNGDSFSPDLALDSPGTDHFVIIAQLKEEVATLKKMLHQKDQMILEKEKKITELKADFQYQESQMRAKMNQMEKTHKEVTEQLQAKNRELLKQAAALSKSKKSEKSGAITSP

SEQ ID NO: 918527 - protein, 311 aa, Homo sapiens; identical to SEQ ID NO: 918523

SEQ ID NO: 918528 - protein, 138 aa, Homo sapiens [sequence omitted]

SEQ ID NO: 918529 - protein, 176 aa, Homo sapiens
MAEICPQTQRAWIATPLRSSSLGLAKYPLRASCSALANKHPERCLASHGLQPGWPRGAKFSIAIVHRISPETHSLHVAQLNSHVGFLDLVVSVLTVMIQSVTCQGSGSTHYELLGIPGCNIHLYIPMALHSQDNRCSVPQKVFLALSCDCGPPLPWAIQRALPPSNSCNHTGSKKV

SEQ ID NO: 918530 - protein, 148 aa, Homo sapiens
ANFCKMYSGISLKYPKGLPLKRCMCVSDRPAFQAPGPSKLHGWGFLECSTAQDLCTVFVLTRKKRKRIETHCLMSWRGNENTLAGQLSWVDPCSVTKPLSHMLTCYSPAWDPAHKYLRYTTLGITQLMERTRKGVRICTLANFEEHPI

SEQ ID NO: 918531 - protein, 214 aa, Homo sapiens
MTANPGISALSEAQQAPLPRRLSFTWSCHLASLCFQSPLQIQIQVEAKPGHSHNPARFVQAQGSADMPAPCHIGPLQTLGTGKNRREAEVWLRVAQQQEEEKREGEKSCVPSGNTDLGAPPTRAVTPSLGLGRSCISKPLGATAFPDTHSGSCLQSAWSSCRLTGSWHLCLELPTPLQLACLAVCSGQIPCSIAHTPLTALYSARPWQVWDPDH

SEQ ID NO: 918532 - protein, 153 aa, Homo sapiens
MGCRESCPQANGPLPWGASPAVSEDQNLSVLHSSHWRQLRADFQSHKKQPQLEELQPQLWIFSFCPGGRVGTKPPGPVKTEGEARTLRERSQTQKATSGPHESIPTISWINAKPGQQSDPWLPGARGQGKGQTARGNFSLMLYFDNGGGYMTV

SEQ ID NO: 918533 - protein, 346 aa, Homo sapiens
YPWSLMMATYRWGFGVDVFFVDVDAIPFCVLVFLLTIRSLSFRNLQESEEEEVPQESWDEGYSTLSIPPEMLASYQSYSGTFHSLEEQQVCMAVDIGGEYSIVKVIKLQFMAQAMPVPTWTDCHDIELKAGHRWDQVKKEDQEATGPRLSRELLDEKGPEVLQDSLDRCYSTPSGYLELTDSCQPYRSAFYILEQQRVGWALDMDEIEKYQEVEEDQDPSCPRLSGMLMEVEEPEVLQDSLDRCYSTPSMYFELPDSFQHYRSVFYSFEEQHISFALDVDNRFLTLMGTSLHLVFQMGVIFPQTLPVQNMNNAMFLQKTLSLSFIGESHLAECPGTLVLSHSDTCK

SEQ ID NO: 918534 - protein, 134 aa, Homo sapiens
RFWMIPEYHTKISVNNAKYFSVHWSLSASHEAMGGQFISDKLMQIRNVFWEGLTGAGERTSKIACSNDWQVLLIVDLELIQGYPLDTLDPLHMDLFIGMLGLPENMAASFQEQGFQKAWMKVVETKAANPRTTL

SEQ ID NO: 918535 - protein, 432 aa, Homo sapiens
LQEGPLCTMSNQVLCCVVLCLLGANTVDGGITQSPKYLFRKEGQNVTLSCEQNLNHDAMYWSCSTLEEISRTADDVILASVSHVDFCFAGECIRPEVGEAPQPRTAAPGDAFTYQEQCRCMQKYRHPLTVTFVDNQKYLSAFPAEPKLSSYHPGGKTGKGNCSVRLCSFHACQGFWFHGDLRLGATLSRETELQRIPTKLQAEGQPRPSGSTREQNHYGKFTEKSGKLESQPESIKSSIIKLSFPYCEMAICNDFEKWDPWWCRCLSQVRVRSLAPWAGPQDALENAFCSQLCDSFLSVLVKQPDPVRLEMPGMVPPHVPPQMLNIPQTSLQAKPVAPQVPSPGGAPGQGPYPYSLSEPAPLTLDTSGKNLTEQNSYSNIPHEGKHTPLYERSLPINPAQSSSPNHVDSAYFPGSSTSSSSDNDEGSGGATK

SEQ ID NO: 918536 - protein, 145 aa, Homo sapiens
MPGMVPPHVPPQMLNIPQTSLQAKPVAPQVPSPGGAPGQGPYPYSLSEPAPLTLDTSGKNLTEQNSYSNIPHEGKHTPLYERSLPINPAQSSSPNHVDSAYFPGSSTSSSSDNDEGSGGATNIQSIGDSVPLNTMYNEGFPGNGD

SEQ ID NO: 918537 - protein, 205 aa, Homo sapiens
RPVGDILMLTGGTRWQGYPHVENLGWGGGLLVLTTSDSIVVPSSCSLPKSLPTDGPGQKVVKESEARGRKARVPMAPTGWLAWLGPTLAGPAPGGSLHIHPLFPIYTLPESPSSPDPAIQTLCVSGNHFSDATWGLLQLLCIFLESLMEPCMMTVSTSLHGKELRDRGHPVPSPSQPLVQGKRAVDVNYSPSDALSWGRNWEGQR

SEQ ID NO: 918538 - protein, 968 aa, Homo sapiens
MSLQAPSRLLELAGQSLLRNQFLTIFTLDELPREVFPLMFMEAFSMRRFEALKLMVQAWPFLSLPLGSLMKTLHLETLQAVLRGLDTLVAQKVRPRRWKLQVLDLRDVDENFWTIWSGARVLSCSPEAMSKRQTVEDCPRMGEHQPLKVFIDLCLKESTLDECLSYLFGWIHYRRGLVHLCCSKVQNYSMPTSSFRNLLERIYPDSIQELEVWKKCSLNKTGKFAPYLSQMSNLRELFLAFGYERELYVSVQWPCIPDLDSPFLCLYYPQMLYIKKISNIKEHLEHLLRYLKNPLGAFIFSDAYLTDRDMECLSQYPSLSQLKELRLIHILMWTTHLEPLGVLLEKVAATLKTLVLKDCRIQDPQLRVLLPALSHCSQLTTFNFHGNETSMNALKDLLRHTGGLSKLGLELYPAPLESLDYKGHVNWEILTPIRAELMRTLREVRQPKRIFFGPDPQERPKVFKPGVPAWFFLRSEHLLDYIQICFPCRFMKMSIWTPPRLLELAGRSLLRDQALAMSTLEELPTELFPPLFMEAFSRRRCEALKLMVQSWPFRRLPLRPLIKMPCLEAFQAVLDGLDALLNLGVRPRRWKLQVLDLQDVCENFWMVWSEAMAHGCFLNAKRNKKPVEDCPRMRGRQPLTVFVELWLKNRTLDEYLTCLLLWVKQRKDLLHLCCKKLKILGMPFRNIRSILKMVNLDCIQEVEVNCKWVLPILTQFTPYLGHMRNLQKLILSHMDVSRYVSPEQKKEIVTQFTTQFLKLRCLQKLYMNSVSFLEGHLDQLLSCLKTSLKFLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCVELYPAPRESYGADGTLCWSRFAQIRAELMNRVRDLRHPKRILFCTDYCPDCGNRSFYDLEADQYCC

SEQ ID NO: 918539 - protein, 215 aa, Homo sapiens
MAEVRVQLLLSRRPESVSFARSVCGLLGAGPGLGTWPIHCSLKRGRLVLSSRPFPGASARLPLQVGRRGPQSGGSEGPKMGTEIGWELAARTPPPTRGVAPFLEVTPTQCRPSEALTQLASFCQRPPFCPFAALEERPRVPGAELPTDRGVDLGVAVILQSSDKTVLLTRRARTLSVSPNLWVPPGITAAVAGRAGSEGRKQGSGEPKQPGSDCD

SEQ ID NO: 918540 - protein, 434 aa, Homo sapiens
MAEVRVQLLLSRRPESVSFARSVCGLLGAGPGLGTWPIHCSLKRGRLVLSSRPFPGASARLPLQVGRRGPQSGGSEGPKMGTEIGWELAARTPPPTRGVAPFLEVTPTQCRPSEALTQLASFCQRPPFCPFAALEERPRVPGAELPTDRGVDLGVAVILQSSDKTVLLTRRARTLSVSPNLWVPPGGHVELEEEVTSQLIQPEPRDPCLGPSWVWAEGEASKRTWKSQALAPLMVFSDSQLLDGGLRELWEESGLHLPQGQFSWVPLGLWESAYPPRLSWGLPKYHHIVLYLLVISQESQQQLQARIQPNPNEVSALMWLTPDVAAAVAAAEDGTETPGLLPQDLPPSVLAVELEEDGRARPLVLHMSTLLRMIPTMAEDKERVSTGTKFALKLWLQHLGRTPPPCKSAAYLDPGPAKEEWNMDPLPPNQGSGK

SEQ ID NO: 918541 - protein, 219 aa, Homo sapiens
MAEVRVQLLLSRRPESVSFARSVCGLLGAGPGLGTWPIHCSLKRGRLVLSSRPFPGASARLPLQVGRRGPQSGGSEGPKMGTEIGWELAARTPPPTRGVAPFLEVTPTQCRPSEALTQLASFCQRPPFCPFAALEERPRVPGAELPTDRGVDLGVAVILQSSDKTVLLTRRARTLSVSPNLWVPPGRRASRTLGGEWTTPAPGPVLLGPSGFMGVCLPS

SEQ ID NO: 918542 - protein, 117 aa, Homo sapiens
MWLTPDVAAAVAAAEDGTETPGLLPQDLPPSVLAVELEEDGRARPLVLHMSTLLRMIPTMAEDKERVSTGTKFALKLWLQHLGRTPPPCKSAAYLDPGPAKEEWNMDPLPPNQGSGK

SEQ ID NO: 918543 - protein, 215 aa, Homo sapiens; identical to SEQ ID NO: 918539

SEQ ID NO: 918544 - protein, 374 aa, Homo sapiens
MAEVRVQLLLSRRPESVSFARSVCGLLGAGPGLGTWPIHCSLKRGRLVLSSRPFPGASARLPLQRPPFCPFAALEERPRVPGAELPTDRGVDLGVAVILQSSDKTVLLTRRARTLSVSPNLWVPPGGHVELEEEVTSQLIQPEPRDPCLGPSWVWAEGEASKRTWKSQALAPLMVFSDSQLLDGGLRELWEESGLHLPQGQFSWVPLGLWESAYPPRLSWGLPKYHHIVLYLLVISQESQQQLQARIQPNPNEVSALMWLTPDVAAAVAAAEDGTETPGLLPQDLPPSVLAVELEEDGRARPLVLHMSTLLRMIPTMAEDKERVSTGTKFALKLWLQHLGRTPPPCKSAAYLDPGPAKEEWNMDPLPPNQGSGK

SEQ ID NO: 918545 - protein, 326 aa, Homo sapiens
MAEVRVQLLLSRRPESVSFARSVCGLLGAGPGLGTWPIHCSLKRGRLVLSSRPFPGASARLPLQRPPFCPFAALEERPRVPGAELPTDRGVDLGVAVILQSSDKTVLLTRRARTLSVSPNLWVPPGGHVELEEEDGGLRELWEESGLHLPQGQFSWVPLGLWESAYPPRLSWGLPKYHHIVLYLLVISQESQQQLQARIQPNPNEVSALMWLTPDVAAAVAAAEDGTETPGLLPQDLPPSVLAVELEEDGRARPLVLHMSTLLRMIPTMAEDKERVSTGTKFALKLWLQHLGRTPPPCKSAAYLDPGPAKEEWNMDPLPPNQGSGK

SEQ ID NO: 918546 - protein, 215 aa, Homo sapiens; identical to SEQ ID NO: 918539

SEQ ID NO: 918547 - protein, 162 aa, Homo sapiens
LPLAECCAPMEATMALIMASPSGSPSPALYPTAGRSGLPLHANRNTTKAKEALLKPPFPAASRQHLPQWAPSLLPLLVAGKVMVSQEEKGNRSLVGTLGGALRWRLYPGQIQQDLGFSAYTAQRYLPPGISGPHTDIFMLEADPEKQISISIKIYGKSRRPS

SEQ ID NO: 918548 - protein, 334 aa, Homo sapiens
FKEKVRKMMSFRKIWSLFIVNNSNEEGRNQWKHRHAWRNGTEFNDDLFRKEGINWAENAVEVVGSNTGHVRCPEGFLGEYCQHRDPCEKNRCQNGGTCVAQAMLGKATCRCASGFTGEDCQYSTSHPCFVSRPCLNGGTCHMLSRDTYECTCQVGFTACLLKGRNPKCPGGNLNYQFNGIVVVSSDGSVPPSGTKTSRPAELNVAGTGSKHFASGSLGVMVRSANGPMPACLIPVQMEVPVPLWPTSSPANASQASQGRSVRLMSMSVTFQDTASMVAPASTCLVPTSASAFRASQASTVTACMCPVHPRLVSMEAPVGRLVTSLLSATAFQKQ

SEQ ID NO: 918549 - protein, 237 aa, Homo sapiens
MRTGPVTRSRSPPRGARAGASSCGKPLGAQGGGAEAAATVGRGLRWEEAAEAEGHTRLLRCTPEKVSAKLRAAAEAAAEERRTRGAGSRGICAGLRSVAPGPEPLKQEEGRREWGSSIGTPSPCGSAQAAAAAAAEEATEKIPALRPALLWALLALWLCCATPAHGEYRAEGRCPRRPGLPPGATLLPLGPSLCGKARLGRRRGARPLAGFPRVWTSPGAPPVVPRQPPGFPANRRG

SEQ ID NO: 918550 - protein, 416 aa, Homo sapiens
MRTGPVTRSRSPPRGARAGASSCGKPLGAQGGGAEAAATVGRGLRWEEAAEAEGHTRLLRCTPEKVSAKLRAAAEAAAEERRTRGAGSRGICAGLRSVAPGPEPLKQEEGRREWGSSIGTPSPCGSAQAAAAAAAEEATEKIPALRPALLWALLALWLCCATPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPETVRRGTELWERDREVWNGKEHDEN

SEQ ID NO: 918551 - protein, 307 aa, Homo sapiens
QPQPRPRPRLAGAASPRTGGGGGSQSPAPAGERTMHCLGAEYLVFIMGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITGMLVRDFCPGRGIK

SEQ ID NO: 918552 - protein, 347 aa, Homo sapiens
QPQPRPRPRLAGAASPRTGGGGGSQSPAPAGERTMHCLGAEYLVSAEGAPRQREWRPQIYRKCTDTAWLFLFFLFWTGLVFIMGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVAARLDFCSQKENKIDS

SEQ ID NO: 918553 - protein, 347 aa, Homo sapiens; identical to SEQ ID NO: 918552

SEQ ID NO: 918554 - protein, 347 aa, Homo sapiens; identical to SEQ ID NO: 918552

SEQ ID NO: 918555 - protein, 347 aa, Homo sapiens; identical to SEQ ID NO: 918552

SEQ ID NO: 918556 - protein, 343 aa, Homo sapiens
QPQPRPRPRLAGAASPRTGGGGGSQSPAPAGERTMHCLGAEYLVSAEGAPRQREWRPQIYRKCTDTAWLFLFFLFWTGLVFIMGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITGMLVRDFCPGRGIK

SEQ ID NO: 918557 - protein, 194 aa, Homo sapiens
HSGMLAYLPFQWVLPMLSSCGRLCELLSPLVGMKVMFLRSTLAGVGRIKISNGWLVRDKEIFSLKSSYPKSDLVLEKVAVKTRSGEAAKVIIRRGIPFLNQVSSSCQSHSEGGDEEPPAGLAADPCSLCVRNMANLTNSQEPRFWTKSPRSSPDADRRPFLGPIPSHGPLPLPFAENALHWFMLYVFISSMKTD

SEQ ID NO: 918558 - protein, 206 aa, Homo sapiens
MPSKMQGLESWTPGAQLVHYLTVAALAPKLQDKVPFTLPSPFLKQKESLPMATTVMVEKICSGKKKAFRICSSSTETLSPHLDVFDISFVSKTNGLGSEGGGAAQGPHWSQKPVTCLKGAVATLIFRVKGVIQSYTNMTVELLKVKKLSPPYVLKWSLALSSWLECSGASRLTATSASWVQVILLLQPPDLLGLQSKPVKKWPSHS

SEQ ID NO: 918559 - protein, 206 aa, Homo sapiens; identical to SEQ ID NO: 918558

SEQ ID NO: 918560 - protein, 293 aa, Homo sapiens
MASNVTNKMDPHSMNSRVFIGNLNTLVVKKSDVEAIFSKYGKIAGCSVHKGFAFVQYDKEKNARAAVAGEDGRMIASQVVDINLAAEPKVNRGNAGVKRSAAEMYGSSFDLDYGFQRDYYDGMYSFPARVPPPPPIALAVVPSKRQRLSGNTSRRGKSGFNSKSGKRGSSKSGKLKGDDLQAIKQELTQIKQKVDSLLENLEKIEKEQSKQEVEVKNAKSEEEQSSSSMKKDETHVKMESEGGAEDSAEEGDPLDDDVNEDQGDDQLELIKDDEKEAEEGEDDRDSTNGQDDS

SEQ ID NO: 918561 - protein, 187 aa, Homo sapiens
MVLTLEQAAGSEHYDASPCSPPPLSNIPTLVGSRHVGGLQQPRDWAFVPAPCATSNYTGFANKHGSKPSSLGVSNGAEKKSGSPTHQAKVSLQMATSPSNGNILNSVAIQAHQYLDGTWSLSRTNGVTLYPYQVLAGPGDASDFPASRFTTWQSHEEVGHTDTWTGVQAPTCPLISSVTWHKGFALS

SEQ ID NO: 918562 - protein, 158 aa, Homo sapiens
MLATIIIKGLLKKFENLASKRWSCCKVQAVIHEVINLLRYAVSSEQPAQNPHSPHPRDLLWHPGIGCTLSLTYAHVPALPVGQGVFLASSLGMDSHWLADHQPIFDQLPDLLTGVGIGDFIGFIGVQPDLLLATGEDPRGKPLLKPEHTHGCDHSSER

SEQ ID NO: 918563 - protein, 480 aa, Homo sapiens
MPFQTFKNYCYFYPFQVSRPLPLWRDNRQTPWLLSLRGELVASLEDASLMGLYVDMNATTVTVQSPRQGLLQRWEVLNTSAELLPLWLPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 918564 - protein, 151 aa, Homo sapiens
EGQFGDSHGHDGLMNHRRIIWTPFGRDVRNSLLLGTSFSNNIYSSRWKRKAPYVKSFLQSFLVREEINSTCHICSWASQVGFYHSLKWFTKLSYVSRVSSFCGFVVLLTSGVKLQTFPVSVTAHKDLRDRLLNHSCFAFENLSHLTKVRQQ

SEQ ID NO: 918565 - protein, 151 aa, Homo sapiens; identical to SEQ ID NO: 918564

SEQ ID NO: 918566 - protein, 295 aa, Homo sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEGIQLAGGRGVGV

SEQ ID NO: 918567 - protein, 1036 aa, Homo sapiens
GTCGPALCASPSPVAPTPAMKRIFSCSSTQVAVERWNRHDQKLLEAVHRGDVGRVAALASRKSARPTKLDSNGQSPFHLAASKGLTECLTILLANGADINSKNEDGSTALHLATISCQPQCVKVLLQDVNTKLHAASLCGHLQHGANEDAVDAENRSPLHWAASSGCASSVLLLCDHEAFLDVLDNDGRTPLMIASLGGHAAICSQLLQRGARVNVTDKNDKSALILACEKGSAEVAELLLSHGADAGAVDSTGHDALHYALHTQDKALWRHLQQALSRRRRGGQRLVQHPDLASQASPSEPQAGSPPKSSWRAEPEEEQEEKEDEDPCSEEWRWKYEEERRKVVRLEQELVQKTEECKTQAAAYLDLENQIREQAQELGVLLSWEPRASGKQGSSLRPGGDGMEQGCPKDLLAESTQELKKQQQAAATVNPVLAPKKAEDSAPGKIQYEVHGRSQPEEQGPPQSPASETIRKATGQQLTTNGAQTFGPDHADQLPAGQKESSQVLGVEPGGTVAEPVGPAAMNQLLLQLREELAAVWREKDAARGALSRPVMEGALGTPRAEAAAAAWEKMEARLERVLARLEWAKAGLQVKPEVPSQESREGALKAAPGSIKQDEEKEKRVPGARGEPLGALGGEKALGGLAKGQLEKEMSVLRLSNSNLLEELGELGRERQRLQRELQSLSQRLQREFVPKPEAQVQLQQLRQSVGLLTNELAMEKEATEKLRKLLASQSSGLRGLWDCLPADLVGERSAQSKAAESLEELRACISTLVDRHREAQQVLARLQEENQQLRGSLSPCREPGTSLKAPASPQVAALEQDLGKLEEELRAVQATMSGKSQEIGKLKQLLYQATEEVAELRAREAASLRQHEKTRGSLVAQAQAWGQELKALLEKYNTACREVGRLREAVAEERRRSGDLAAQAAEQERQASEMRGRSEQFEKTAELLKEKMEHLIGACRDKEAKIKELLKKLEQLSEEVLAIRGENARLALQLQDSQKNHEEIISTYRNHLLNAARGYMEHEVYNILLQILSMEEE

SEQ ID NO: 918568 - protein, 168 aa, Homo sapiens
TLVSQLQDKFEHLKMIQQEEIRKLEEEKKKLEGEIIDFYKMKAASEALQTQLSTDTKKDKHRPPEAASQALIKEHNQGTRWEAGLHKPVPSLAFPFGLSRSLSQSGVQWRDLGSLPAPPPRFTPFSCFSLPSSWGYRHLPPNPANFFVFLVETGFHRVSQDRLDLLTL

SEQ ID NO: 918569 - protein, 519 aa, Homo sapiens
MLNPIRWDFEILNISELNISKEVVMEVTIINHMEEGLSESKEYDQCGEAFSQILNLNLNKKIPTIVRPCECSLCGKVFMHHSSLSRHIRSHLGHKPYDYQEYGEKPYKCKQCGKAFSSCQSFRRHERTHTGEKPYACPECGKAFISLPSVRRHMIKHTGDGPYKCQECGKAFDRPSLFQIHERTHTGEKPYECQECAKAFISLPSFQRHMIRHTGDGPYKCQECGKAFDRPSLFRIHERTHTGEKPHECKQCGKAFISFTNFQSHMIRHTGDGPYKCKVCGRAFIFPSYVRKHERTHTGEKPYECNKCGKTFSSSSNVRTHERTHTGEKPYECKECGKAFISLPSVRRHMIKHTGDGPYKCQVCGRAFDCPSSFQIHERTHTGEKPYECQVCGKAFISLKRIRKHMILHTGDGPYKCQVCGKAFDCPSSVRTHERTHTGEKPYECKECGKAFNYASSIRIHERTHTGEKPYECKQCGKTFSYSSSFQRHERAHNGDKPYVKNVGKLSFITQPSNTCENE

SEQ ID NO: 918570 - protein, 602 aa, Homo sapiens
FLFRVRCVWVPVSASPVAPVAPPQRLARWDLHRPERAVGRTPGHPGSQEMDSVASEDVAVNFTLEEWALLDPSQKKLYRDVMRETFRNLACVGKKWEDQSIEDWYKNQGRILRNHMEEGLSESKEYDQCGEAFSQILNLNLNKKIPTIVRPCECSLCGKVFMHHSSLSRHIRSHLGHKPYDYQEYGEKPYKCKQCGKAFSSCQSFRRHERTHTGEKPYACPECGKAFISLPSVRRHMIKHTGDGPYKCQECGKAFDRPSLFQIHERTHTGEKPYECQECAKAFISLPSFQRHMIRHTGDGPYKCQECGKAFDRPSLFRIHERTHTGEKPHECKQCGKAFISFTNFQSHMIRHTGDGPYKCKVCGRAFIFPSYVRKHERTHTGEKPYECNKCGKTFSSSSNVRTHERTHTGEKPYECKECGKAFISLPSVRRHMIKHTGDGPYKCQVCGRAFDCPSSFQIHERTHTGEKPYECQVCGKAFISLKRIRKHMILHTGDGPYKCQVCGKAFDCPSSVRTHERTHTGEKPYECKECGKAFNYASSIRIHERTHTGEKPYECKQCGKTFSYSSSFQRHERAHNGDKPYVKNVGKLSFITQPSNTCENE

SEQ ID NO: 918571 - protein, 574 aa, Homo sapiens
MRRHDRLLFVFLVETGFLHVGQDSVASEDVAVNFTLEEWALLDPSQKKLYRDVMRETFRNLACVGKKWEDQSIEDWYKNQGRILRNHMEEGLSESKEYDQCGEAFSQILNLNLNKKIPTIVRPCECSLCGKVFMHHSSLSRHIRSHLGHKPYDYQEYGEKPYKCKQCGKAFSSCQSFRRHERTHTGEKPYACPECGKAFISLPSVRRHMIKHTGDGPYKCQECGKAFDRPSLFQIHERTHTGEKPYECQECAKAFISLPSFQRHMIRHTGDGPYKCQECGKAFDRPSLFRIHERTHTGEKPHECKQCGKAFISFTNFQSHMIRHTGDGPYKCKVCGRAFIFPSYVRKHERTHTGEKPYECNKCGKTFSSSSNVRTHERTHTGEKPYECKECGKAFISLPSVRRHMIKHTGDGPYKCQVCGRAFDCPSSFQIHERTHTGEKPYECQVCGKAFISLKRIRKHMILHTGDGPYKCQVCGKAFDCPSSVRTHERTHTGEKPYECKECGKAFNYASSIRIHERTHTGEKPYECKQCGKTFSYSSSFQRHERAHNGDKPYVKNVGKLSFITQPSNTCENE

SEQ ID NO: 918572 - protein, 198 aa, Homo sapiens
PVSCPLRLGSGLRFSSGPGGSTAASGALGPAQAGESRRQDPGTPWKPGNGACAGPGAWRLGEGLVGTGRNRLWKHPGLPAATPGSGTRVPWRSSALCPLGRRVGWAVASTPGVLSRPCAATAASASEPCLGSSAPAAPPLSRLFVLGHGRVIRRNPVSGVRFVHGKSCGLWPSQYIVFFSGGLVFLRVFQTYWKKNLK

SEQ ID NO: 918573 - protein, 639 aa, Homo sapiens
FLFRVRCVWVPVSASPVAPVAPPQRLARWDLHRPERAVGRTPGHPGSQEMDSVASEDVAVNFTLEEWALLDPSQKKLYRDVMRETFRNLACVGKKWEDQSIEDWYKNQGRILRNHMEEGLSESKEYDQCGEAFSQILNLNLNKKIPTIVRPCECSLCGKVFMHHSSLSRHIRSHLGHKPYDYQEYGEKPYKCKQCGKAFSSCQSFRRHERTHTGEKPYACPECGKAFISLPSVRRHMIKHTGDGPYKCQECGKAFDRPSLFQIHERTHTGEKPYECQECAKAFISLPSFQRHMIRHTGDGPYKCQECGKAFDRPSLFRIHERTHTGEKPHECKQCGKAFISFTNFQSHMIRHTGDGPYKCKVCGRAFIFPSYVRKHERTHTGEKPYECNKCGKTFSSSSNVRTHERTHTGEKPYECKECGKAFISLPSVRRHMIKHTGDGPYKCQVCGRAFDCPSSFQIHERTHTGEKPYECQVCGKAFISLKRIRKHMILHTGDGPYKCQVCGKAFDCPSSVRTHERTHTGEKPYECKECGKAFNYASSIRIHERTHTGEKPYECKQCGKTFSYSSSFQRHERAHNGDKPYVKNVGKLSFITQPSNTCENLQFAFWVSDLFGSSPLSPVSHFWNRNLYPVPVSYFGNT

SEQ ID NO: 918574 - protein, 213 aa, Homo sapiens
MASHDCSSLGHRCTADLFFLLGWQAQSPISSNVHQWDSRERKKAERAGVPAPQLQPCVHQQGSPPSHQCQMEKLYCHVFEHLAGSTTGVPIIKLISTRPWSAHFLVHVLLRVGCRENSRSCMRCPFDCYIHDMGQNEDSSNDFGSGSPRFFRRAVRAVTDVERVVLPLLHHSACYLTCEDTCPEQSITDDAQKNANPGSTGTSFTFIHWSLSP

SEQ ID NO: 918575 - protein, 145 aa, Homo sapiens
MFSLCYLPTAGRLTLTVIKCRNLKAMDITGYSDPYVKVSLLCDGRRLKKKKTTIKKNTLNPVYNEAIIFDIPPENMDQVSLLISVMDYDRVGHNEIIGVCRVGITAEGLGRDHWNEMLAYPRKPIAHWHSLVEVKKSFKEGNPRL

SEQ ID NO: 918576 - protein, 138 aa, Homo sapiens
MFSLCYLPTAGRLTLTVIKCRNLKAMDITGYSDPYVKVSLLCDGRRLKKKKTTIKKNTLNPVYNEAIIFDIPPENMDQVSLLISVMDYDRVGHNEIIGVCRVGITAEGLGRDHWNEMLAYPRKPIAHWHSLVEGNPRL

SEQ ID NO: 918577 - protein, 128 aa, Homo sapiens
MFSLCYLPTAGRLTLTVIKCRNLKAMDITGYSDPYVKVSLLCDGRRLKKKKTTIKKNTLNPVYNEAIIFDIPPVGHNEIIGVCRVGITAEGLGRDHWNEMLAYPRKPIAHWHSLVEVKKSFKEGNPRL

SEQ ID NO: 918578 - protein, 151 aa, Homo sapiens
MHTVETYNKETDGRTFVEFILGSLRGHREWFLTGFPILLLVAFGEGDRSGQRSEKSQPKQRTELITLELFHPLQSSTVIPDPTDLAGVIIELGPNDSPQTSEFKGATEEAPAKESPHTSEFKGAARVSPISESYYLIELKRVMCGRVINDG

SEQ ID NO: 918579 - protein, 224 aa, Homo sapiens
MLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQRSSTADLTWQKRESTNLKIDL

SEQ ID NO: 918580 - protein, 368 aa, Homo sapiens
HVAGVWCTNDFITQLVSIVPSRRKMRFYESIITFLPQQVRDCRLTGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKNWGEGWGFVPSDRALVFVDNHDNQRGHGAGGASILTFWDARLYKMAVGFMLAHPYGFTRVMSSYRWPRQFQNGNDVNDWVGPPNNNGVIKEVTINPDTTCGNDCVCEHRWRQIRNMVIFRNVVDGQPFTNWYDNGSNQVAFGRGNRGFIVFNNDDWSFTLTVQTGLPAGTYCDVISGDKINGNCTGIKIYVSDDGKAHFSISNSAEDPFIAIHAESKL

SEQ ID NO: 918581 - protein, 378 aa, Homo sapiens
HVAGVWCTNDFITQLVSIVPSRRKMRFYESIITFLPQQVRDCRLTGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFVPSDRALVFVDNHDNQRGHGAGGASILTFWDARLYKMAVGFMLAHPYGFTRVMSSYRWPRQFQNGNDVNDWVGPPNNNGVIKEVTINPDTTCGNDCVCEHRWRQIRNMVIFRNVVDGQPFTNWYDNGSNQVAFGRGNRGFIVFNNDDWSFTLTVQTGLPAGTYCDVISGDKINGNCTGIKIYVSDDGKAHFSISNSAEDPFIAIHAESKL

SEQ ID NO: 918582 - protein, 234 aa, Homo sapiens
MVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKVIRSRPPVRPSTLAGSCPPVCSWLQLSFCGARLML

SEQ ID NO: 918583 - protein, 138 aa, Homo sapiens
MVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKVCIPMHPEQTTFSRMLA

SEQ ID NO: 918584 - protein, 186 aa, Homo sapiens
MGEQHSSRGHVHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKVCIPMHPEQTTFSRMLA

SEQ ID NO: 918585 - protein, 347 aa, Homo sapiens
MLCCRSFWHCRPPEMSILCLSTFVVIVCGVALVAVFLFLFWKLCWMPWRNKEASSPSSANPPLEALQSPSFRGNMADKLKDPSTLGFLEAAVKISHTSPDIPAEVQMSVKEHIMRHTRLQRQTTEPASSTRHTSFKRHLPRQMHVSSVDYGNELPPAAEQPTSIGRIKPELYKQKSVDGEDAKSEATKSCGKINFSLRYDYETETLIVRILKAFDLPAKDFCGSSDPYVKIYLLPDRKCKLQTRVAPQGPWNPTFDENFHFPVPYEELADRKLHLSVFDFDRFSRHDMIGEVILDNLFEASDLSRETSIWKDIQYATSVQEFPKLQSPTHAQTACLTVCLSWMFLLK

SEQ ID NO: 918586 - protein, 199 aa, Homo sapiens
MWIKQVLNQDLTFQHIKIIYPTAPPRSYTPMKGGISNVWFDRFKITNDCPEHLESIDVMCQVLTDLIDEEVKSGIKKNRILIGGFSMGGCMAMHLAYRNHQDVAGVFALSSFLNKASAVYQALQKSNGVLPELFQCHGTADELVLHSWAEETNSMLKSLGVTTKFHSFPNVYHELSKTELDILKLWILTKLPGEMEKQK

SEQ ID NO: 918587 - protein, 113 aa, Homo sapiens
MGGCMAMHLAYRNHQDVAGVFALSSFLNKASAVYQALQKSNGVLPELFQCHGTADELVLHSWAEETNSMLKSLGVTTKFHSFPNVYHELSKTELDILKLWILTKLPGEMEKQK

SEQ ID NO: 918588 - protein, 237 aa, Homo sapiens
MAAASGSVLQRCIVSPAGRHSASLIFLHGSGDSGQGLRMWIKQVLNQDLTFQHIKIIYPTAPPRSYTPMKGGISNVWFDRFKITNDCPEHLESIDVMCQVLTDLIDEEVKSGIKKNRILIGGFSMGGCMAMHLAYRNHQDVAGVFALSSFLNKASAVYQALQKSNGVLPELFQCHGTADELVLHSWAEETNSMLKSLGVTTKFHSFPNVYHELSKTELDILKLWILTKLPGEMEKQK

SEQ ID NO: 918589 - protein, 131 aa, Homo sapiens
MWIKQVLNQDLTFQHIKIIYPTAPPRSYTPMKGGISNVWFDRFKITNDCPEHLESIDVMCQVLTDLIDEEVKSGIKKNRILIDVSTSGVIGGILKEPFRWLLSMVGYCYDKNLLFLAGMLKITDNFYSLFT

SEQ ID NO: 918590 - protein, 237 aa, Homo sapiens; identical to SEQ ID NO: 918588

SEQ ID NO: 918591 - protein, 199 aa, Homo sapiens; identical to SEQ ID NO: 918586

SEQ ID NO: 918592 - protein, 183 aa, Homo sapiens [sequence omitted]

SEQ ID NO: 918593 - protein, 169 aa, Homo sapiens
MAAASGSVLQRCIVSPAGRHSASLIFLHGSGDSGQGLRMWIKQVLNQDLTFQHIKIIYPTAPPRSYTPMKGGISNVWFDRFKITNDCPEHLESIDVMCQVLTDLIDEEVKSGIKKNRILIDVSTSGVIGGILKEPFRWLLSMVGYCYDKNLLFLAGMLKITDNFYSLFT

SEQ ID NO: 918594 - protein, 140 aa, Homo sapiens
GIWKMKSLSDFSKKVVFEPRRVGLNGTVIGRELERSYTPMKGGISNVWFDRFKITNDCPEHLESIDVMCQVLTDLIDEEVKSGIKKNRILIDVSTSGVIGGILKEPFRWLLSMVGYCYDKNLLFLAGMLKITDNFYSLFT

SEQ ID NO: 918595 - protein, 221 aa, Homo sapiens
MAAASGSVLQRCIVSPAGRHSASLIFLHGSGDSGQGLRMWIKQVLNQDLTFQHIKIIYPTAPPRFKITNDCPEHLESIDVMCQVLTDLIDEEVKSGIKKNRILIGGFSMGGCMAMHLAYRNHQDVAGVFALSSFLNKASAVYQALQKSNGVLPELFQCHGTADELVLHSWAEETNSMLKSLGVTTKFHSFPNVYHELSKTELDILKLWILTKLPGEMEKQK

SEQ ID NO: 918596 - protein, 113 aa, Homo sapiens; identical to SEQ ID NO: 918587

SEQ ID NO: 918597 - protein, 199 aa, Homo sapiens; identical to SEQ ID NO: 918586

SEQ ID NO: 918598 - protein, 246 aa, Homo sapiens
MAAASGSVLQRCIVSPAGRHSASLIFLHGSGDSGQGLRMWIKQVLNQDLTFQHIKIIYPTAPPSYTVGPSFARSYTPMKGGISNVWFDRFKITNDCPEHLESIDVMCQVLTDLIDEEVKSGIKKNRILIGGFSMGGCMAMHLAYRNHQDVAGVFALSSFLNKASAVYQALQKSNGVLPELFQCHGTADELVLHSWAEETNSMLKSLGVTTKFHSFPNVYHELSKTELDILKLWILTKLPGEMEKQK

SEQ ID NO: 918599 - protein, 129 aa, Homo sapiens
MPLRSGIRISIHFHSHSISYILQLVFTTETCGAIQHLHNFHSSDWFGVIGTCLCVQVSNDVPRNEAKPILAPPGWVHSDPLSSPPTHSGFPGDFLAQNNTILAPQLETRVWNCPHVQWLLGLLCRGSEE

SEQ ID NO: 918600 - protein, 155 aa, Homo sapiens
QQTLPLPFMMFTWAEGSLPADSHTAPALLFLKSLATGADWPAAGRVILRGRGPGRIVSSRAGWTPQRPDLGNPSLEVPGPELPEGWVRGLGGVRFGFLGHSGAAAQAAGAEPSPAPSATSPGTPSLLLDNTPPPPGPPSPKPPSFVQRQILRTHP

SEQ ID NO: 918601 - protein, 157 aa, Homo sapiens
TKRLAPAECGDSKLVQLGVSRSSIRLQQRRRNQPLDARLRTLLSGQSARRLVPNASLCGDPSDTSLGVSILIRSIQLPDLTSTGCTPLSSLRPRSAAFAPRYTRLVMRRSSRSFRLQCTGFPSSSAQSISAHLSNSMPSSLLTISRCPGMFAVRCPL

SEQ ID NO: 918602 - protein, 155 aa, Homo sapiens; identical to SEQ ID NO: 918600

SEQ ID NO: 918603 - protein, 155 aa, Homo sapiens; identical to SEQ ID NO: 918600

SEQ ID NO: 918604 - protein, 300 aa, Homo sapiens
QWGQSPPSSPAAGLLRKGEMGEGSPLLASLLYTTKVGGAGRGAVMQAQLTDALLCLQIMSVLLFIEHSVEVAHGKASCKLSQMGYLRIGRFLIALRPLPRDAFLSLTLAEVDPSLHLQPSTLSDLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMEDMPHNQFIKMMIIFSIAFITVLIFKVYMFKCVWRCYRLIKCMNSVEEKRNSKMLQKSHIDSRRRREN

SEQ ID NO: 918605 - protein, 96 aa, Homo sapiens
QQLPLLCPAPGTRLFPLQCLRGGDGSTMDPRLSTVRQTCCCFNVRIATTALAIYHVIMSVLLFIEHSVEVAHGKASCKLSQMGYLRIDYFNSEEKG

SEQ ID NO: 918606 - protein, 191 aa, Homo sapiens [sequence omitted]

SEQ ID NO: 918607 - protein, 160 aa, Homo sapiens
MLFIISLSLLIGVVKNREKYLLPFLSLQIMDYLLCLLTLLGSYIDILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 918608 - protein, 289 aa, Homo sapiens
QQLPLLCPAPGTRLFPLQCLRGGDGSTMDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 918609 - protein, 289 aa, Homo sapiens; identical to SEQ ID NO: 918608

SEQ ID NO: 918610 - protein, 88 aa, Homo sapiens
AAASPSLPCSRHQALSPSVSQRRGRQHHGPPLVHCPPDLLLLQCPHRNHRPGHLPCDHERLVVHRALGRGGPWQGVLQALPDGLPQDR

SEQ ID NO: 918611 - protein, 91 aa, Homo sapiens
TRMRGPSRSSWMLASGESGGSCLAYVLGLLEREKDSSAKHSLTWAFFQVYMFKCVWRCYRLIKCMNSVEEKRNSKMLQKVSVAAGGCQPCH

SEQ ID NO: 918612 - protein, 275 aa, Homo sapiens
QQLPLLCPAPGTRLFPLQCLRGGDGSTMDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVLPSYSESGYRAESK

SEQ ID NO: 918613 - protein, 55 aa, Homo sapiens
MQGTLDGAGPTFQNREKYLLPFLSLQIMDYLLCLLTLLGSYIELPAYLKLASRSR

SEQ ID NO: 918614 - protein, 289 aa, Homo sapiens; identical to SEQ ID NO: 918608

SEQ ID NO: 918615 - protein, 289 aa, Homo sapiens; identical to SEQ ID NO: 918608

SEQ ID NO: 918616 - protein, 283 aa, Homo sapiens
QQLPLLCPAPGTRLFPLQCLRGGDGSTMDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 918617 - protein, 289 aa, Homo sapiens; identical to SEQ ID NO: 918608

SEQ ID NO: 918618 - protein, 70 aa, Homo sapiens
APLQSQQPVQAQVTPQPQTPVQLPSVATPQSSQQQPTPVHAQPPGTPLSSSSSKSNSDLGIETAREKCDQ

SEQ ID NO: 918619 - protein, 146 aa, Homo sapiens [sequence omitted]

SEQ ID NO: 918620 - protein, 150 aa, Homo sapiens
GLRLQVQGSDNLQCLSNSGMTKTSLPFSGVHTTMRNTTSLKWAESLLLTLDLEKPVSLLLSVTNLYSKNSAQFSTILQTLSFPATFTPSPSIPLSSAYFFFFSDRVSLCRPGRSAVAQSWAHCSLNLPGSSDSPASAPQVAGTTSAHHHA

SEQ ID NO: 918621 - protein, 101 aa, Homo sapiens
MITHGSDTGKKRIRRGGNILVAKEHPRTIRAVGAPNNVVGDTDHPHRRDYIRAPLEPRTIMQILRRGYCGRLNRQAASNGDPAGRRLGDSGKRRLSHLFSR

SEQ ID NO: 918622 - protein, 182 aa, Homo sapiens
MTLEQADHGEMIWLKMNMRNKGRGTNHYTNKMLLPLPYKREETLSSLCIHLKSPGDMKSSPSGPDAAPVEGEDIMKCVVKEGNHHSAMTPRSAGTYTGQRAAWQRAEQHTHKWYVLPPKSKDTQDRYSYVIIKTMRIGEWHGLTYTVFKDCSGCNVGPGFPHQGMLVPFTEIRNTGRPVKSG

SEQ ID NO: 918623 - protein, 182 aa, Homo sapiens
SAPVPVVGAVAPSVPTGRRLGFSRVQGSMDVDNGSGPWLAQEPGVITNPGPRGWDQAPRSRLPVAGLLSPSKPKHRQSRRCAFRRPPRASRRRRRPASRRTSVAPPCCCWGAPEASIPCPGFRLSGRPPFRPRSRASPAPELRASTTSAGSGQGFHCKVGCQTCWSSPNPELISAACHHCWG

SEQ ID NO: 918624 - protein, 108 aa, Homo sapiens
MEDSSTDQEATAWAPELTSSPCTDEERSHETSAQSGNRALFVTSCLSGGPVMKALPDWAQGIQKGQLVFAIVCCFSITSSPKQHWMNASRGSHNSFQDLVTIVSVPVQ

SEQ ID NO: 918625 - protein, 165 aa, Homo sapiens
MGLGKVNPAGYLEGVNQGPRKIPGGRMQLEINCPIKELELDLECFGEPWKVLDKGGASQIRVRDDCRRLTGMSEQEQTREGACGGGLEMAREGSCLDEQSPETVSGTHRENLQLKGDARGDITLLPFDCVWMPLLTNTTIPLLDWRGCREGIVSVDCTLSVSLVG

SEQ ID NO: 918626 - protein, 152 aa, Homo sapiens
MGLGKVNPAGYLEGVNQGPRKIPGGRMQLEINCPIKELELDLECFGEPWKVLDKGGASQIRVRDDCRRLTGMSEQEQTREGACGGGLEMAREGSCLDEQSPETVSGTHRENLQLKGDARGDITLLPFDCVWMPLLTNTTIPLLDWRGCREGF

SEQ ID NO: 918627 - protein, 1404 aa, Homo sapiens
MCEVMPTINEGGPPHGADADANFEQLMVNMLDEREKLLESLRESQETLAATQSRLQDAIHERDQLQRHLNSALPQEFATLTRELSMCREQLLEREEEISELKAERNNTRLLLEHLECLVSRHERSLRMTVVKRQAQSPSGVSSEVEVLKALKSLFEHHKALDEKVRERLRAALERVTTLEEQLAGAHQQVSALQQGAGVRDGAAEEEGTVELGPKRLWKEEDTGRVEELQELLEKQNFELSQARERLVTLTTTVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKASGPGAWDLPLSPMFLSSQGARQGRERVGGALGQEPENCFPPCDSREHTALCLSVGRVIPVLITLQGCDSLIRRGVKVLEGEEAMLMQSVFLFLFFFFLILYTVVVNTFFHLGLEQKDYDFHLWKGETLEEKMVYISLKGKGDVLRLGLSEEEAGETWQVLKYLGRKAMGMVVLLQDDKWRLSVTGTGGHDPQGHPGTRAEERHGNIEEHLRQLEGQLEEKNQELARVRQREKMNEDHNKRLSDTVDRLLSESNERLQLHLKERMAALEEKNTLIQELESSQRQIEEQHHHKGRLSEEIEKLRQEVDQLKGRGGPFVDGVHSRSHMGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 918628 - protein, 1200 aa, Homo sapiens
LIADSRGYTEGQATGKEDTGRVEELQELLEKQNFELSQARERLVTLTTTVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKASGPGAWDLPLSPMFLSSQGARQGRERVGGALGQEPENCFPPCDSREHTALCLSVGRVIPVLITLQGCDSLIRRGVKVLEGEEAMLMQSVFLFLFFFFLILYTVVVNTFFHLGLEQKDEDFHLWKGETLEEKMVYISLKGKGDVLRLGLSEEEAGETWQVLKYLGRKAMGMVVLLQDDKWRLSVTGTGGHDPQGHPGTRAEERHGNIEEHLRQLEGQLEEKNQELARVRQREKMNEDHNKRLSDTVDRLLSESNERLQLHLKERMAALEEKNTLIQELESSQRQIEEQHHHKGRLSEEIEKLRQEVDQLKGRGGPFVDGVHSRSHMGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 918629 - protein, 1560 aa, Homo sapiens
MCEVMPTINEGGPPHGADADANFEQLMVNMLDEREKLLESLRESQETLAATQSRLQDAIHERDQLQRHLNSALPQEFATLTRELSMCREQLLEREEEISELKAERNNTRLLLEHLECLVSRHERSLRMTVVKRQAQSPSGVSSEVEVLKALKSLFEHHKALDEKVRERLRAALERVTTLEEQLAGAHQQVSALQQGAGVRDGAAEEEGTVELGPKRLWKEEDTGRVEELQELLEKQNFELSQARERLVTLTTTVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKASGPGAWDLPLSPMFLSSQGARQGRERVGGALGQEPENCFPPCDSREHTALCLSVGRVIPVLITLQGCDSLIRRGVKVLEGEEAMLMQSVFLFLFFFFLILYTVVVNTFFHLGLEQKDYDFHLWKGETLEEKMVYISLKGKGDVLRLGLSEEEAGETWQVLKYLGRKAMGMVVLLQDDKWRLSVTGTGGHDPQGHPGTRAEERHGNIEEHLRQLEGQLEEKNQELARVRQREKMNEDHNKRLSDTVDRLLSESNERLQLHLKERMAALEEKNTLIQELESSQRQIEEQHHHKGRLSEEIEKLRQEVDQLKGRGGPFVDGVHSRSHMGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEGENRRAGHGRGPAERGLLPGTPGPGRVERGEAEAGAPRSCAAAALTLRGERVCALTRRSVCSPAAADFSQLGRRGRRDWRPPRFGPTPADPPSSRPGSDGGVPVARGKWARPGDAGTLLLALGPTHLPLAAGLALPLQSRLPALPGLPLPASSGLGRFALGARCVAAVAHILQPLSSCFAT

SEQ ID NO: 918630 - protein, 156 aa, Homo sapiens [sequence omitted]

SEQ ID NO: 918631 - protein, 172 aa, Homo sapiens
SGCFSLALTLLLDHGPLRSRASSQMLALLLDQGALVFWDVSSFIKVAYPNQFPNGIKKPLPKGGRLSLKEDRKNRQEKTSCERKQGAQRAQRHIQCDSFEGQRVLTLTLHNDMEISVLATSSVSAALLTCTARDTDNIGNTVFLWDLFASSITDEFFSSKHNNSFSTGTSSS

SEQ ID NO: 918632 - protein, 172 aa, Homo sapiens; identical to SEQ ID NO: 918631

SEQ ID NO: 918633 - protein, 150 aa, Homo sapiens
MSKLAQRQNSMSLAPVDFECVSEENLVGNIEETLLTCLKCPSLSFQVARALEQPLQYSHKELVYSEGQQQLQEGEDATMSPRPRPRSLDLGAAVAVDALQLDDLSWASDPGLQPYFSISRYSMPTPQLHVESKQLTQPRYSEDTNDNSSY

SEQ ID NO: 918634 - protein, 150 aa, Homo sapiens; identical to SEQ ID NO: 918633

SEQ ID NO: 918635 - protein, 352 aa, Homo sapiens
MIVQLCAFWALNSASFQCPGKSTSPGRGGPEDFVNDDGGNDGRNNSVVAYYVPSTVVSSLYGTSFNFPNNSVKKVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYRESKPGFLSDSWVSKSNRKCTRKAPNP

SEQ ID NO: 918636 - protein, 622 aa, Homo sapiens
QAVRFGPSQGMCSEARLARRLRDALREEEPWAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGENPHPITPFTRQLYHQQLEEAQIAPGPEFSGHSLELAAALRTGCIPDVQADEDALAQQFEQPDPARRWREGVVKSSFTYLLLDPRETQDLPARAFSLTPAERLQTFIRAIFYVGKGTRARPYVHLWEALGHHGRSRKQACPKVRQILDIWASGCGVVSLHCFQHVVAVEAYTREACIVEALGIQTLTNQKQGHCYGVVAGWPPARRRRLGVHLLHRALLVFLAEGERQLHPQDIQARG

SEQ ID NO: 918637 - protein, 140 aa, Homo sapiens
AAATELAAAASEEYSGAVAKAAEPAWLAGDLSDEAVEELLRCGADPNLVLEDGAAAVHLAAGARHPRGLRCLGALLRQGGDPNARSVEALTPLHVAAAWGCRRGLELLLSQGADPALRDQVGRHCAGKERLGEPRGREGR

SEQ ID NO: 918638 - protein, 625 aa, Homo sapiens
AAATELAAAASEEYSGAVAKAAEPAWLAGDLSDEAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGENPHPITPFTRQLYHQQLEEAQIAPGPEFSGHSLELAAALRTGCIPDVQADEDALAQQFEQPDPARRWREGVVKSSFTYLLLDPRETQDLPARAFSLTPAERLQTFIRAIFYVGKGTRARPYVHLWEALGHHGRSRKQACPKVRQILDIWASGCGVVSLHCFQHVVAVEAYTREACIVEALGIQTLTNQKQGHCYGVVAGWPPARRRRLGVHLLHRALLVFLAEGERQLHPQDIQARG

SEQ ID NO: 918639 - protein, 139 aa, Homo sapiens
MVSIMVKNIQYLRKLKYPTNSTLTETHRAENKYINKLRKNTKIFCPNPPAILNGRHTGTPPGDIPYGKEVSYTCDPHPDRGMTFNLIGESTIRRTSEPHGNGVWSSPAPRCELPVGAGSHDALIVGKFYEVFAEEFCHL

SEQ ID NO: 918640 - protein, 199 aa, Homo sapiens
MKEKGLVSIQRLAACHSEVLTGKLHDVCLVVTGEVTNLRSKVSHLAISTLGDLFQALKKNMDQEAEEIARCLLQKMADTNEFIQRAAGQSLRAMVENVTLARSLVVLTSAGVYSVQQTCIKLLPSTRDVSGTAGHHRNPLIRKYAAEHLSAVLEQIGAEKLLSGTRDSTDMLVHNLVRLAQDSNQDTSDLDEIGDYYSK

SEQ ID NO: 918641 - protein, 148 aa, Homo sapiens
MTICAGCRIVPLVVHRESQELPLHPALRAPWRSLPRQSRLFYVSQGPQEEETVVFPELRDLPRGPAGVHLAVHVGNAAVALGGAVELPDLAYAEALRELLPDGRTQPVPHRQAHAVSPLRLAHRLLQQVAADLPDVLNHLGDGGLCTC

SEQ ID NO: 918642 - protein, 127 aa, Homo sapiens
MVAVGRRRKVRPPLRVQKKKDFRDVSLGRSLKSHLAKKSCEKKVDVLSKKCNDDRCQPAFSSSGRGPQAVVCMPVYRCGHLIASEDSLPFTLITKEVQKAVYGFMPNEWYWKGIRFAQLEDVLGRWV

SEQ ID NO: 918643 - protein, 168 aa, Homo sapiens
MVFLPWELHTKKGKMALLASNGCFIRCNEAGDIEAKSKTAGEEEMIKSFIDGNLGCFQSFALINSAAVHNIEYASICGCAGGPEDKFPESELPGGYELSLTDRKTASDPPYILIVFVSQFMEITVISRCAALELESGHRDPLRDMSHYHCQLPVLWVILIVECRSINL

SEQ ID NO: 918644 - protein, 149 aa, Homo sapiens
QPFSVWVKTEAGSGQTYAVRECLLRLHFCSSPPWCCSGSHTRPEPASASLRRSVPEPWPSNLMRSLPSLCSREPRRRGGSCTSGGSLLSSFRTHSTPLESGGSRGAESRLCGLPGFALAPVRAGLRPDRGSWRLCREGQPPALTTLETG

SEQ ID NO: 918645 - protein, 168 aa, Homo sapiens; identical to SEQ ID NO: 918643

SEQ ID NO: 918646 - protein, 149 aa, Homo sapiens; identical to SEQ ID NO: 918644

SEQ ID NO: 918647 - protein, 168 aa, Homo sapiens; identical to SEQ ID NO: 918643

SEQ ID NO: 918648 - protein, 166 aa, Homo sapiens
PGGCKWVWRGPALLPCCVSRPDSGLPTTSLDSAPAQLPAALVGPQLPKAKLRRPSSGLTVASPGSAPALRWHLQAPNSLRSVGSSRPSLGLLAASVGPSRPQVSLELGLEEQQVGLPGPSSVLSAASPGAKLPRVSLSRPSSSCLPVVSFSPAQLMALGGLPRPRF

SEQ ID NO: 918649 - protein, 783 aa, Homo sapiens
MPSLLLPEGMYRPSLCLTADSSHPALPCLRPLQSKAAPAFWQLVQVQLLPHGDLFRPNSCLLQRAEVSAPASHWPVEAQLMPLVASTGPSPPCWRPLQARPLPHSGLSRPTSSSPWPPGAMLLPLGSLCGPSSCLPVASVGQARASGQTFQAQRLLLCIFSRPWTSSSRPLQAQLFLSAPLQAQTVVKSASPGPAPASRRPLWMQKFLESASPGPAPPASQWPLSAQPSSCLLAAFPGPAFDFWWPLQASTRPGLLPPEGLHRPSLCLTADSPRPASSRLTAASRVQSSCLSAASAGPAPACQWPLQAHGAHSSQRPFQAQFFPSGGLSGPRTSSSRPLQTHLHPPGVLSGPSSSSRLRLQARLLPLNNLFGLSAYPSPGGLGRPTASSSQAPQAQVRPHGGLSRMSSCPPMASAGPKWSPVGGLLHAKLGPPGGLCRPKSSSSWPGIGPGRAASRPPRAQLHPLGGLSRCKTSSSQPLQAQLLLPPSGLFQPSPAHGSRWPSQAPLLTFGGLFRPELDLQWAFAGPASCLSKACMGPASASASQRTLHAQLALTSLRPPESKAPASRPLGQAQLPPASGLFRPMGLIPHNNLSRPSFSLPAASPGPEPPQVGLSRPTCSLLASSPGPALLPCCVSRPDSGLPTTSLDSAPAQLPAALVGPQLPKAKLRRPSSGLTVASPGSAPALRWHLQAPNSLRSVGSSRPSLGLLAASVGPSRPQVSLELGLEEQQVGLPGPSSVLSAASPGAKLPRVSLSRPSSSCLPVVSFSPAQLMALGGLPRPRF

SEQ ID NO: 918650 - protein, 143 aa, Homo sapiens
MLSALNPWAGLELLGPRDPPTSASKGAGITGMSHRGWSPNKLTKAEFTYFGLLYAFQGYFLLVNERLEDATSCLFSGDHTQEEPDSLLEVPVSFPLFLQHPFRRHLCFSAATREAQHAWRLALQGGIRLQGIGLTFFTQKMGF

SEQ ID NO: 918651 - protein, 173 aa, Homo sapiens
VHHFILQMGKLRLRQFKIQAAWLQHPSSLLLSCLFSHPPSDPIILPPSDIPWPPGLCRPLPATGLLPSAEQDSSSLGAHHAQMGPGTQLVLNKSSSSSSEHGCIPLAGGFGASVTECVQGVVAAPRGPLCPKMALLSPILDVVLTVALSLLLLGLILGLLCFFTCRLARPLST

SEQ ID NO: 918652 - protein, 140 aa, Homo sapiens [sequence omitted]

SEQ ID NO: 918653 - protein, 347 aa, Homo sapiens
MEPIYEEYLANHGTIVKPYYWLSFSLDCSNCPYHIRTGEEARVSLTEFCQIFGFPYGTTFPQTKHLTFYELKTSSGSLVQKGHASSCTGNYIHPESMLFEMNGYLDSAIYNNDSIRHIILYSNNSPCNEANHCCISKMYNFLITYPGITLSIYFSQLYHTEMDFPASAWNREALRSLASLWPRVVLSPISGGIWHSVLHSFISGVSGSHVFQPILTGRALADRHNAYEINAITGVKPYFTDVLLQTKRNPNTKAQEALESYPLNNAFPGQFFQMPSGQLQPNLPPDLRAPVVFVLVPLRDLPPMHMGQNPNKPRNIVRHLNMPQMSFQETKDLGRLPTGSLTQNQLM

SEQ ID NO: 918654 - protein, 646 aa, Homo sapiens
PPPPDSPGRLPRPGPGAEEGRDGLSARGAAAQQRDCTMGNQDGKLKRSAGDALHEGGGGAEDALGPRDVEATKKGSGGKKALGKHGKGGGGGGGGGESGKKKSKSDSRASVFSNLRIRKNLSKGKGAGGSREDVLDSQALQTGELDSAHSLLTKTPDLSLSADEAGLSDTECADPFEVTGPGGPGPAEARVGGRPIAEDVETAAGAQDGQRTSSGSDTDIYSFHSATEQEDLLSDIQQAIRLQQQQQQQLQLQLQQQQQQQQLQGAEEPAAPPTAVSPQPGAFLGLDRFLLGPSGGAGEAPGSPDTEQALSALSDLPESLAAEPREPQQPPSPGGLPVSEAPSLPAAQPAAKDSPSSTAFPFPEAGPGEEAAGAPVRGAGDTDEEGEEDAFEDAPRGSPGEEWAPEVGEDAPQRLGEEPEEEAQGPDAPAAASLPGSPAPSQRCFKPYPLITPCYIKTTTRQLSSPNHSPSQSPNQSPRIKRRPEPSLSRGSRTALASVAAPAKKHRADGGLAAGLSRSADWTEELGARTPRVGGSAHLLERGVASDSGGGVSPALAAKASGAPAAADGFQNVFTGERALLLASGSQVACQSGPSPATRPPWALEGGDLVVAHLFSVGNPFPPSELTPHGEMTWTYLLVFCVLTRS

SEQ ID NO: 918655 - protein, 271 aa, Homo sapiens
MWCPNFKFHLTQNFLIEDGAWGYLEDGQSQRKTTKPEGAPTEEKRPVGFRSSFGQREAAGSASPEPAGWRLAVRGGLVLTQWPQETVTHAVSTCVILWTAGGPREQLLWRRTQPRPGPMAAPAGCPLPPVGSASQRQREHWVQPLEGLEGACFGDSALVDPLSLCRRDLNGRSEGLQMSELSMALPGVCLSDLAFVEPPEPTLCSSESLICLGMSNAVVFIILVFSSINSKSQHQQCQHGRAHPNGFIMLNSLEITKISLLHTFMGTYISL

SEQ ID NO: 918656 - protein, 153 aa, Homo sapiens
GKYNACSEAPPGMFVKIANFLSLHTDWEGLNEVAEPYPRVSDSVGLSWVLRICIPNEALGEADAAGPGITFLKPLVQGDSKDYWTSEERDCFQFEGNKSYIRRYCWELSMWIAFGQSHGSFSVSAAEMEPLSSSSRPKGRAGSGSSSILLQSY

SEQ ID NO: 918657 - protein, 120 aa, Homo sapiens
MREGQRWDLNLGFTRFSLLPSLSPCLAGTELRLNNCSLGGRRMAGLAGEVKSDIGISQDYFMVLLHILHLMEITVQVMWNPTLWCQTVNCLSTGYPLNNCEIEFVMNEGLGFNSTTGEKV

SEQ ID NO: 918658 - protein, 703 aa, Homo sapiens
PFFSPVPGPTSSATNVSMVVSAGPLSSEKAEMNILEINEKLRPQLAEKKQQFRNLKEKCFLTQLSGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDNEDVQVEVAEKVQKSSAPREMQKAEEKEVPEDSLEECAITYSNSHGPYDSNQPHRKTKITFEEDKVDSTLIGSSSHVEREDAVHIIPENESDDEEEEEKGPVSPSSEKFVITDFLKPTSVSSSKSFSILLCSIAGEELRSFGGEGMNLQESEEEEVPQESWDEGYSTPSIPPEMLASYKSYSSTFHSLEEQQVCMAVDIGSEYSIVKVIKLQFMAQSQAMPVPTWTDCHDIELKAGHRWDQVKKEDQEATGPRLSRELLDEKGPEVLQDSLYRCYSTPSGCLELTDSCQPYRSAFYVLEQQRVGLAVDMDEIEKYQEVEEDQDPSCPRLSRELLDEKEPEVLQDSLGRWYSTPSGYLELPDLGQPYSSAVYSLEEQYLGLALDLDRIKKDQEEEEDQGPPCPRLSRELLEVVEPEVLQDSLDRCYSTPSSCLEQPDSCQPYGSSFYALEEKHVGFSLDVGVAITELRDVIATGRTYRHMLNGVLMEVEEPEVLQDSLDGCYSTPVCCCKKKKTFSA

SEQ ID NO: 918659 - protein, 149 aa, Homo sapiens
MHLPLDWRLAVSWDSLSRHTEICKDLFYLDESSVQWRIQMHKQTLMMKYKCSKEECGKLCRGEGKASPSLSEGSVKNSVHKRQINRRKRILKETDQTYLIIVYLIIVSHDTGAFRMKIQLPSGVQELVYHLEITERTGAWSMAKTRLWW

SEQ ID NO: 918660 - protein, 262 aa, Homo sapiens
CRRTTSPSLPLTLLLAAPPAQLLLPPGHDQSPCWHPGPALSPGTLGPLSWAMANSGLQLLGYFLALGGWVGIIASTALPQWKQSSYAGDAIITAVGLYEGLWMSCASQSTGQVQCKLYDSLLALDGHIQSARALMVVAVLLGFVAMVLSVVGMKCTRVGDSNPIAKGRVAIAGGALFILAGLCTLTAVSWYATLVTQEFFNPSTPVNARYEFGPALFVGWASAGLAVLGGSFLCCTCPEPERPNSSPQPYRPGPSAAAREYV

SEQ ID NO: 918661 - protein, 160 aa, Homo sapiens
MAPPVRLERPFPSRRFPGLLLAALVLLLSSFSDQCNVPEWLPFARPTNLTDDFEFPIGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDSDDIRE

SEQ ID NO: 918662 - protein, 174 aa, Homo sapiens
MAPPVRLERPFPSRRFPGLLLAALVLLLSSFSDQCNVPEWLPFARPTNLTDDFEFPIGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDSELKYAFLFLLPIHSNFSLE

SEQ ID NO: 918663 - protein, 197 aa, Homo sapiens
SLLTLRKEVTKIQYMSNCELPSSTAFVWKEAQGLTRGIHRKPKHCQALLLHLGQQDQCNVPEWLPFARPTNLTDDFEFPIGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDSELKYAFLFLLPIHSNFSLE

SEQ ID NO: 918664 - protein, 149 aa, Homo sapiens
AEHLGMAGCRSRAVPFREAAEAQREFKNCAGRPVVLGDLAHPLQLLAWVLSPSLPGASGMGWPLRVRGLPSLHPPTRNLLWPASAVRSPGSCQCLSLHTSPQAEGASSSLGQPREGLPQCSGGLKGSSSAARVDTEAKEAQRGKCVSSH

SEQ ID NO: 918665 - protein, 131 aa, Homo sapiens
LTLLQLMLGSLHPLSCTHCPTSPSEMNPVPQLEMQKSHVFCVTHTESCRLELFLFGHLGTCQVFFLKKWYLWVVCPLSSCHQMGWLLCGKMERREDYSDGTRKQDICGQKLPLRTKPVKDGKIHDGSLLEL

SEQ ID NO: 918666 - protein, 131 aa, Homo sapiens; identical to SEQ ID NO: 918665

SEQ ID NO: 918667 - protein, 143 aa, Homo sapiens
PGKSIAQMCLSYHFLVAVLNQWVPGIGEQRPSPPASRETILSDMDDDNQSMPTVIISSAMYPLLAFLLPYVTIPAPSLLLPGITFPEKLHSAALEPDSVPGSCSRGASQASTAPTSVGTVDPVVDIPGDLFTINLAGANSLGP

SEQ ID NO: 918668 - protein, 143 aa, Homo sapiens; identical to SEQ ID NO: 918667

SEQ ID NO: 918669 - protein, 247 aa, Homo sapiens
MNTSIASSSMSVLEKSFHSTQPAIGFFQTLLTATNPSTRRGSNEKLVQRMLTHPSVSTANPKRRGRGRAGAEGTLAAVFTEHTQKDLPERVPKRHNSTRSTKWRGMAVKRQTPTERLMGTAFQRQGWVAGTRAPRGPDQQKRPVTLSPSDKIQPQREGACETHEGLALDLHLTLFQREFSGRQHCQFPFISLEVNILEFSTHIHRATLLGHLHTHTPGPPLPLGMSKPDAVSHPGNTFFPAHTSATG

SEQ ID NO: 918670 - protein, 152 aa, Homo sapiens
LGSIRVTMGQMWAVVRSTLELFHTDNEEEGEYNKVTVEVTDQVYLPPKAKAEKEGEVHPYPSAPPHYYFEENDPPDLSFLEDTGGKAHLVDYNKACDDIRDNLHKATLLAQATAGLRVDKGNTLFPGACFNCGKHGHTKKNLKKKSASQATR

SEQ ID NO: 918671 - protein, 209 aa, Homo sapiens
MLGKLNTEEESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPEIETT

SEQ ID NO: 918672 - protein, 222 aa, Homo sapiens
MLGKLNTEEESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPGNNQRTCWPCRFLSLGSR

SEQ ID NO: 918673 - protein, 134 aa, Homo sapiens [sequence omitted]

SEQ ID NO: 918674 - protein, 134 aa, Homo sapiens [sequence omitted]

SEQ ID NO: 918675 - protein, 134 aa, Homo sapiens [sequence omitted]

SEQ ID NO: 918676 - protein, 52 aa, Homo sapiens
MKNKRRRRGEGGAQRREEAQRGGGEAERGSNGAKSESGERRNKKRSGGGRRE

SEQ ID NO: 918677 - protein, 238 aa, Homo sapiens
WAQVDEAWSLAGRAMLLEVQGTPPGFCTDFHSHLFLACFMLVLTQSSIFSLLSMAINRYLASHSRLRHKSLVTGTQTRGVTAVLWVLAFGTGLTPFLEWNSKDSTSNNCMEPWDGTMNESCCLVKCLFQNAVPMSYMVYFSFGGTTLQWEIYTAKSLAVMVGMFALCSLPVRTMDCVTLFQLAQAKDKPKWARKMTILLSHANLIVNPIVYNHWNRESCYTFHKIIYRKLPEGKKLEG

SEQ ID NO: 918678 - protein, 128 aa, Homo sapiens
MDLQYHCAWKVFVSPIKPIGTAGPRGSLWNGCNADVGGHVKAHLALPHLTEARPSGLLQAPHFDSLGARKFVVIFCGSCRKQKMHCLDGPSDSPPPRLERQRLPGRARKQVTDQLIQAKAAGRPGIWP

SEQ ID NO: 918679 - protein, 138 aa, Homo sapiens
MPEIFHLPINFLQLVSCAHFVVGESFNNCTTAYVGGYPYFHLPSENPGDTKTHLEFLHQRFRYFSHVYFQTRNNSDVASAALEIHISYTGLGFKCSQASIIILMFQCRSIPCQSLSNLPKILCGNSLLLKVLFLDGSK

SEQ ID NO: 918680 - protein, 129 aa, Homo sapiens
MPQNCWVLPAPAPKEALCTRPLLPGVGEGWRQQLRTVSFYLFSAFFSTFYLSTFFSTKKLKPGEHLHLIWTKRNGHNCLDELWHRHSAKKRKLAEEALQAKWTKTPHPCEGDRGLEIMNKSALSITHDA

SEQ ID NO: 918681 - protein, 306 aa, Homo sapiens
MGWGTSPHIRCASLLLVPKMLGKEGRLFVLGYALAAIYVGEYVGARPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHA

SEQ ID NO: 918682 - protein, 141 aa, Homo sapiens
MHAFLTCSKTISRLSLSGTVLNYKKGYHSGSHPIPPSLLKPVQHQGTYHGEDWQTDLTQMPPYRELQDLLVFIGTFNRWIEAFPTRTGKVLEVSKFLKKSFQDLDYQKVCKVTTDLTSQLRSHKIGSFPNYCCEEHHYCRT

SEQ ID NO: 918683 - protein, 1259 aa, Homo sapiens
YKDCMNSNEGIYSPGIKSSSLKEYPPCKTADLGSPCKEPHKTFVYDLDSHVDADDDPSTLALLQAVPNQSCRPHGSKLTHSVSDSLFGWETNRKHFLEGTSSVYPKERPEKLTSCASSCPLEMKLCPSVQTPQVQRERGPQGQGHGRMALNLQLSDTDDNETFDELHIESSDEKSPSDVSLAADTDKSVENLDVLVGFGKSLCGSPEEEEKQVPIPSETRPKTFSFIKQQRVVKRTSSEECVTVIFDAEDGEPIEFSSHQTGVVTVTRNEISINSTPAGPKAEHTELLPQGIACLQPRAAARDYTFFKRSEEDTEKNIPKDNVDNVPRVSTESFSSRTVTQNPQQQKLVKPTHNISCQSNSRSSAPMGIYQKQNLTKIPPRGKSSPQKSKLMEPEATTLLPSSGLVTLEKSPALAPGKLSRFMKTESSGPLFELRSDPHIPKHSAQLPHSSRMPSRRDWVQCPKSQTPGSRSRPAIESSDSGEPPTRDEHCGSGPEAGVKSPSPPPPPGRSVSLLARPSYDYSPAPSSTKSETRVPSETARTPFKSPLLKGISAPVISSNPATTEVQRKKPSVAFKKPIFTHPMPSPEAVIQTRCPAHAPSSSFTVMALGPPKVSPKRGVPKTSPRQTLGTPQRDIGLQTPRISPSTHEPLEMTSSKSVSPGRKGQLNDSASTPPKPSFLGVNESPSSQVSSSSSSSSPAKSHNSPHGCQSAHEKGLKTRLPVGLKVLMKSPQLLRKSSTVPGKHEKDSLNEASKSSVAVNKSKPEDSKNPASMEITAGERNVTLPDSQAQGSLADGLPLETALQEPLESSIPGSDGRDGVDNRSMRRSLSSSKPHLKPALGMNGAKARSHSFSTHSGDKPSTPPIEGSGKVRTQIITNTAERGNSLTRQNSSTESSPNKAPSAPMLESLPSVGRPSGHPSSGKGSLGSSGSFSSQHGSPSKLPLRIPPKSEGLLIPPGKEDQQAFTQGECPSANVAVLGEPGSDRRSCPPTPTDCPEALQSPGRTQHPSTFETSSTSKLETSGRHPDASATATDAVSSEAPLSPTIEEKVMLCIQENVEKGQVQTKPTSVEAKQKPGPSFASWFGFRKSRLPALSSRKMDISKTKVEKKDAKVLGFGNRQLKSERKKEKKKPELQCETENELIKDTKSADNPDGGLQSKNNRRTPQDIYNQLKIEPRNRHSPVAWLLSHRQLYQYSRKPQEKHENQSRYGSTKRLPDVPCIIKPQIVSISKAALVVSLKGGRENECVKMCNMLEIQSS

SEQ ID NO: 918684 - protein, 341 aa, Homo sapiens
NWLMTEQAQDLSANPTSLQPPVNLDPFACFPGQGPRLVPLHKGKSLRRALKERRLLEDFLRNHHYAVSRKHSSSGVVASESLTNYLDCQYFGKIYIGTLPQKFTLVFDTGSPDIWVPSVYCNSDACREKPPTLRSVQVLHPQNMGKSLSIQYGTGSMRGLLGYDTVTDLVEVMILLQVSNIVDPHQTVGLSTQEPGDVFTYSEFDGILGLAYPSLASEYALRLGFRNDQGSMLTLRAIDLSYYTGSLHWIPMTARILAVHCGQFDIDCGRLSSIPTAVFEIHGKKYPLPPSAYTSQDQGFCTSGFQGDYSSQQWILGNVFIWEYYSVFDRTNNRVGLAKAV

SEQ ID NO: 918685 - protein, 97 aa, Homo sapiens
GNILNIQQAIGATAGQYNEFDIDCGRLSSIPTAVFEIHGKKYPLPPSAYTSQDQGFCTSGFQGDYSSQQWILGNVFIWEYYSVFDRTNNRVGLAKAV

SEQ ID NO: 918686 - protein, 436 aa, Homo sapiens
MVAHACNPNTLALVAVPALEESAPQAKLSSEVRERRSDFPILSPGTRGIPPPKCRVLPAAPQGLLRPPSLTQRNPSRGGRRGWRSPPGVNRRALNAPSRPARLQQPPRPCGEVPGWRRRPQRSSWSDRGCSAAAGRSMTAVGVQVAGAWRGADPGCCPAVGGWGWEDGGRGVPTASAGVGLGVRAPPVPAPCCKPGSGGGWAGSNLGGPACLIIAAPEARTPAASARGLASTRGSQTSFGKIFLLFGVTSDLLAQRPLGQRQPRRSFFESFIRTLIITCVALAVVLSSVSICDGHWLLAEDRLFGLWHFCTTTNQTICFRDLGQAHVPGLAVGMGLVRSVGALAVVAAIFGLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 918687 - protein, 192 aa, Homo sapiens
NHGRRRERNRKWVLRPYMGAGPLDCGQEGLSQRALGDQLEGHSRNHLKHRQETVDYMIKQREDFEPFVEDDIPFEKHVASLAKPGTFAGNDAIVAFARNHQLNVVIHQLNAPLWQIRGTEKSSVRELHIAYRYGEHYDSVRRINDNSEAPAHLQTDVSEASDFSRIPRPTGNRLRAVYLALKTSNVFVESWH

SEQ ID NO: 918688 - protein, 164 aa, Homo sapiens
MFYSEASSQTAAEPRAASQGQRGKASEVKRQGCTQEERRNSWPRAARGEGVDRLAAAQIQGPLQRHGAQMIACGTLLDSTSSLGLGSFRGGVECLDLSHTQLPSNTQLPPSSSRSTQLFLQVHSVPGSTRAGGSKRDHGGSPWPVHRLECKLDTQKLAGPELDI

SEQ ID NO: 918689 - protein, 358 aa, Homo sapiens [sequence omitted]

SEQ ID NO: 918690 - protein, 114 aa, Homo sapiens
EFAFEAKNSARGVKRAGPLDCRGSPHQLPTPVKASQLENRGAAGHPAKALPTNCLSEEEVAKKRKNLATYCRPVKAKHCQAGAPADVACSVRRKKPGPALAFEEKCSTLKSKAH

SEQ ID NO: 918691 - protein, 315 aa, Homo sapiens
ASAAVMAVRERAAAAMAALERRVPSLDDFAGQSWSSWVERADLPAADGAELEESSKNTKKLDAMTLIKEDMSIFGHCPAHDDFYLVVCNHCSQVVKPQAFQKHCERRHGPLSKLYGRAPPHLQPLPALRNAMYVNGQGPACRAPGSTKTSSREKGQGSRSRGHQPPEKTQKDNLCLFVPVVNLEKMSSLPKPDGHGIRVAPPSAFLSQPGGLTKDSPGKPPMAPPSKEPPGRENIEIIPSEGSSHWAEGSPPEKEPSGTRLPPKTHRKMARKECDLNRQCGVINPETKKICTRLLTCKVTPFPARPWPLRRSALH

SEQ ID NO: 918692 - protein, 283 aa, Homo sapiens
ASAAVMAVRERAAAAMAALERRVPSLDDFAGQSWSSWVERADLPAADGAELEESSKNTKKLDAMTLIKEDMSIFGHCPAHDDFYLVVCNHCSQVVKPQAFQKHCERRHGPLSKLYGRAPPHLQPLPALRNAMYVNGQGPACRAPGSTKTSSREKGQGSRSRGHQPPEKTQKDNLCQPGGLTKDSPGKPPMAPPSKEPPGRENIEIIPSEGSSHWAEGSPPEKEPSGTRLPPKTHRKMARKECDLNRQCGVINPETKKICTRLLTCKVTPFPARPWPLRRSALH

SEQ ID NO: 918693 - protein, 349 aa, Homo sapiens
MPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACPASMPPTKDNLVPSYPAGSPSVAAACSQAECMGGSQAITSPLPANTPSPSFSKLPPSKASKSSKGKDGVEVEAPSRKRKLSPGPTTLKRTCILEPTGKGKPSGCRGLSAKTKTALSMGLNGTMGPRVKRAGPLDCRGSPHQLPTPVKASQLENRGAAGHPAKALPTNCLSEEEVAKKRKNLATYCRPVKAKHCQAGAPADVACSVRRKKPGPALAFEEKCSTLKSKAH

SEQ ID NO: 918694 - protein, 349 aa, Homo sapiens; identical to SEQ ID NO: 918693

SEQ ID NO: 918695 - protein, 209 aa, Homo sapiens
MPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACPASMPPTKDNLVPSYPAGSPSVAAACSQAECMGGSQAITSPLPANTPSPSFSKLPPSKASKSSKGKDGVEVEAPSRKRKLSPGCCRFL

SEQ ID NO: 918696 - protein, 119 aa, Homo sapiens
ICMFVSVWMWVLFPTGCFSGELWFLPSVLLFVALSHGVLQVPESLLAKDPGRDTARDESLEPKVCPAHTYVQGQCPQSSSSARTSSVAASHKCSARDVHRFLSNLRLHKGRTAQPPTSQ

SEQ ID NO: 918697 - protein, 132 aa, Homo sapiens
MPLALRFGDLVIFRMLSTLVRGGDIKAASCSLQLPSSFFSHRWWQPPPTAVSGSFRGGSNTSRGEVPSSHITDMAATVGLGIKGSPWMTLTGQLPPPCKKAWASLLEDESPPGSVVSADFRHVRESSARLSL

SEQ ID NO: 918698 - protein, 143 aa, Homo sapiens
MMLAVALRKCMLLWVEERKMQTVGSLTEFLGRTDMTSRRVKTVEGEKRPHTFQKMMSDAVGSLKHEDWKTENFSYMSPNHRVSVGERLKLDFLDLLLHSFIRSLADQKNTFIMQTVVYHKDSIFPPSQVTSHAPGQTDHPTFK

SEQ ID NO: 918699 - protein, 270 aa, Homo sapiens
QQLRHAVAGSQCPGMTTTMSPHACYGQVHPQLSPSTISGALNQPDGGGYSSFGLVQPRPPLEPSPTGRHRGVRAVSRAGLRRHRPCHGCHAVQSGNSRGCAKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLFSGALSPSLLHSLSQNSSRLTTPRNSLTLPSIPAGISNMAVGDMSSMLTSLAEESKFLNMMT

SEQ ID NO: 918700 - protein, 153 aa, Homo sapiens
MRTKGINVAAVRAQYALGQGPPTTGLWSGTSPWPVGNWAAQQETANSIVNCSCEGSRMCAPYENLMPDDLRWNSVIPKPSPHLICGKIVFHKTKHRIKLWFYDYVYTKNTHKVFFNALKNFLQHFNLRKGRDEKDALSVMLYSCQRTGTQASH

SEQ ID NO: 918701 - protein, 125 aa, Homo sapiens
MLENVLASHSKMQGALEKVQIELGRRDSEIAGLKKERDLNQQRVQKLEAEVDQWQARMLVMEDQHNSEIESLQKALGVAREDNRKLAMSLEQALQTNNHLQTKLDHIQEQLESKELERQNLETFK

SEQ ID NO: 918702 - protein, 125 aa, Homo sapiens; identical to SEQ ID NO: 918701

SEQ ID NO: 918703 - protein, 176 aa, Homo sapiens [sequence omitted]

SEQ ID NO: 918704 - protein, 125 aa, Homo sapiens; identical to SEQ ID NO: 918701

SEQ ID NO: 918705 - protein, 125 aa, Homo sapiens; identical to SEQ ID NO: 918701

SEQ ID NO: 918706 - protein, 130 aa, Homo sapiens
MLLWGSHRAYFCQRGVTSQFQQAFPSSSHACLLAHIVSGAVASDRLSEKSHFSSCPQRVSREKSCLKSKAENNSLFLVCPKSNDKGSCKRNAEGELKQTEEEKTQKRRQGEDGGRDGSDVATRQEIPRMP

SEQ ID NO: 918707 - protein, 316 aa, Homo sapiens
MVRCNNEAKDVSSIIVAFGYPFRLHRIQYEMPLCDEESSSKTMHLMGDFSAPAEFFVTLGIFSFFYTMAALVIYLRFHNLYTENKRFPLVDFCVTVSFTFFWLVAAAAWGKGLTDVKGATRPSSLTAAMSVCHGEEAVCSAGATPSMGLANISVLFGFINFFLWAGNCWFVFKETPWHGQGQGQDQDQDQDQGQGPSQESAAEQGAVEKQHQLLETWAALSVASYPPSCWSHEWQELSASCAVPGPRYLTWGLTCTLTVSENQPLLQSLSPLKSRAGRCYWCFFTLRPSSIFVFSVYPLPDTSFSPSLGPKAENQC

SEQ ID NO: 918708 - protein, 450 aa, Homo sapiens
RPQPLRARTAAPPRPSQPASQTGLRPTDGRSRSGPARLLCPGPAAPRSPAVSAASRPESQAPTPRPALAAPACPRPRAPGRTADKSPRQQVDRLLVGLRWRRLEEPLGFIKVLQWLFAIFAFGSCGSYSGETGAMVRCNNEAKDVSSIIVAFGYPFRLHRIQYEMPLCDEESSSKTMHLMGDFSAPAEFFVTLGIFSFFYTMAALVIYLRFHNLYTENKRFPLVDFCVTVSFTFFWLVAAAAWGKGLTDVKGATRPSSLTAAMSVCHGEEAVCSAGATPSMGLANISVLFGFINFFLWAGNCWFVFKETPWHGQGQGQDQDQDQDQGQGPSQESAAEQGAVEKQHQLLETWAALSVASYPPSCWSHEWQELSASCAVPGPRYLTWGLTCTLTVSENQPLLQSLSPLKSRAGRCYWCFFTLRPSSIFVFSVYPLPDTSFSPSLGPKAENQC

SEQ ID NO: 918709 - protein, 138 aa, Homo sapiens
MRIPFSLHILTNICVFNVLDLGHSDRIPVKKPILPLHIPVSGQRGEGSYGPVNVRSQILKPPIQVGIGHTSLTLISFVPLTFSQGAGIPSKQVQVQPLDLYFASLQRIPAFSPQAFSAEAPSIMEQNQIISTESFSIS

SEQ ID NO: 918710 - protein, 144 aa, Homo sapiens
MGHGTGCLCGNLNNAQGSQCLATLDLRVSVLEAGSPRSKCQQQALGGPASWFIDGHRLPMSSHGGRGKEGFPTHLPFTLRSPASYCSKLSHGQEVSQSSPRASIGAAYKKPLEAASLWNPLPLLATAYRTSSPPFLSCHCLAAP

SEQ ID NO: 918711 - protein, 271 aa, Homo sapiens
GHQLPVDMCFPRPPPRVLRKYQNKQDSTGGSWSLDGVSVFLASSQRPCCLREVTDRAPPAPAPMLGHGSYQQGGFTVRETRAGHAAAAPASRARASARECACLYPCSRVERSPMADSPCLCGAWHVDDFQVNMQQRQPRAWCRVEASQAGLCQHLWQPLQRVPAAAEDDLAKDMGFTVDIIVQCGKPGPTQTLLTLLPTQLPSSSDSSRPSTPSTQAGLNLQERRAHPGWDLTFPRSHNCGAADLGPGSPNSDEMQAASCPHSSVSCCPAV

SEQ ID NO: 918712 - protein, 805 aa, Homo sapiens
VSPRTILGTQQDLTMKCNEEEKSLSSEAFSKVSLTNLRRSAVPDLSSDLGMNIFKKFKSRKEDRERKGSIPFHHTGKRRPRRMGVPFLLHEDHLDVSPTRSTFSFGSFSGLGEDRRGIEKGGWQTTILGKLTRRGSSDAATEMESLSARHSHSHHTLVSDLPDPSNSHGENTVKEVRSQISTITVATFNTTLASFNVGYADFFNEHMRKLCNQVPIPEMPHEPLACANLPRSLTDSCINYSYLEDTEHIDGTNNFVHKNGMLDLSVVLKAVYLVLNHDISSRICDVALNIVECLLQLGVVPCVEKNRKKSENKENETLEKRPSEGAFQFKGVSGSSTCGFGGPAVSGAGDGGGEEGGGGDGGGGGGDGGGGGGGGGGPYEKNDKNQEKDESTPVSNHRLALTMLIKIVKSLGCAYGCGEGHRGLSGDRLRHQAQNCLTKLYKLDKMQFRQTMRDYVNKDSLNNVVDFLHALLGFCMEPVTDNKAGFGNNFTTVDNKSTAQNVEGIIVSAMFKSLITRCASTTHELHSPENLLVQFIKEAHGNVFRRVALSALLDSAEKLAPGKKVEENEQESKPAGSKSDEQMQGANLGRKDFWRKMFKSQSAASDTSSQSEQDTSECTTAHSGTTSDRRARSRSRRISLRKKLKLPIGLADGVEDLLDISSVDRLSFIRQSSKVKFTSAVKLSEGGPGSGMENGRDEEENFFKRLGCHSFDDHLSPNQDGGKSKNVVNLGAIRQGMKRFQFLLNCCEPGTIPDASILAAALDLLSVVFYYPSSEAYFCQFVHVISVQFCALDGETLRSFGEEAP

SEQ ID NO: 918713 - protein, 192 aa, Homo sapiens
MARGGPYTETESQPQEGRRRTDQLAAWERSQVSGRTPVVAIFIGDSASRTRVNFFFRASGSQGWSRELIIRIRVGPPASRLCSARHQCTRRPRLPSPPVVAVNTAVAAEVSRAVGQAAVRVVLQGAIQLIFRRPDGPRLLLSNDSLELLVPGVTRAIQRDGGCEEVAALLPQLLGLCVEAAGTAAGGRRQPT

SEQ ID NO: 918714 - protein, 172 aa, Homo sapiens
YINNPLYIMKQKVLQQASSAKPNQHFCEEVSSLPSDLTASASGGGSAVKPHYWKVHLVKFPLRAGDVLEDSSDSVAIMTSNSDSDIPSGSQGVLFLASLKNVNIGWARWLTPVIPALWEAEVAGSFEVRSLRPAWPTWFHGMIWLNPQTKAAEPRTAYWTSPYEKQKCIEAN

SEQ ID NO: 918715 - protein, 138 aa, Homo sapiens
MEGVLVPVHIHDLQSQLTLRKASQDVCGSSSPEEEEINASGAAVIGLKEQLTLGAEFSFHCVEYLNASPLEKQGESGQPLQIYKREKPNNSIKKWAKDTNRYFSKEGIDVDNNHMKESSTSLIIGEVQVKTTAKKRRK

SEQ ID NO: 918716 - protein, 156 aa, Homo sapiens
MTPRSIFGVALPWNHPFSLFHGPCQLSQICTHVYTVVNLRTGPEGSWLLKHSRATPGALKNPNSRSKFEFGSACRTQISKEAALAQISQGSGNNESINKDSSHLSSLYYGQAYTCIVTKQVDGCGVIQKNVILTHCERQRASKFGPSHPVWAVWPQ

SEQ ID NO: 918717 - protein, 156 aa, Homo sapiens; identical to SEQ ID NO: 918716

SEQ ID NO: 918718 - protein, 255 aa, Homo sapiens
MPQPRSSWDYSFMMVKNSTTFAQKKVIHILISLCTQGNSSPQGIALGRNYDSCQIRAPGAVSQHCSMLAPGHLYHTTAHNFTRSSGKDEVIRHQLSLYTAILGFYLQRIRKTPRRAFGDAWSPAQLSPGSGCSPDCAGSFLRKHHGVHPCALSHDPAASSPGLTCFAGYFPARPDPEAVGGPPGYFSRGSETQCVVVITFASHAKGPRFETGRKQSGSGSGSGSGLFGRDCDGWEHRWTHVSKNRAPQVSNSYPF

SEQ ID NO: 918719 - protein, 255 aa, Homo sapiens; identical to SEQ ID NO: 918718

SEQ ID NO: 918720 - protein, 158 aa, Homo sapiens
ISHMLQSLIRSLYTESCRLSAQAVLLRNDELLYWQPPQGEKLNQVHKEEALGWQAELVGFTFDVVSSLKLQQCHMHPVTVSGRSCKAFWEPHIISRGQLSCVPGQNHSSRKHQQASQEAEARESLICIRNSVKMNCCVLKGSKLSLIPSQISCITLFY

SEQ ID NO: 918721 - protein, 155 aa, Homo sapiens
MRLSVLRLLLLLAEGGKKGEGGTQAEDARGQARFSHLPAATPTPPILPPPSVLSSYPRRLDNRLLSGSARVGQGPRAPLQLTCGSPWQPPPLVRAAWARESARPGCATGPTGRPGARVKNTVEASSKPANKFPFSTALSGQGLFYEHLRCCTRGV

SEQ ID NO: 918722 - protein, 241 aa, Homo sapiens
MQWSPTPGASACLGWASSLACSTAPTLLGRAGRGPLMAAKWFKEFPLNLKTVSERAKPGGGGGKLRKNSEAGGAGPGPGKGRKNSAAELGSGRAGVGPKDSRLSRDSLQGLIQAAAGKGRKNSRATEEEPHRGATKSSGCSTYINRLIKVDTQEKNGKSNYPSSSSSSSSSSSSASSSPSSLGPELDKGKIIKQQETVIILEDYADPYDAKRTKGQRDAERVGENDGYMEPYDAQQMITGL

SEQ ID NO: 918723 - protein, 185 aa, Homo sapiens
MGSNHSWTLVSVSGQHWPVDPLAESPGPFRAAKGQQERVSLVFLLCILRAAPPLVLARWPVTRGPGGRSTTEPLGAGFSEDLLVPRSPTLKAQASPGCAVLTAMLSWAWTPSSALISHLCLSPPRGEPPHAEAGLGAGYVVLIVVAIFVLVAGTATLLIVRYQRMNGRYNFKIQSNNFSYQVFYE

SEQ ID NO: 918724 - protein, 171 aa, Homo sapiens
MRMNVQMTRTDARAPGRSKSWRCLRKSVHATSLNLQEGHNIVFSKESFKKLLPYENSLAIYILWVLTSVSSRLTLAGRGFHPFLNGHQNSDEFMTFSLRNYPRPKILIGKDGNILFPASCVSLQPYLIISLSPFLAHHISDPGSFRFWEQVKLFPVSGPLHLLISLTQSVT

SEQ ID NO: 918725 - protein, 140 aa, Homo sapiens
MGRVCGGDGLPCLLLTVTIDPGICASFPHSPRAPCEVIAPSIHCSERWSSDKLKSEDWAESTKPAPSTKSLLLSSFPLADMGNSSPSSFGAHTPRLLVPAIALGQDGDGQRLIRRTLQGFAWTALGFTAKRASQSPSSSH

SEQ ID NO: 918726 - protein, 158 aa, Homo sapiens
ISPSLIIGMDSRPRVSPVDLPFPDAIILVFTGFALTYWLPHQLCWILIGFDISIYLLSHQSALEMGIEGRPVSRGGWEQSLRIPACSPLSQSVAFPGHLPRPPGELSCSDTPQLTQRRRAQGWWLQHPRKCASKVYSISNFTSPSQSFLECLVEDRGL

SEQ ID NO: 918727 - protein, 144 aa, Homo sapiens
HTGFFQMNAQKAGKYLESDWFVLENGQTRRVCTDPFRSPRVGRRREWETGKAGLWGGVAGRGKARMFPNNEIIADLSEPPSWDTCLTCTPEGEEWAGNWGVGRTWKATPMGKVDMTPPAIKLDDAAMLILQTRNKSVIENLYRQ

SEQ ID NO: 918728 - protein, 150 aa, Homo sapiens
MNYRHSAKETLCKCDYYKCQIETPTEWSPLRKALKQALLVTGLPRPPPWSPALTLTHFLFPGPVTSGGRASPRPKFLFLGKLSAPRPCTTSECPGSPLNFENQKLQGKWHSFLPCSSVISVPCNCAGVFTGPLVFPCLCFMLQRLFIRQS

SEQ ID NO: 918729 - protein, 256 aa, Homo sapiens
KVSYTQSRHQNLEMKQLLDSPCEPADGGLKSETLAKRRSSKDLLGKPPQLYDTPYEPAEGGPRAEGKARPPDSRLPENDERPAAEYEQPWEWKKEQIVRALSVQFEGAERPSFREETVRQHHRQKSWTQKILKPALSDHSEGEKVDPGLPLEKQPWYHGAISRAEAESRLQPCKEAGYLVRNSESGNSRYSIALKTSQGCVHIIVAQTKDNKYTLNQTSAVFDSIPEVVHYYSNEKLPFKGAEHMTLLYPVHSKLH

SEQ ID NO: 918730 - protein, 398 aa, Homo sapiens
LSQNLYKMILCKLEEDCAGAREQSGHAEEGTQTQHPKIWLPRALRQTYIRKILRLLLKGGGPREGPPTSNSRNVQLQVKPPCGPGVDRTPTAAGRVRKPLGAAQSITLIPQGKPKPQAIWTHDGCALDTRRVSVRNGEQDSILFIREAQRADSGRYQLRVQLGGLEATATIDILVIERPGPPQSIKLVDVWGFSATLEWTPPQDTGNTALLGYTVQKADTKSGLWFTVLEHYHRTSCIVSDLIIGNSYAFRVFAENQCGLSETAPITTDLAHIQKAEATCQPLLVPSATVYKTKGFAQRDFSEAPKFTQPLADCTTVTGYNTQLFCCVRASPRPKIIWLKNKMDIQGNPKYRALTHLGICSLEIRKPGPFDGGIYTCKAVNPLGEASVDCRVDVKVPN

SEQ ID NO: 918731 - protein, 237 aa, Homo sapiens
ASAMLLKIQEMGSTVEVLNDQLTKKCSELSCMLQTVTMEKARIIADHQAILQVEQKMMTQTFQEQNLLLDAAHASITNELQTVQNEKTQLQAHLDHLILEHNQCIQKAQDAEKRTAVQKELLESTIARLRGELEASMQEKKSLLEEKERFQREVNKTEKEIVQERCNLEKELAKNKLAQQKVEKITESKNKLAYENGKLQIKVKQLEEQVQSFTDTSLQNDHLRKMNKYLQTKYAQV

SEQ ID NO: 918732 - protein, 141 aa, Homo sapiens
MVRLIVFNRIWLIGEQGLPGQPGIQGKRGHRGAQGDQGPCGDPGLKGQPGEYGVQGLTGFQGFPGPKGPEGDAGIVGISGPKGPIGHRGNTGPLGREGIIGPTGRTKFGYEIKHKNETMIGQVMLGKFSNIDNSINKQGAQ

SEQ ID NO: 918733 - protein, 168 aa, Homo sapiens
MASSTLNDQECLRRLLLWTCLQSSIFSLPVLRHVGYNTSASASSSTNRANITNDLLHRDVMRAKSYEFMPLKHLLKMLIISRSKELEIGSYAQSHGWWHATAPHWLFAGGLCSSPHGPLHRIASNREAVSPRPWSSCPGFSMVTLSVVTMGTSPKKGGLPGVTENFKK

SEQ ID NO: 918734 - protein, 165 aa, Homo sapiens
PPGCFSSKTTCCSQLMTPWTGMAQTSTLAKWSAYLEQQSTLSTSPLAAELQEVLGPVVLMQDKATGPEAPLDPEPSPSKERCPPIPNGAWYTDGSSRGAAAAWTRPLLQSNLVLPPYVLKLATWMEPSVFPAHIKICTRRVQISKSTASRGPSWDVPSLWGLMKV

SEQ ID NO: 918735 - protein, 237 aa, Homo sapiens
RNHSCLPQASLEAKFQDPPNGGLNPIYVFSYMVVCQYLWGIGSMTSYGCQKSMDAQEFLHMAPGEVTITVRLIRSFEHRNFKPVVYHGVNLDQTVKEFIVFLKQDALKIIHQAHKSKTNELVLSLEDDERLLLKEDSTLKAAGIEEEDENDVHSDLLAEDSRCLLSKYAECKWLFSEGMLRILLRVILSDGLEKFSSSSFGFLSALQIPVEHSTPDVSGVFACGPSTKIRTSKRFDQ

SEQ ID NO: 918736 - protein, 264 aa, Homo sapiens
MVFTQAPAEIMGHLRIRSLLARQCLAEFLGVFVLMLLTQGAVAQAVTSGETKGNFFTMFLAGSLAVTIAIYVGGNVSGAHLNPAFSLAMCIVGRLPWVKLPIYILVQLLSAFCASGATYVLYHDALQNYTGGNLTVTGPKETASIFATYPAPYLSLNNGFLDQVLGTGMLIVGLLAILDRRNKGVPAGLEPVVVGMLILALGLSMGANCGIPLNPARDLGPRLFTYVAGWGPEVFRWETDSPGAGLHSPSSAKGSVPGSTALCL

SEQ ID NO: 918737 - protein, 168 aa, Homo sapiens
QIQSRATAKPGGRGMPPGQQWFRAVLRSTKPEPGRCMLRGPIPAHTVPPLSEAQHLLSRISSEGRLHCPRGTQPPNEPQGRVWKARQYYGQIMDLGIAADAIGERKWNNRGPILPNVIHWSYPYGNRQYTDLEWKQIITGSPDSIVSQNIEPRKYLRSHLIQSPLFYQ

SEQ ID NO: 918738 - protein, 151 aa, Homo sapiens
EPYQLLRPTMGKGPTEGHTGPIILDPEPPQRPQGTAVFPWWNQHSVQRADKKMAEQERSGERGAPESMSAVVLLKQRELVVQFSLSWRCAVCECSEYNDVPVLSVQGHGSHFAGHIDLKVGLGFPLCITVANAAVDITHTIFLNGLMEVAR

SEQ ID NO: 918739 - protein, 1935 aa, Homo sapiens
GEGFTRLLCFFFQWEPPNAAVSSPSMNSFTLPSKNKREAPVVARAALFLECARFVHRCNRGNWPEWMKGHHVNITKKGLSRGRSPIVGNKRNQKLQWNAAKLFYQWGDAIGVRLNELCHGESESPANLLGLIYDEETKRRLRKEDEEEDFLDDSKETPFTTRTPACTVNPSKCGCPFALKMAACQLLLEITTFLRETFSCLPRPRTEPLVDLESCRLRLDPELDRHRYERKISFAGVLDENEDSKDSLHSSSHTLKSDAGVEEKKVPSRKIRIGGSRLLQIKGTRSFQVKKGGSLSSIRRVGSLKSSKLSRQDSESEAEELQLSQSRDTVTDLEGSPWSASEPSIEPEGMSNAGAEENYHRNMSWLHVMILLCNQQSFICTHVDYCHPHCYLHHSRSCARLVRAIKLLYGDSVDSLRESSNISSVALRGKKQKECSDKSCLRTPSLKKRVSDANLEGKKDSGMLKYIRLQVMSLSPAPLSLLIKAAPILTEEMYGDIQPAAWELLLSMDEHMAGAAAAMFLLCAVKVPEAVSDMLMSEFHHPETVQRLNAVLKFHTLWRFRYQVWPRMEEGAQQIFKIPPPSINFTLPSPVLGMPSVPMFDPPWVPQCSGSVQDPINEDQSVSNRHFQFHGKSFSARAVSRSHQRAEHILKNLQQEEEKKRLGREASLITAIPITQEACYEPTCTPNSEPEEEEEVTNLASRRLSVSPSCTSSTSHRNYSFRRGSVWSVRSAVSAEDEEHTTEHTPNHHVPQPPQAVFPACICAAVLPIVHLMEDGEVREDGVAVSAVAQQVLWNCLIEDPSTVLRHFLEKLTISNRQDELMYMLRKLLLNIGDFPAQTSHILFNYLVGLIMYFVRTPCEWGMDAISATLTFLWEVVGYVEGLFFKDLKQTMKKEQCEVKLLVTASMPGTKTLVVHGQNECDIPTQLPVHEDTQFEALLKECLEFFNIPESQSTHYFLMDKRWNLIHYNKTYVRDIYPFRRSVSPQLNLVHMHPEKGQELIQKQVFTRKLEEVGRVLFLISLTQKIPTAHKQSHVSMLQEDLLRLPSFPRSAIDAEFSLFSDPQAGKELFGLDTLQKSLWIQLLEEMFLGMPSEFPWGDEIMLFLNVFNGALILHPEDSALLRQYAATVINTAVHFNHLFSLSGYQWILPTMLQVYSDYESNPQLRQAIEFACHQFYILHRKPFVLQLFASVAPLLEFPDAANNGPSKGVSAQCLFDLLQSLEGETTDILDILELVKAEKPLKSLDFCYGNEDLTFSISEAIKLCVTVVAYAPESFRSLQMLMVLEALVPCYLQKLKRQTSQVETVPAAREEIAATAALATSLQALLYSVEVLTRPMTAPQMSRCDQGHKGTTTANHTMSSGVNTRYQEQGAKLHFIRENLHLLEEGQGIPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQR

SEQ ID NO: 918740 - protein, 1508 aa, Homo sapiens
GEGFTRLLCFFFQWEPPNAAVSSPSMNSFTLPSKNKREAPVVARAALFLECARFVHRCNRGNWPEWMKGHHVNITKKGLSRGRSPIVGNKRNQKLQWNAAKLFYQWGDAIGVRLNELCHGESESPANLLGLIYDEETKRRLRKEDEEEDFLDDSKETPFTTRTPACTVNPSKCGCPFALKMAACQLLLEITTFLRETFSCLPRPRTEPLVDLESCRLRLDPELDRHRYERKISFAGVLDENEDSKDSLHSSSHTLKSDAGVEEKKVPSRKIRIGGSRLLQIKGTRSFQVKKGGSLSSIRRVGSLKSSKLSRQDSESEAEELQLSQSRDTVTDLEGSPWSASEPSIEPEGMSNAGAEENYHRNMSWLHVMILLCNQQSFICTHVDYCHPHCYLHHSRSCARLVRAIKLLYGDSVDSLRESSNISSVALRGKKQKECSDKSCLRTPSLKKRVSDANLEGKKDSGMLKYIRLQVMSLSPAPLSLLIKAAPILTEEMYGDIQPAAWELLLSMDEHMAGAAAAMFLLCAVKVPEAVSDMLMSEFHHPETVQRLNAVLKFHTLWRFRYQVWPRMEEGAQQIFKIPPPSINFTLPSPVLGMPSVPMFDPPWVPQCSGSVQDPINEDQSKSFSARAVSRSHQRAEHILKNLQQEEEKKRLGREASLITAIPITQEACYEPTCTPNSEPEEEEEVTNLASRRLSVSPSCTSSTSHRNYSFRRGSVWSVRSAVSAEDEEHTTEHTPNHHVPQPPQAVFPACICAAVLPIVHLMEDGEVREDGVAVSAVAQQVLWNCLIEDPSTVLRHFLEKLTISNRQDELMYMLRKLLLNIGDFPAQTSHILFNYLVGLIMYFVRTPCEWGMDAISATLTFLWEVVGYVEGLFFKDLKQTMKKEQCEVKLLVTASMPGTKTLVVHGQNECDIPTQLPVHEDTQFEALLKECLEFFNIPESQSTHYFLMDKRWNLIHYNKTYVRDIYPFRRSVSPQLNLVHMHPEKGQELIQKQVFTRKLEEVGRVLFLISLTQKIPTAHKQSHVSMLQEDLLRLPSFPRSAIDAEFSLFSDPQAGKELFGLDTLQKSLWIQLLEEMFLGMPSEFPWGDEIMLFLNVFNGALILHPEDSALLRQYAATVINTAVHFNHLFSLSGYQWILPTMLQVYSDYESNPQLRQAIEFACHQFYILHRKPFVLQLFASVAPLLEFPDAANNGPSKGVSAQCLFDLLQSLEGETTDILDILELVKAEKPLKSLDFCYGNEDLTFSISEAIKLCVTVVAYAPESFRSLQMLMVLEALVPCYLQKLKRQTSQVETVPAAREEIAATAALATSLQALLYSVEVLTRPMTAPQMSRCDQGHKGTTTANHTMSSGVNTRYQEQGAKLHFIRENLHLLEEGQGIPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLR

SEQ ID NO: 918741 - protein, 132 aa, Homo sapiens
MEWRCTVPGAVGRRDLGLKHQIKGFGLDPKAQCLCESLEPGLTACHSQQGAGLAGAETQGQQEMKWEGSGPAACTAAPMPAAEDWAHLEALGESGGPSIFLQRRGEILGGYENINGGEILTLPLTSHVNLGK

SEQ ID NO: 918742 - protein, 132 aa, Homo sapiens; identical to SEQ ID NO: 918741

SEQ ID NO: 918743 - protein, 145 aa, Homo sapiens
MSRFHLSAKNRLTLSPGIAAKVGLWCSCKSDGIHLPDVRPTHWNTAPLTGASLNGNYMSYCKEDTLDPGVSCTGRNVTVRSQGIIINCQYGRIKGSPPQEYHCNTEPTLIPFYCTPPENITPNPVSFTRDNLIPIDWDISIFNSP

SEQ ID NO: 918744 - protein, 144 aa, Homo sapiens
MLPRLLNSLKGKTINTLPICVIIPYYRGRQPLGPQTGTTPWLVRNQATQQQTQTFVCEAIFRVAVNLCTSSCALSSSSFTALSCWRKFITSRCNSFRSLECSSCIAFSRSFRKATRPHRRGIKQQKEGSQVERTCLESQMRLWN

SEQ ID NO: 918745 - protein, 280 aa, Homo sapiens
MNGECSCLPGWAGLHCNESCPQDTHGPGCQEHCLCLHGGVCQATSGLCQCAPGYTGPHCASLCPPDTYGVNCSARCSCENAIACSPIDGECVCKEGWQRGNCSVPCPPGTWGFSCNASCQCAHEAVCSPQTGACTCTPGWHGAHCQLPCPKGQFGEGCASRCDCDHSDGCDPVHGRCQCQAGWMGARCHLSCPEGLWGVNCSNTCTCKNGGTCLPENGNCVCAPGFRGPSCQRCEAPYCPFHLPPAGGSVVSAARAPLPPRPPPTSPTLPPVSSSDPSSD

SEQ ID NO: 918746 - protein, 106 aa, Homo sapiens
MYPFPPACQPGRYGKRCVPCKCANHSFCHPSNGTCYCLAGWTGPDCSQRCPLGTFGANCSQPCQCGPGEKCHPETGACVCPPGHSGAPCRIGIQEPFTVMPTTPVA

SEQ ID NO: 918747 - protein, 698 aa, Homo sapiens
MNGECSCLPGWAGLHCNESCPQDTHGPGCQEHCLCLHGGVCQATSGLCQCAPGYTGPHCASLCPPDTYGVNCSARCSCENAIACSPIDGECVCKEGWQRGNCSVPCPPGTWGFSCNASCQCAHEAVCSPQTGACTCTPGWHGAHCQLPCPKGQFGEGCASRCDCDHSDGCDPVHGRCQCQAGWMGARCHLSCPEGLWGVNCSNTCTCKNGGTCLPENGNCVCAPGFRGPSCQRCEAPYCPFHLPPAGGSVVSAARAPLPPRPPPTSPTLPPVSSSDPSSDYLLQWEGGRETVGKGLIEDWPLPPITMYPFPPACQPGRYGKRCVPCKCANHSFCHPSNGTCYCLAGWTGPDCSQRCPLGTFGANCSQPCQCGPGEKCHPETGACVCPPGHSGAPCRIGIQEPFTVMPTTPVAYNSLGAVIGIAVLGSLVVALVALFIGYRHWQKGKEHHHLAVAYSSGRLDGSEYVMPDVPPSYSHYYSNPSYHTLSQCSPNPPPPNKVPGPLFASLQNPERPGGAQGHDNHTTLPADWKHRREPPPGPLDRGSSRLDRSYSYSYSNGPGPFYNKGLISEEELGASVASLSSENPYATIRDLPSLPGGPRESSYMEMKGPPSGSPPRQPPQFWDSQRRRQPQPQRDSGTYEQPSPLIHDRDSVGSQPPLPPGLPPGHYDSPKNSHIPGHYDLPPVRHPPSPPLRRQDR

SEQ ID NO: 918748 - protein, 215 aa, Homo sapiens
MNGECSCLPGWAGLHCNESCPQDTHGPGCQEHCLCLHGGVCQATSGLCQCAPGYTGPHCASLCPPDTYGVNCSARCSCENAIACSPIDGECVCKEGNRVEFPREKTWGMAKGRRESPRVWVGQGQGSGCRVRVEGQQLDTGKVSRLLSSWNIHFAFLQPQRSYLSLKAEAKSHLTGERPSPSVIRKHNYHAGKGLTSARVTHWRTFRLDSDTVDT

SEQ ID NO: 918749 - protein, 780 aa, Homo sapiens
MAFRALLVFYQPTFIDLLPKLLNAPPPTWEQLENGLVAVRTVVHGLVDYIQNHSKKGADQQQPPQHSKYKTYMCRDMKQRGGCPRGASCTFAHSQEELEKFRKMNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVTKPLQMVPRGSQLYPAQQTDVYYQDPRGAAPPFEPAPYQQGMYYTPPPQCVSRFVRPPPSAPEPAPPYLDHYPPYLQERVVNSQYGTQPQQYPPIYPSHYDGRRVYPAPSYTREEIFRESPIPIEIPPAAVPSYVPESRERYQQIESYYPVAPHPTQIRPSYLREPPYSRLPPPPQPHPSLDELHRRRKEIMAQLEERKVISPPPFAPSPTLPPTFHPEEFLDEDLKVAGKYKGNDYSQYSPWSCDTIGSYIGTKDAKPKDVVAAGSVEMMNVESKGMRDQRLDLQRRAAETSDDDLIPFGDRPTVSRFGAISRTSKTIYQGAGPMQAMAPQGAPTKSINISDYSPYGTHGGWGASPYSPHQNIPSQGHFSERERISMSEVASHGKPLPSAEREQLRLELQQLNHQISQQTQLRGLEREANTLAGQSQPPPPPPPKWPGMISSEQLSLELHQVEREIGKRTRELSMENQCSLDMKSKLNTSKQAENGQPEPQNKVPAEDLTLTFSSDVPNGSALTQENISLLSNKTSSLNLSEDPEGGGDNNDSQRSGVTPSSAP

SEQ ID NO: 918750 - protein, 459 aa, Homo sapiens
MAFRALLVFYQPTFIDLLPKLLNAPPPTWEQLENGLVAVRTVVHGLVDYIQNHSKKGADQQQPPQHSKYKTYMCRDMKQRGGCPRGASCTFAHSQEELEKFRKMNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVTKPLQMVPRGSQLYPAQQTDVYYQDPRGAAPPFEPAPYQQGMYYTPPPQCVSRFVRPPPSAPEPAPPYLDHYPPYLQERVVNSQYGTQPQQYPPIYPSHYDGRRVYPAPSYTREEIFRESPIPIEIPPAAVPSYVPESRERYQQIESYYPVAPHPTQIRPSYLREPPYSRLPPPPQPHPSLDELHRRRKEIMAQLEERKVISPPPFAPSPTLPPTFHPEEVSKSFLVSFIRVFL

SEQ ID NO: 918751 - protein, 81 aa, Homo sapiens
THLYTHLTMMAVECTLLRLTQEKRYSEKALYPLRFHLQQYHRMYQNPEKDTNRSRVTIQWLLIQLRSDLRTSEYAVFFFIT

SEQ ID NO: 918752 - protein, 327 aa, Homo sapiens
MPPVKKSQQQQSLMESMQPGKPSDWELEGRKHERPESLLAPTQFCAAEQDVKALAGPLQAIPEMDFEPSPAEPLGNVERSLRAPAELLPDARGFVPAAYEEFEYGGEIFALPAPYDEEPFQAPALFENCSPASSESSLDICFLRPVSFAMEAERPEHPLQPLPKSATSPAGSSSAYKLEAAAQAHGKAKPLSRSLKEFPRAPPADGVAPRLYSTRSSSGGRAPIKAERAAQAHGPAAAAVAARGASRTFFPQQRSQSEKQTYLEEMHLEDTTRFCPKEERESEQTSFSDQNPRQDQKGGFRSSFRKLFKKKNGNATGEDFCGPWGWW

SEQ ID NO: 918753 - protein, 170 aa, Homo sapiens
MPSRSSLHLAEQLLLVSGLSKACGFQVLRPAEMPVHFPQEAPPSYVTLMKVFLHHMICYRKNKEGIWKQLRSKLAVGCHLESPTGKCRITPDQGQEGGLGLTLSPQAGVQWQDGSSLQPRPPWLKLSSHLSLRETLGTENQIPHILSYKWELNDENTWTQRGEQQTPRPT

SEQ ID NO: 918754 - protein, 141 aa, Homo sapiens
FSAWMHTEYSCSQNNSLSLQSTLYLIDSLYKNRKATLRVSQRKAKDAGSFLFVCLFVCFLRRGLALSPRLECSSAISAQCRDFCVSASAEVVGAILSIRFFLQPLLAAGKREWRERGIRTDVDTAEEEEPAVTDFLEMTNK

SEQ ID NO: 918755 - protein, 173 aa, Homo sapiens
VASLYFRIKDEVEESAMMGVSGYVEYLREQEVSERWFRYNPRLTCIYCAKSFNQKGSLDRHMRLHMGITPFVCRMCGKKYTRKDQLEYHIRKHTGNKPFHCHVCGKSFPFQAILNQHFRKNHPGCIPLEGPHSISPETTVTSRGQAEEESPSQEETVAPGEAVQGSVSTTGPD

SEQ ID NO: 918756 - protein, 263 aa, Homo sapiens
MMGTCRMICDPYTAAPGGEPPGAKAQPPGPSTAALEVMQDLSANPPPPFIQGPKGDPGRPGKPGPRGPPGEPGPPGPRGPPGEKGDSGRPGLPGLQLTAGTASGVGVVGGGAGVGGDSEGEVTSALSATFSGPKIAFYVGLKSPHEGYEVLKFDDVVTNLGNHYDPTTGKFSCQVRGIYFFTYHILMRGGDGTSMWADLCKNGQVRASAIAQDADQNYDYASNSVVLHLDSGDEVYVKLDGGKAHGGNNNKYSTFSGFLLYPD

SEQ ID NO: 918757 - protein, 287 aa, Homo sapiens
MALGLLIAVPLLLQAAPRGAAHYEMMGTCRMICDPYTAAPGGEPPGAKAQPPGPSTAALEVMQDLSANPPPPFIQGPKGDPGRPGKPGPRGPPGEPGPPGPRGPPGEKGDSGRPGLPGLQLTAGTASGVGVVGGGAGVGGDSEGEVTSALSATFSGPKIAFYVGLKSPHEGYEVLKFDDVVTNLGNHYDPTTGKFSCQVRGIYFFTYHILMRGGDGTSMWADLCKNGQVRASAIAQDADQNYDYASNSVVLHLDSGDEVYVKLDGGKAHGGNNNKYSTFSGFLLYPD

SEQ ID NO: 918758 - protein, 1133 aa, Homo sapiens
NLVPQLEMQKSPVFCIVHAGCYRLELVPLTSNDDEDEDKEKMQCDNNIKSKTLPDIPSSGSTTQPLSTQDNSEVLFLKENNQNVYGLDDSEHISSIVDVPPRESHSHSDQSSKTSLMSEMRNAQSIGRRWEKPSPSNVTERKKRGSSWESNNLSADTPCATVLDKQHISSPELNCNNEINGHTNETNTEMQRNKQDLPGLSSESAREPNAECMNQIEDNDDFQLQKTVYDADMDLTASEVSKIVTVSTGIKKKSNKKTNEHGMKTFRKVKDSSSEKKRERSKRQFKNSSDVDIGEKIENRTERSDVLDGKRGAEDPGFIFNNEQLAQMNEQLAQVNELKKMTLQTGFEQGDRENVLCNKKEKRITNEQEETYSLSQSSGKFHQESKFDKGQNSLTCNKSKASRQTFVIHKLEKDNLLPNQKDKVTIYENLDVTNEFHTANLSTKDNGNLCDYGTHNILDLKKYVTDIQPSEQNESNINKLRKKVNRKTEIISGMNHMYEDNDKDVVHGLKKGNFFFKTQEDKEPISENIEVSKELQIPALSTRDNENQCDYRTQNVLGLQKQITNMYPVQQNESKVNKKLRQKVNRKTEIISEVNHLDNDKSIEYTVKSHSLFLTQKDKEIIPGNLEDPSEFETPALSTKDSGNLYDSEIQNVLGVKHGHDMQPACQNDSKIGKKPRLNVCQKSEIIPETNQIYENDNKGVHDLEKDNFFSLTPKDKETISENLQVTNEFQTVDLLIKDNGNLCDYDTQNILELKKYVTDRKSAEQNESKINKLRNKVNWKTEIISEMNQIYEDNDKDAHVQESYTKDLDFKVNKSKQKLECQDIINKHYMEVNSNEKESCDQILDSYKVVKKRKKESSCKAKNILTKAKNKLASQLTESSQTSISLESDLKHITSEADSDPGNPVELCKTQKQSTTTLNKKDLPFVEEIKEGECQVKKVNKMTSKSKKRKTSIDPSPESHEVMERILDSVQGKSTVSEQADKENNLENEKMVKNKPDFYTKAFRSLSEIHSPNIQDSSFDSVREGLVPLSVSSGKNVIIKENFALECSPAFQVSDDEHEKMNKMKFKVNRRTQKSGIGDRPLQDLSNTSFVSNNTAESENKSEDLSSERTSRRRRCTPFYFKEPSLRDKMRR

SEQ ID NO: 918759 - protein, 1133 aa, Homo sapiens; identical to SEQ ID NO: 918758

SEQ ID NO: 918760 - protein, 1133 aa, Homo sapiens; identical to SEQ ID NO: 918758

SEQ ID NO: 918761 - protein, 122 aa, Homo sapiens
SILLEQLVVEATEVVNPLLEPVEHRDGKVFMPGNKVLLHLNLIRNRITEVGLEGFLATVQYQMQFSKAKSASKGPVGLLWLSLAKNCFAPQCPAYAIIQELMLPRDPIKAKLREDEAMAFFP

SEQ ID NO: 918762 - protein, 101 aa, Homo sapiens
SGVSGANEACGAKRPPVCNSPPGNRITEVGLEGFLATVQYQMQFSKAKSASKGPVGLLWLSLAKNCFAPQCPAYAIIQELMLPRDPIKAKLREDEAMAFFP

SEQ ID NO: 918763 - protein, 465 aa, Homo sapiens
TPPRTGRIRSLDAEQRSPDSATPRLSPVECVLTFLPRRRSQRRCGQHQHVERAERAGGLTQGPASGDPEVFWRGDQKGRARGQREASDRSASRGGGGAQKPCAGGWGEGIIGAGENNIFWKGRQDSIQSPTEEYQCSGVLETDFAELCTRWGYTDFPKVVNRPRPHPPFVPSASLSEKATLDDPRLSGSCSLNSLESKYVFFRPTIQVELEQEDSKSVKEIYIRGWKVEERILGVFSKCLPPLTQLQAINLWKVGLTDKTLTTFIELLPLCSSTLRKVSLEGNPLPEQSYHKLMALDSTPRPSLSPYHLGKGPRFLPLHPQTRPPPQALKSPIFRRTPCTFSSDPHSPSGCPRIAHLSLRNNNIDDRGAQLLGQALSTLHSCNRTLVSLNLGFNHIGDEGAGYIADGLRLNRSLLWLSLAHNRIQDKGALKLAEVLRAFELTHTEVVERRRLLLEKGTQERSRSR

SEQ ID NO: 918764 - protein, 248 aa, Homo sapiens
GHFPRMSKKSEDSLLYSLRGTLTLLMLGRVASIQSEPGQQNLLVQQPLGRKRGLRQLRRPLLSRQKTQTEPRNRQGARLSTTRRSIQPKTKPSADQKRSVTFIEAQPEPAAAPTDALPATGQLQGCSPAPSRKPEAMDEPVLTSSPAIVVADLHSVSPKQSENFPTEEGEKEEDTEAQGATAHSPLSAQLSDPDDFTGLETSSLLQHGDTVLHISEENGMENPLLSSQFTFTPTELGKTDAVLDESHV

SEQ ID NO: 918765 - protein, 870 aa, Homo sapiens
MTSPKELNKTLVTNPGEAGICGKYIEQPHFNSPGDSFERGTPSRSLGFSLQGLPISILAYLERHLGRNASRSDTSVTQTLCIQRNSSDYEMMKKNAVIDLMGAEGMEGGASGNLHSRKLVSFTLSDLRAVGLKKGMFFNPDPYLKMSIQPGKKSSFPTCAHHGQERRSTIISNTTNPIWHREKYSFFALLTDVLEIEIKDKFAKSRPIIKRFLGKLTIPVQRLLERQAIGYNLGRRLPADHVSGYLQFKVEVTSSVHEDASPEAVGTILGVNSVNGDLGSPSDDEDMPGSHHDSQVCSNGPVSEDSAADGTPKHSFRTSSTLEIDTEELTSTSSRTSPPRGRQDSLNDYLDAIEHNGHSRPGTATCSERSMGASPKLRSSFPTDTRLNAMLHIDSDEEDHEFQQDLGYPSSLEEEGGLIMFSRASRADDGSLTSQTKLEDNPVENEEASTHEAASFEDKPENLPELAESSLPAGPAPEEGEGGPEPQPSADQGSAELCGSQEVDQPTSGADTGTSDASGGSRRAVSETESLDQGSEPSQVSSETEPSDPARTESVSEASTRPEGESDLECADSSCNESVTTQLSSVDTRCSSLESARFPETPAFSSQEEEDGACAAEPTSSGPAEGSQESVCTAGSLPVVQVPSGEDEGPGAESATVPDQEELGEVWQRRGSLEGAAAAAESPPQEEGSAGEAQGTCEGATAQEEGATGGSQANGHQPLRSLPSVRQDVSRYQRVDEALPPNWEARIDSHGRIFYVDHVNRTTTWQRPTAPPAPQVLQRSNSIQQMEQLNRRYQSIRRTMTNERPEENTNAIDGAGEEADFHQASADLLSTQLRKFVDDYVLGTELRPRDTEMTATVGPGIPDLRAIIMS

SEQ ID NO: 918766 - protein, 127 aa, Homo sapiens
PIEMSCPLLHCELGQRPHLEPRSPQTQASCISYCFSLFLWFPQPYSPLSESVLASYAAPWSKALAARALITSSFRTSGNYRHNVWKKNDFKLMQQRQTMVWPKMEQNLQGKREVPGVIWSDEDGTGE

SEQ ID NO: 918767 - protein, 350 aa, Homo sapiens
MVERLGTPGTQGWQAGEVGKYPRQSGSGARLLDQAAGSEPAGFRFHRGPYPGRIPSRCGLRGSPVPSLEVTRPAHPPGVAAGKSWRPEGSAAPSKLGLCAAPMAATAPLPRTPPAQQGGADARSKEWPKKGPGAGMLLGSEPSEQGETQVQAGLGQMRVMGSQEQQLQEAAATFRAERESTMKELRLPPPRVEPQTFQEGMQLLLEHQKLLLVGRFASPAPLAQPKGSPEAAPKHELVRTALRSSCCQLPRAEDSLWMPPVLQEPSLAGTWADAADPPVGLGFQRLPSVPARGHISSRGSPGLGTRASDSKRAPPFLAASGELLGVLRGLFSSSVWMNKILENQRQEACN

SEQ ID NO: 918768 - protein, 159 aa, Homo sapiens
LCVPHPGHTDTGCKLPMDLPFWDLEDNGPLLLTAPLGSVPVETKYGGSNPTFPLSTVLVEVLCEGSTPATSFCLNIQAFPYILHTYIGRGSQASTLAFCTPTGLTPHESHQSYGLHILKQLPELYLGPFEPRLDLEQLGHREQCPKAVQNVVYTNLHSR

SEQ ID NO: 918769 - protein, 150 aa, Homo sapiens
SGFPLSLPQLMINFLSGFPQTSIVSCLSNKLWAKEQRPLWEVFTPPIPNANIGIYLLLGTSIQSPTVYRPGGLAPLPHTQTTTYKLILGICGLRHREVMQCVKGHTASISRALSHTPTTSPLAASIQLEPCEQGVLCSLSVEGKSWQPGC

SEQ ID NO: 918770 - protein, 201 aa, Homo sapiens
MHEHQQGDPSVYAVLRPRLKGYVALGWRTGRQRCFDEKKDIDYLVNPCLMAGKLGIYVQDLDLPTRLRDSNQAVRLALAMQLGFEGPRFSGEKSRQEGCWEVCQAQLSKERFFEETTNGNAMMPCFRGWLLLGREAGSYLEGQGIGDYKSTFLQIDAFQPYWKHTTFEPQGLGEAVNVRGEAESTFQLLLFRPLNHFLQHF

SEQ ID NO: 918771 - protein, 145 aa, Homo sapiens
MEILNKWDRDPEAFLLRIAIDEIWLCQYGPEDKRQSNQWLPRGGKGPVKAKVDLSRAKNLETIPENLRNRYLKFIGVSYDHKLPSKPRLAMGNLKHANIQNIGYCKKKTVSVGKGLEKRTPLYIVGENENWYSRCGKPYGDSSKN

SEQ ID NO: 918772 - protein, 467 aa, Homo sapiens
AGSFKRPVKQIKNQMGLPPGMPDRACAVGSVARALSRSRRYVCARDADASRRRRRPFNYGLSIEEKNENDENSLSSSSDSSEDKDEKISEECDIEEKTEVKEEPELQTKREMEERTVTLEIPEVLKRQLEDDCYYINRRKRLVQLPCHTNIITILESYVKHFAISAAFSANERPRHHHAMPHASMNVPYIPAEKNIDLCKEMVDGLRITFDYTLPLVLLYPYEQAQYKKVTASKVFLAIKESATNTNRSQEKLSPSLRLLNPSRPQSTESQSTSGEPATPKRRKAEPQAVQSLRRSSPHTANCDRLSKSSTSPQPKRWQQDMSTSVPKLFLHLEKKTPVHSRSSSPTLTPSQEGSPVFAGFEGRRTNEINEVLSWKLVPDNYPPGDQPPPPSYIYGAQHLLRLFVKLPEILGKMSFTEKNLKALLKHFDLFVRFLAEYHDDFFPESAYVAASEVHYSTRNPQAVNKC

SEQ ID NO: 918773 - protein, 175 aa, Homo sapiens
MLHQKCNNGGFHLAEKYRKFFLAEGIAWVKTDVKLYGLLGNDKQFDATGVGHIVGKGVAGDEEKGVHWGQNLKDLIPQPMEPSEVYSSVGSGTDRRDTAAATEAQHLSSESKEKTSAQKSGHPFGILKADFTISTLMDPEEMKDQFLRQIQEVLKLTLGHEQFRLKWVSFEVNKK

SEQ ID NO: 918774 - protein, 193 aa, Homo sapiens
GDICAYSEMPSDAAVVRLHTPGKRTTSIHKWAQLCSSNTLFTNQRVGQIGPAGIIFCKKLFLNLSVKEKAPHVLCDLSDLEYLDEEFHQSLQWMKDNDIHDILDLTFTVNEEVFGQITERELKPGGANIPVTEKNKKEYIERMVKWRIERGVVQQTESLVRGFYEMRNFAQYQIASLHQTLGMAHVSSCSIQF

SEQ ID NO: 918775 - protein, 193 aa, Homo sapiens; identical to SEQ ID NO: 918774

SEQ ID NO: 918776 - protein, 163 aa, Homo sapiens
MPVLNFRMILPGGRASPRRGCRRRPRQRARRFPRSGPGSGAFSGRRGRAHHHRGGRAVIRIIALLPAWGSSGPRLHRAGPGRAGAGGGGARAIQPLAQSVPLDSGGFKSLGLCICCSRTSGYPFPGPPGKLLSPFKVLHKPLAQCLVLREQEWKEHIFPLKEH

SEQ ID NO: 918777 - protein, 1086 aa, Homo sapiens
MAGLAEWPSLAMVHCSFPAPKPSGLHTEGSQIIENIPADSLLEGGQVIKNIPEYSLSEGGQIIKNIPADSFLESGPGQSPEVEEHVSKKHFEADERDFPIKKNSSTKKKHLISEVPNSKSGSSGTVHDYIMRQIFTAPIFSELEIEVKEPSETPMNLENQLPTPWKRSLSSHILFHEENADEIELPQPRSATSQIIQAFPIDTLLESGIIKVIELDKEHHKSSLLGTGITSPKGNLKDSQEYYSEIRSETEPLSEQSIPIIPKDTTSVSRAEFIQEDQNMFPQDSSYYSIANKELYLPRNGQRLCKDKNDLSSTLESLTNSLMDKLSESDEIMLKSFLKNIFNVFFKYNHSERRGQPEKELERLIQPSFTSDTEHLEELQEDFDKADKLDRKPILSPKLRVFLEELSESEVKHLKSELSKQIQHYLVERLSESGHITKEDLPKIYQNLYLMNEKAEQKGPNSFQGKYSETVKEIMSFVNNFNHHFIDKHLEIKLRSFLKEILQNYFLKNISESSLFNETASETIYPNISSLRTKSVSISFHELEQDISKGSFGRRFEINMKYPLSKSLQNYLIALSENELLHLKADLSKHLQSLFIEKLSKSGLMTKKQLEGINQHINLLNSSSIPLKYIKTHLPFRDDCHFVEKHSEKQNKYSRIVQQTTLQTVSEDKLREAELIREKEKKYFPLQNLKGNSSLIKEQKSYYTKEEAKTPSLIKVQPSSNENIQASPLSKSSEILTDILLKKLRKEHVFTQLPQAENSVHKTEIQDPYSWGGKSKITQSKAWCEKTLKMKSLDRKEHVNIYKWTVQEKPEAVLTSYPRIPNARMPREDEYLNRITFPSWQSSTLTHFNTETGEKSKLEDQYCQTLKGNNNNNKKHLVTFAQYKKEIQTLYIKPDEICSEKCAKFPEIQSFQYKVVEDEKNLKPHLFPELFKIEDLKPKVRKERDRVAQPKKSFNKIVRILPTTLPTTRIHLKKSVPRTLLHWTARRTIHDCSDKFEDLHDMTSFTHLKKVKSRSRLLGKSSDDIHNHARHSARPYTAPEVNKQRESYSGKFTSRRMVSSGLVHINDKTSDYEMHKMRPKKIKRGY

SEQ ID NO: 918778 - protein, 137 aa, Homo sapiens
MTVVTKIYTNAYTFFFLFLFFETESHCVSAGVECSGTILAHCSLRLLGSRDSPASASQVAGIIDEHQYAQLSFVFLVEMGSHHVGQAGLELLTSNDPPASAAQSAGITEFSIHKSSEKQEILEKHAYDNKQGIYRVV

SEQ ID NO: 918779 - protein, 77 aa, Homo sapiens
MKPKLSTWRDIWPAPRCSSHPQFRHQTCGEEAILDAQPQLPSDATTLLTPSKNCLQEPSIILSHRTMAGNNKLLFEA

SEQ ID NO: 918780 - protein, 742 aa, Homo sapiens
MESNQMEAPRSDPTHSERKVRRKKPKSGSWIWISVFFEVRQHSGPRQVMLRCSQPENREKPGDTGQTPPFRLPGRREGLIQRRAAAAGTPPRGLLPLNQHQCPRSSTFSWLFCPAFRSGVRIEAEHQRVPGQRVWRGALGQEPIRSARCACTVQTDLALDEDDYRIRTFKIKKLSFKETGGKNQSSPQLPQTRRIWERAENIAGRRQEKSSWHLCLEHPPFPTPAPLSRPYPDRTAAAAASLPVSVAGGLLRGPPLLLRAAEKYPRTPKCARCRNHGVVSALKGHKRYCRWKDCLCAKCTLIAERQRVMAAQVALRRQQAQEENEARELQLLYGTAEGLALAAANGIIPPRPAYEVFGSVCAADGGGPGAGAPAGTGGGAAGAGGSEAKLQKFDLFPKTLLQAGRPGSPLPPPVKPLSPDGADSGPGTSSPEVRPGSGSENGDGESFSGSPLARASKEAGGSCPGSAGPGGGGEEDSPGSASPLGSESGSEADKEEGEAAPAPGLGGGSGPRQRTPLDILTRVFPGHRRGVLELVLQGCGGDVVQAIEQVLNHHRGGLAAGLGPAAPPDKAAVGAAAAADDAWPSRVDAAAAAAAAAGGPGLPAPLQAGPAAPPHHRPLLAGAMAPGALGSLSSRSAFSPLQPNASHFGADAGAYPLGAPLGLSPLRLAYSAAAAHSRGLAFMAPYSTAGLVPTLGFRPPMDYAFSDLMRDRSAAAAAAVHKEPTYGGGLYGPMVNGAPEKQ

SEQ ID NO: 918781 - protein, 636 aa, Homo sapiens
MESNQMEAPRSDPTHSERKVRRKKPKSGSWIWISVFFEVRQHSGPRQVMLRCSQPENREKPGDTGQTPPFRLPGRREGLIQRRAAAAGTPPRGLLPLNQHQCPRSSTFSWLFCPAFRSGVRIEAEHQRVPGQRVWRGALGQEPIRSARCACTVQTDLALDEDDYRIRTFKIKKLSFKETGGKNQSSPQLPQTRRIWERAENIAGRRQEKSSWHLCLEHPPFPTPAPLSRPYPDRTAAAAASLPVSVAGGLLRGPPLLLRAAEKYPRTPKCARCRNHGVVSALKGHKRYCRWKDCLCAKCTLIAERQRVMAAQVALRRQQAQEENEARELQLLYGTAEGLALAAANGIIPPRPAYEVFGSVCAADGGGPGAGAPAGTGGGAAGAGGSEAKLQKFDLFPKTLLQAGRPGSPLPPPVKPLSPDGADSGPGTSSPEVRPGSGSENGDGESFSGSPLARASKEAGGSCPGSAGPGGGGEEDSPGSASPLGSESGSEADKEEGEAAPAPGLGGGSGPRQRTPLDILTRVFPGHRRGVLELVQPNASHFGADAGAYPLGAPLGLSPLRLAYSAAAAHSRGLAFMAPYSTAGLVPTLGFRPPMDYAFSDLMRDRSAAAAAAVHKEPTYGGGLYGPMVNGAPEKQ

SEQ ID NO: 918782 - protein, 250 aa, Homo sapiens
MSCQDFQQKFIAMFICSEIPITLDHGNTLHEGWSQIMFRKQVILGNTAVTALSDAGGPRNDAQFNFSVQEPMEGTNVVVCVTVAVTPSNLKAEDAKFPLDFQVILRFREKFPPVFFSSFRNTVQSSNNKFRRNFTMTYHLSPGNYVVVAQTRRKSAEFLLRIFLKMPDSDRHLSSHFNLRMKGSPSEHGSQQSIFNRYAQQRLDIDATQLQGLLNQELLTGPPGDMFSLDECRSLVALMEVSFAVIPPML

SEQ ID NO: 918783 - protein, 250 aa, Homo sapiens; identical to SEQ ID NO: 918782

SEQ ID NO: 918784 - protein, 250 aa, Homo sapiens; identical to SEQ ID NO: 918782

SEQ ID NO: 918785 - protein, 269 aa, Homo sapiens
MSCQDFQQKFIAMFICSEIPITLDHGNTLHEGWSQIMFRKQVILGNTAVTALSDAGGPRNDAQFNFSVQEPMEGTNVVVCVTVAVTPSNLKAEDAKFPLDFQVILRFREKFPPVFFSSFRNTVQSSNNKFRRNFTMTYHLSPGNYVVVAQTRRKSAEFLLRIFLKMPDSDRHLSSHFNLRMKGSPSEHGSQQSIFNRYAQQRLDIDATQLQGLLNQELLTGPPGDMFSLDECRSLVALMELKVNGRLDQEEFARLWKRLVHYQVRAHSL

SEQ ID NO: 918786 - protein, 288 aa, Homo sapiens
AQCPPFQFMSGPVLYQEKLLKPAALLLEKGADQEEDEALRVLSLRALGNMALGAPKKVKQYRKVLLEKCLGPLREPVSNSVTAEGMEALTKILAELREGDVGSSFDAMSEQCRIFFDNESELLRLKAFILFGKLARVVGMSKKHFFKGEVKKAWIPLMLHSQDPCSNAAQACMATMFQCVHFWGWKSLEHPSGPSDTATDDKMTVFQTTMCSILVRKPKGEPARPRWPHAGLELGGRDCHSSFLGPYVYLPHMPCRDRHCAAEIEGKSCAYFSCLMFLLVGTSRKVQR

SEQ ID NO: 918787 - protein, 171 aa, Homo sapiens
KRRPAVSWQGWKYIKGLQIACLKERNTDWFYSLYPVVSKSGMRERETDRQTLGKKKSELFDTKGRFCIYVPYLNTVRIRWLQVGLPRMALYSQVLVIVTKTQSSPCPALTQVSLLSSDHPSYLELWRQVALLAGPAVSPEFLNGVIEFKQVNILISNIKKGVQKSQEFETS

SEQ ID NO: 918788 - protein, 171 aa, Homo sapiens; identical to SEQ ID NO: 918787

SEQ ID NO: 918789 - protein, 150 aa, Homo sapiens
MIWELILWYEVSIGWEGGVYVQTCGHTLHIDCHKSYMESLRNDQVLQGFSVDKGEFTCPLCRQFANSVLPCYPGSNVENNPWQRPSNKSIQDLIKEVEELQGRPGAFPVSISILMMPQPLRKEVTVGTGFQQKTKFMLKEDAIHEINQTY

SEQ ID NO: 918790 - protein, 155 aa, Homo sapiens
MVITITLKERKQLSSELGAGAAIDRFMAGCDTCQLIDVIEHQETIKKHIKMQKDKLGPFLSGANRSPSLDPVHYCCTEEERRKVLNNCIMGSFWIPLLVGYFCWINVLPTYSILLTLLLKILYFLLSSQELQSHTLAWRILLYSYSSLMTCSTEK

SEQ ID NO: 918791 - protein, 155 aa, Homo sapiens; identical to SEQ ID NO: 918790

SEQ ID NO: 918792 - protein, 125 aa, Homo sapiens [sequence omitted]

SEQ ID NO: 918793 - protein, 102 aa, Homo sapiens; identical to SEQ ID NO: 779985

SEQ ID NO: 918794 - protein, 102 aa, Homo sapiens; identical to SEQ ID NO: 779985

SEQ ID NO: 918795 - protein, 144 aa, Homo sapiens
MVWFRAPRVCDTRLSVTLMLLHNCLGIHLCPRVCNDANLPQSGQLDEEVGFQDDAQFGSLQHLATEFPMMGQLMGKEKDLLFMARNFLGASVFNSSNLLYTDSELAHIPEGMVLMGLGKPWLTGLPWDDFSAQMFCLPGSSPET

SEQ ID NO: 918796 - protein, 213 aa, Homo sapiens
PICTQTFDETIRKPISLGCGHTVCKMCLNKLHRKACPFDQTTINTDIELLPVNSALLQLVGAQEKNFFNPKDMDEKPTANILNGERLDAFSVPEQQPITLCSGVEDTKHYEEAKKCVEELALYLKPLSSARGVGLNSTTQSVLSRPMQRKLVTLVHCQLVEEEGRIRAMRAARSLGERTVTELILQHQNPQQLSSNLWAAVRARGCQFLGPGT

SEQ ID NO: 918797 - protein, 213 aa, Homo sapiens; identical to SEQ ID NO: 918796

SEQ ID NO: 918798 - protein, 311 aa, Homo sapiens
QKSKWLLIDPHFYCKQKLRTQDYNAAEDADRCVLLPVPLCGVDGGLCVARQGILRQNEQRWRWIFRSVIYEPYLAMFGQVPSDVDGKPDLAQMETAWRRHLLPEPTPRAAPETALQKHARETESNITEYQYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 918799 - protein, 311 aa, Homo sapiens; identical to SEQ ID NO: 918798

SEQ ID NO: 918800 - protein, 212 aa, Homo sapiens
MIGCVCCLFSGSSHLVTLLSSGLALGVVCTEYCDVNRLLVSQPWIPVPVPVEVVGSAMDSSLRRECDSDDTLILDFWPQKPLRRHIPLILSHQVCGNFYGKSRKWIQPCLSLRSTETWNQTQNFTSLCQKDSSELFPQALQSSPESHSVTQGEVQWHNLGSPQPPPPGFKRFSCLSLPSSWDYRHMPPGPEFCVFTTTFAALVQCDRYSTEY

SEQ ID NO: 918801 - protein, 89 aa, Homo sapiens
RLYRSLKVTLFYIYPESRLGSATPKIVSKAKNIEVENKNNLSAVPLNNLEPITNIQIWLANGKRIVQKFNITHSKAKENERRRYRRVHF

SEQ ID NO: 918802 - protein, 259 aa, Homo sapiens
MKDVDNLKSIKEEWVCETGSDNQPLGNNQQSNCEYFVDSLFEEAQKVSSKCVSPAEQKKQVDVNIKLWKNGFTVNDDFRSYSDGASQQFLNSIKKGELPSELQGIFDKEEVDVKVEDKKNEICLSTKPVFQPFSGQGHRLGSATPKIVSKAKNIEVENKNNLSAVPLNNLEPITNIQIWLANGKRIVQKFNITHRVSHIKDFIEKYQGSQRSPPFSLATALPVLRLLDETLTLEEADLQNAVIIQRLQKTASFRELSEH

SEQ ID NO: 918803 - protein, 130 aa, Homo sapiens
CVALTQDRPQTGSATPKIVSKAKNIEVENKNNLSAVPLNNLEPITNIQIWLANGKRIVQKFNITHRVSHIKDFIEKYQGSQRSPPFSLATALPVLRLLDETLTLEEADLQNAVIIQRLQKTASFRELSEH

SEQ ID NO: 918804 - protein, 337 aa, Homo sapiens
MQKIILPNLGLEAVILSPYWALICAEGQLLAPPSWDIGNNASSVASALGTGDRVSLCRQAGVQWHDLGSLQPPPPRFKRFFCLSLLSSWDYRVCETGSDNQPLGNNQQSNCEYFVDSLFEEAQKVSSKCVSPAEQKKQVDVNIKLWKNGFTVNDDFRSYSDGASQQFLNSIKKGELPSELQGIFDKEEVDVKVEDKKNEICLSTKPVFQPFSGQGHRLGSATPKIVSKAKNIEVENKNNLSAVPLNNLEPITNIQIWLANGKRIVQKFNITHRVSHIKDFIEKYQGSQRSPPFSLATALPVLRLLDETLTLEEADLQNAVIIQRLQKTASFRELSEH

SEQ ID NO: 918805 - protein, 102 aa, Homo sapiens
MKDVDNLKSIKEEWVCETGSDNQPLGNNQQSNCEYFVDSLFEEAQKVSSKCVSPAEQKKQVDVNIKLWKNGFTVNDDFRSYSDGASQQFLNSIKKGLSSQVW

SEQ ID NO: 918806 - protein, 337 aa, Homo sapiens; identical to SEQ ID NO: 918804

SEQ ID NO: 918807 - protein, 337 aa, Homo sapiens; identical to SEQ ID NO: 918804

SEQ ID NO: 918808 - protein, 337 aa, Homo sapiens; identical to SEQ ID NO: 918804

SEQ ID NO: 918809 - protein, 337 aa, Homo sapiens; identical to SEQ ID NO: 918804

SEQ ID NO: 918810 - protein, 168 aa, Homo sapiens
MCQAVTIVQKKATCPASRRGRCTGQQLQCQVVTPSFLDSGPDPGPRSDKRQGLGQVTPAGHTICDTCDMRSKALCLPGAARHLQQHSHQAQPQSQHPCAGQGFWTETLLTCGAGSFFGVALAGAPLSGIPGLCPLDARTHPQTFPNVTIWQREWQNHPQKWTTATEQF

SEQ ID NO: 918811 - protein, 1460 aa, Homo sapiens
ELISTFKLLLEKKRSEVMKMKKRYEVGLEKLDSASSQVATMQMELEALHPQLKVASKEVDEMMIMIEKESVEVAKTEKIVKADETIANEQAMASKAIKDECDADLAGALPILESALAALDTLTAQDITVVKSMKSPPAGVKLVMEAICILKGIKADKIPDPTGSGKKIEDFWGPAKRLLGDMRFLQSLHEYDKDNIPPAYMNIIRKNYIPNPDFVPEKIRNASTAAEGLCKWVIAMDSYDKVAKIVAPKKIKLAAAEGELKIAMDGLRKKQAALKEVQDKLARLQDTLELNKQKKADLENQVDLCSKKLERAEQLIGGLGGEKTRWSHTALELGQLYINLTGDILISSGVVAYLGAFTSTYRQNQTKEWTTLCKGRDIPCSDDCSLMGTLGEAVTIRTWNIAGLPSDSFSIDNGIIIMNARRWPLMIDPQSQANKWIKNMEKANSLYVIKLSEPDYVRTLENCIQFGTPVLLENVGEELDPILEPLLLKQTFKQGGSTCIRLGDSTIEYAPDFRFYITTKLRNPHYLPETSVKVTLLNFMITPEGMQDQLLGIVVAQERPDLEEEKQALILQGAENKRQLKEIEDKILEVLSSSEGNILEDETAIKILSSSKALANEISQKQEVAEETEKKIDTTRMGYRPIAIHSSILFFSLADLANIEPMYQYSLTWFINLFILSIENSEKSEILAKRLQILKDHFTYSLYVNVCRSLFEKDKLLFSFCLTINLLLHERAINKAEWRFLLTGGIGLDNPYANLCTWLPQKSWDEICRLDDLPAFKTIRREFMRLKDGWKKVYDSLEPHHEVFPEEWEDKANEFQRMLIIRCLRPDKVIPMLQEFIINRLGRAFIEPPPFDLAKAFGDSNCCAPLIFVLSPGADPMAALLKFADDQGYGGSKLSSLSLGQGQGPIAMKMLEKAVKEGTWVVLQNCHLATSWMPTLEKVCEELSPESTHPDFRMWLTSYPSPNFPVSVLQNGVKMTNEAPKGLRANIIRSYLMDPISDPEFFGSCKKPEEFKKLLYGLCFFHALVQERRKFGPLGWNIPYEFNETDLRISVQQLHMFLNQYEELPYEALRYMTGECNYGGRVTDDWDRRTLRSILNKFFNPELVENSDYKFDSSGIYFVPPSGDHKSYIEYTKTLPLTPAPEIFGMNANADITKDQSETQLLFDNILLTQSRSAGAGAKSSDEVVNEVASDILGKLPNNFDIEAAMRRYPTTYTQSMNTVLVQEMGRFNKLLKTIRDSCVNIQKAIKGLAVMSTDLEEVVSSILNVKIPEMWMGKSYPSLKPLGSYVNDFLARLKFLQQWYEVGPPPVFWLSGFFFTQAFLTGAQQNYARKYTIPIDLLGFDYEVMEDKEYKHPPEDGVFIHGLFLDGASWNRKIKKLAESHPKILYDTVPVMWLKPCKRADIPKRPSYVAPLYKTSERRGVLSTTGHSTNFVIAMTLPSDQPKEHWIGRGVALLCQLNS

SEQ ID NO: 918812 - protein, 507 aa, Homo sapiens
MWLTSYPSPNFPVSVLQNGVKMTNEAPKGLRANIIRSYLMDPISDPEFFGSCKKPEEFKKLLYGLCFFHALVQERRKFGPLGWNIPYEFNETDLRISVQQLHMFLNQYEELPYEALRYMTGECNYGGRVTDDWDRRTLRSILNKFFNPELVENSDYKFDSSGIYFVPPSGDHKSYIEYTKTLPLTPAPEIFGMNANADITKDQSETQLLFDNILLTQSRSAGAGAKSSDEVVNEVASDILGKLPNNFDIEAAMRRYPTTYTQSMNTVLVQEMGRFNKLLKTIRDSCVNIQKAIKGLAVMSTDLEEVVSSILNVKIPEMWMGKSYPSLKPLGSYVNDFLARLKFLQQWYEVGPPPVFWLSGFFFTQAFLTGAQQNYARKYTIPIDLLGFDYEVMEDKEYKHPPEDGVFIHGLFLDGASWNRKIKKLAESHPKILYDTVPVMWLKPCKRADIPKRPSYVAPLYKTSERRGVLSTTGHSTNFVIAMTLPSDQPKEHWIGRGVALLCQLNS

SEQ ID NO: 918813 - protein, 507 aa, Homo sapiens; identical to SEQ ID NO: 918812

SEQ ID NO: 918814 - protein, 203 aa, Homo sapiens
MITPEGMQDQLLGIVVAQERPDLEEEKQALILQGAENKRQLKEIEDKILEVLSSSEGNILEDETAIKILSSSKALANEISQKQEVAEETEKKIDTTRMGYRPIAIHSSILFFSLADLANIEPMYQYSLTWFINLFILSIENSEKSEILAKRLGRAFIEPPPFDLAKAFGDSNCCAPLIFVLSPGADPMAALLKFADDQVPYNR

SEQ ID NO: 918815 - protein, 921 aa, Homo sapiens
MITPEGMQDQLLGIVVAQERPDLEEEKQALILQGAENKRQLKEIEDKILEVLSSSEGNILEDETAIKILSSSKALANEISQKQEVAEETEKKIDTTRMGYRPIAIHSSILFFSLADLANIEPMYQYSLTWFINLFILSIENSEKSEILAKRLQILKDHFTYSLYVNVCRSLFEKDKLLFSFCLTINLLLHERAINKAEWRFLLTGGIGLDNPYANLCTWLPQKSWDEICRLDDLPAFKTIRREFMRLKDGWKKVYDSLEPHHEVFPEEWEDKANEFQRMLIIRCLRPDKVIPMLQEFIINRLGRAFIEPPPFDLAKAFGDSNCCAPLIFVLSPGADPMAALLKFADDQGYGGSKLSSLSLGQGQGPIAMKMLEKAVKEGTWVVLQNCHLATSWMPTLEKVCEELSPESTHPDFRMWLTSYPSPNFPVSVLQNGVKMTNEAPKGLRANIIRSYLMDPISDPEFFGSCKKPEEFKKLLYGLCFFHALVQERRKFGPLGWNIPYEFNETDLRISVQQLHMFLNQYEELPYEALRYMTGECNYGGRVTDDWDRRTLRSILNKFFNPELVENSDYKFDSSGIYFVPPSGDHKSYIEYTKTLPLTPAPEIFGMNANADITKDQSETQLLFDNILLTQSRSAGAGAKSSDEVVNEVASDILGKLPNNFDIEAAMRRYPTTYTQSMNTVLVQEMGRFNKLLKTIRDSCVNIQKAIKGLAVMSTDLEEVVSSILNVKIPEMWMGKSYPSLKPLGSYVNDFLARLKFLQQWYEVGPPPVFWLSGFFFTQAFLTGAQQNYARKYTIPIDLLGFDYEVMEDKEYKHPPEDGVFIHGLFLDGASWNRKIKKLAESHPKILYDTVPVMWLKPCKRADIPKRPSYVAPLYKTSERRGVLSTTGHSTNFVIAMTLPSDQPKEHWIGRGVALLCQLNS

SEQ ID NO: 918816 - protein, 250 aa, Homo sapiens
MKHSFSTTVWVGKRVRESLLGAAQPTQTSPLLEPRALNVRDSLDYKEDVDHRKDVHHRLDVDHKEDVDHGEHVNHGVNVGHREDVDHGEDVDHGEDVDHREDVDHGVDVDHREDMDHGENVDHRIDVDHGMDMGNRVDVDHGVDLDHREDVDHREDVDHGEDVNHWVDVDHEVDMDHGENVDHGEDVDLGVDMDHGVDVDHGLDMGHREEVEHGEDVDHGIDVDHWTLIEQVKDPSPHHHHPKRILGLRS

SEQ ID NO: 918817 - protein, 155 aa, Homo sapiens
MACFLSLGCLESSDSHQCDLIDSITCKKCKRDDGALMSDLKALALFTTLAGHIGITYVQATTQSFAVHKHRVEIDFPLYEKKTMMTHEKSRHFSVWLETWPPAIYPIASVTEKFCDCQVKKNCKQVTHEEQSFLLQTKQQNEENEESEENAESLK

SEQ ID NO: 918818 - protein, 155 aa, Homo sapiens
MMSGHPPLLCSFQICHLSHKTAYIDYKTNWNIWAVKDLQLHSKEDGNAMFNFFPKWLWMYNRAQRPNHSLGFTKDLSRENRSSKGSMRLKTMAQKGSGAYNCEGISCFQVNIMKRISNRKNSLGIPNFRAHRQNVVYVQQVLVEATKYGVEGCGS

SEQ ID NO: 918819 - protein, 160 aa, Homo sapiens
MSSCAMMSGHPPLLCSFQICHLSHKTAYIDYKTNWNIWAVKDLQLHSKEDGNAMFNFFPKWLWMYNRAQRPNHSLGFTKDLSRENRSSKGSMRLKTMAQKGSGAYNCEGISCFQVNIMKRISNRKNSLGIPNFRAHRQNVVYVQQVLVEATKYGVEGCGS

SEQ ID NO: 918820 - protein, 160 aa, Homo sapiens; identical to SEQ ID NO: 918819

SEQ ID NO: 918821 - protein, 128 aa, Homo sapiens
CAETVGSTPGRTRMESQASLPRPSQAFHGVALTVAPLWLFRQAELPVSKGVGPSSLPKPLLTLCVFSSEASTQPLSSAGEASTTGRRAPLRAAYCAPAAHKRFGGVQLLWQCLQPSEFLLHLLGEKSS

SEQ ID NO: 918822 - protein, 147 aa, Homo sapiens
MKLLAHIYQATTEIKTQNLVWAEHPWDLPEPSGPSDNGEARRTYLMPKSSSVGGSICSGEQRGGHQHCGISSSLRRGWRAVAKQQCDLLRMCGLQMVAQVFWGESRVGYGCNPGNCKLEVKSELVKTSEFAGVAATGGAGRAPWSGL

SEQ ID NO: 918823 - protein, 147 aa, Homo sapiens; identical to SEQ ID NO: 918822

SEQ ID NO: 918824 - protein, 169 aa, Homo sapiens
MGWSQDLFRALWRSLSREVKEHVGTDQFGNKYYYILQNKNWRGQTIQEKRIVEAANKKEVDYETGDIPTEWEAWIRRTRKTPPTMEEILKNEKHREEIKIKSQDFYEKEKLLSKETSEELLPPPVQTQIKGRASAPYFGKEKPSVAPSSTGKTFQPGSWMPRDGKSHNE

SEQ ID NO: 918825 - protein, 186 aa, Homo sapiens
MNKILDIDYHNSQPQGRVGPVVTKTIRQAGRPKPIYLSHSTDGHKPTGIGKRPLLIQQPCMAFKILSCTSYHKPGRRRRWLPRFCRKVATSSALPPTHPSSWGFWVVSQQYLPTVKIHCFLHINTESDLRQLVRRIYHVRAQRENAIQWTLARHQICRHLDLGLISLQKHATQNIQFDVRKNMQHF

SEQ ID NO: 918826 - protein, 216 aa, Homo sapiens
FLRITFSSPLPVLSSCSSFFYFNLSFISPHQGKQTLGCGRVCCSPVCIRVRPCLEEEEKKKKKKKKKKKKKKKKKKKKKKKKKKRKKKKKKEEEEEEEEEEEEKENKMRGRRKKNKRKKKKEEKEEEEEEENKEKEEFHVAGEASQPWRKVNGTPYTAAGKRVNENQEKGKPLMKPSDLVTLIYYHENKLTPNKLKRMSKDTYTKVRSNFICYSQI

SEQ ID NO: 918827 - protein, 279 aa, Homo sapiens
MACRKWEAEDRLVTGQWVVVTEKDGKQESTIFDAVMICSGHHVYPNLPTDSFPGLDQFRGNYLHSRDYKNPEAFKGKRVLVIGLGNSGSDIAVELSRLATQPRHRGWYFYVTPQEIHLFYVALQIKEDLRHPPCEASSLRKEPVFNDELPSRILCGTLSIKPSVKEFTETSAVFEDGTMFEAIDSVIFATGYDYSYPFLDETIMKSRNNEVTLFKGIFPPLMEKPTLAVIGLVQSLGAAIPTADLQAWWAAKVFANSCTLPTTNEMMDDTDEKMGKKLK

SEQ ID NO: 918828 - protein, 380 aa, Homo sapiens
MASVIPASNRSMRSDRNTYVGKRFVHVKNPYLDLMDEDILYHLDLGTKTHNLPAMFGDVKFVCVGGSPNRMKAFALFMHKELGFEEAEEDIKDICAGTDRYCMYKTGPVLAISHGMGIPSISIMLHELIKLLHHARCCDVTIIRIGTSGGIGIAPGTVVITDIAVDSFFKPRFEQVILDNIVTRSTELDKELSEELFNCSKEIPNFPTLVGHTMCTYDFYEGQGRLDGALCSFSREKKLDYLKRAFKAGVRNIEMESTVFAAMCGLCGLKGQKQGEEREGERSSLVRVDGQSDSSAGCCRNLSEVILRAFLSLLQIFVTLLSLLPAGFPPGCFLLYISVVTALHCIFFLMLLLDLLVADFRLQIALPQATAAAFHGVDPF

SEQ ID NO: 918829 - protein, 390 aa, Homo sapiens
AGRAARVSAQDFTSAAMLAPGCELDPDQEVVRTRPEDVPASPSTSTMIVSVLRPPSHASCTACGTVTFHIVERMASVIPASNRSMRSDRNTYVGKRFVHVKNPYLDLMDEDILYHLDLGTKTHNLPAMFGDVKFVCVGGSPNRMKAFALFMHKELGFEEAEEDIKDICAGTDRYCMYKTGPVLAISHGMGIPSISIMLHELIKLLHHARCCDVTIIRIGTSGGIGIAPGTVVITDIAVDSFFKPRFEQVILDNIVTRSTELDKELSEELFNCSKEIPNFPTLVGHTMCTYDFYEGQGRLDGALCSFSREKKLDYLKRAFKAGVRNIEMESTVFAAMCGLCGLKAAVVCVTLLDRLDCDQINLPHDVLVEYQQRPQLLISNFIRRRLGLCD

SEQ ID NO: 918830 - protein, 453 aa, Homo sapiens
AGRAARVSAQDFTSAAMLAPGCELDPDQEVVRTRPEDVPASPSTSTMIVSVLRPPSHASCTACGTVTFHIVERMASVIPASNRSMRSDRNTYVGKRFVHVKNPYLDLMDEDILYHLDLGTKTHNLPAMFGDVKFVCVGGSPNRMKAFALFMHKELGFEEAEEDIKDICAGTDRYCMYKTGPVLAISHGMGIPSISIMLHELIKLLHHARCCDVTIIRIGTSGGIGIAPGTVVITDIAVDSFFKPRFEQVILDNIVTRSTELDKELSEELFNCSKEIPNFPTLVGHTMCTYDFYEGQGRLDGALCSFSREKKLDYLKRAFKAGVRNIEMESTVFAAMCGLCGLKGQKQGEEREGERSSLVRVDGQSDSSAGCCRNLSEVILRAFLSLLQIFVTLLSLLPAGFPPGCFLLYISVVTALHCIFFLMLLLDLLVADFRLQIALPQATAAAFHGVDPF

SEQ ID NO: 918831 - protein, 138 aa, Homo sapiens
MVYWGIVMLFPKLSCHPNQPANTTGSSLIFNVCDPKCQCGLSARLWLDQAHYKQFPQLAPGNMWCLEAWRCQEPQGPKEGVTALAWGAPRSGLPEGPQLSLLFTCNVVSKTHLSPVCVTAVLALPFDGSWFLSCDQKE

SEQ ID NO: 918832 - protein, 879 aa, Homo sapiens
MPFGFQREDNSRRKELPMQRPGGTGERSGTRELGDSRNHRTSKRVSQSWLRELLGLGSLKDCSSSLSFLSPAMWAGTGSRERPDSGSRHFQACEGRELPGPLRAEGCWGLQLQLTGCSCAQECGLLPHQLGRGRAPSGLVDCAAPAVPPLLQLASSQWLLHTGLSVFMLKVQVNDIISRQYLSQAVVEVFVNYTKTNSTVTKSNGAVLIKVPYKLGLSLTIIAYKDGYVLTPLPWKTRRMPNAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHTVFLTAILGGTIVIVIGFFAVLLCYCRDKCGTPQKRERNITKLEVLKRDQTTSTTHINHISTVKVALKAEDKSQLFNAKNSSYSPQKKEPSKAETEERVSMVKTRDDFKIYNEDVSFLSVNQNNYSRNPTQSLEPNVGSKQPKHINNNLSSSLGDAQDEKRYLTGNEEAYGRSHIPEQLMHIYSQPIAILQTSDLFSTPEQLHTAKSATLPRKGQLVYGQLMEPVNRENFTQTLPKMPIHSHAQPPDAREEDIILEGQQSLPSQASDWSRYSSSLLESVSVPGTLNEAVVMTPFSSELQGISEQTLLELSKGKPSPHPRAWFVSLDGKPVAQVRHSFIDLKKGKRTQSNDTSLDSGVDMNELHSSRKLEREKTFIKSMHQPKILYLEDLDLSSSESGTTVCSPEDPALRHILDGGSGVIMEHPGEESPGRKSTVEDFEANTSPTKRRGRPPLAKRDSKTNIWKKREERPLIPIN

SEQ ID NO: 918833 - protein, 234 aa, Homo sapiens
VGGMSPAGLSKTEAEALPATEVSSQKNDPDKDPIIRAVQGEIVVIGATNRLDSIDPALRRPGRFDREFLFNLPDQKARKHILQIHTRDWNPKLSDAFLGELAEKCVGYCGADIKALCTEAALIALRRRYPQIYASSHKLQLDVSSIVLSAQDFYHAMQNIVPASQRAVMSSGHALSPIIRPLLERSFNNILAVLQKVFPHAEISQSDKKEDDVWKCPLCSPDLRLGSIALLKLC

SEQ ID NO: 918834 - protein, 757 aa, Homo sapiens
VVSRGSRGDKKRDIETLILEDSEDENALSIFETNCHSGSPKKQSSSAAIHKPYLHFTMSPYHQPTSYRPRLLLSGERGSGQTSHLAPALLHTLERFSVHRLDLPALYSVSAKTPEESCAQIFREARRTVPSIVYMPHIGDWWEAVSETVRATFLTLLQDIPSFSPIFLLSTSETMYSELPEEVKCIFRIQYEEVLYIQRPIEEDRRKFFQELILNQASMAPPRRKHAALCAMEVLPLALPSPPRQLSESEKSRMEDQEENTLRELRLFLRDVTKRLATDKRFNIFSKPVDVSDYLEVIKEPMDLSTVITKIDKHNYLTAKDFLKDIDLICSNALEYNPDKDPGDKIIRHRACTLKDTAHAIIAAELDPEFNKLCEEIKEARIKRGLSVTSEQINPHSTGARKTETRVEEAFRHKQRNPMDVWHNSANKCAFRVRRKSRRRSQWGKGIIKKRKVNNLKKDEEDTKFADYENHTEDRKLLENGEFEVSTDCHEENGEETGDLSMTNDESSCDIMDLDQGQRLNNGAGTKENFASTEEESSNESLLVNSSSSLNPEQTSRKETFLKGNCLNGEASTDSFEGIPVLECQNGKLEVVSFCDSGDKCSSEQKILLEDQSKEKPETSTENHGDDLEKLEALECSNNEKLEPGSDVEVKDAELDKEGASKVKKYRKLILEQAKTTSLELVPEEPSEPVPPLIVDRERLKKLLDLLVDKSNNLAVDQLERLYSLLSQCIYRHRKDYDKSQLVEEMERTVHMFETFL

SEQ ID NO: 918835 - protein, 757 aa, Homo sapiens; identical to SEQ ID NO: 918834

SEQ ID NO: 918836 - protein, 757 aa, Homo sapiens; identical to SEQ ID NO: 918834

SEQ ID NO: 918837 - protein, 238 aa, Homo sapiens [sequence omitted]

SEQ ID NO: 918838 - protein, 471 aa, Homo sapiens
MDLVYGPLGLLCKGQGACGDLSGGGLSVAVPGEIRGYELAHQRHGRLPWARLFQPSIQLARQGFPVGKGLAAVLENKRTVIEQQPVLCEVFCRDRKVLREGERLTLPRLADTYEMLAIEGAQAFYNGSLMAQIVKDIQAAVVQPHPSAHSSCCPIAGGIVTAEDLNNYCAELIEHPLNISLGDAVLYMPSARLSGPVLALILNILKGYNFSRESVETPEQKGLTYHRIVEAFRFAYAKRTLLGDPKFVDVTEAHGIQQPLNVNTSMFISQPALAPLGSQQVVRNMTSEFFAAQLRSQISDHTTHPISYYKPEFYTPDDGGTAHLSVVAEDGSAVSATSTINLYITNEFGAPPSPANFIQPGKQPLLSMCPTIMVGQDGQVRMVVGAAGGTQITTDTALAIIYNLWFGYDVKRAVEEPRLHNKLLPNVTTVERNIDQVGRGLEKLSHGVGSQGILGWRPGSSQSGQWLVSSL

SEQ ID NO: 918839 - protein, 471 aa, Homo sapiens; identical to SEQ ID NO: 918838

SEQ ID NO: 918840 - protein, 351 aa, Homo sapiens
MNKSFSYSDLARWKTSFGDMLCYLPQVEDLLTSFWKSLQQDTVMLMSLPDVCQLFKCYDVQLYKVGGRTMRMVLKSKRRVSVLKSDLQAIINQGTLATSKKALASDRSGADELENNPEMKCLRNLISLLGTSTDLRVFLSCLSSHLQAFVFQTSRSKEEFTKLAASFQLRWNLLLTAVSKAMTLCHRDSFGSWHLFHLLLLEYMIHILQSCLEEEEEEEDMGTVKEMLPDDPTLGQPDQALFHSLNSSLSQACASPSMEPLGVMPTHMGQGRYPVGVSNMVLRILGFLVDTAMGNKVLLEDETTESAVKLSLPMGQEALITLKDGQQFVIQISDVPQSSEDIYFRENNANV

SEQ ID NO: 918841 - protein, 193 aa, Homo sapiens
LSSSESSKLFQPLPVTQFQSCFHMFRYLFSSAPLYWYQFTVLVHFHAANKDIPETGKFTKERGLLDSQFDVAGEASQSWQKVKGTSHMAADKRRESMCRQTPIFETIRTPTPRTHREERTTLDASSLRAITLTAKVCGFTPEVNACTWLTLNQIPQQVNSNPPAVTISPSPTMSSGTLPEGIPHPAKDIPDST

SEQ ID NO: 918842 - protein, 137 aa, Homo sapiens
RTPEVSDLLSHRMWARPLPDLTLGMTEIQTQEGYVALGQAVAEKTSEHLYIPLSAVSYLEGPPDLQTLRHSCSGSSWNSHCFTAFLRGSPALLPGSYSSPVVPPIAIKPPNLYWEDLYLLFQGKKMIKLSHMVVIWA

SEQ ID NO: 918843 - protein, 234 aa, Homo sapiens
MTAYSRMSLNILSILICILYLKIPLPGSPMTDSRTTIPLTVSEAPAWTGSGLSLISLDSHGSRRLPLPHPSLCVMESCVFVFIPTESEPLEVRAMTVSYTSLAPSVSPTHQHGPVSPRPHVGMGLCPPTHVSAWACVPQPTLQHGACPPGHASAWAMSPNPRVSMGPVSPNPCFSMGHVPQATRQHGPCPHIGESLMQVGSPGKLTQRQKSVYWWRGSALGFRVCEGREGKPVG

SEQ ID NO: 918844 - protein, 136 aa, Homo sapiens [sequence omitted]

SEQ ID NO: 918845 - protein, 279 aa, Homo sapiens
MSGSFEFSCSLLTWALPPTACLADHIPQMVPNCQPFEPTDTLMIWKAFISPSERDLADASSFSTQYMEHADTSPAAENNVCQKHAFPERTTIISGMFLPNLPFERNPELFLNRIWRLPNTTNIQTACGFLHYKSLLCGGENRGYGANGSGDIGGLGGLLRGPELPSLAFSSPLPGHQPKDPQCLDPVVFNSGRTLESSEELTEIWMLTSNSLSSENSSCFWGVFGIGCDYLGERAFSRRPEPSSDRKGGSDSYHLCTSGDSHVNYSCCQCQLGIVQSRT

SEQ ID NO: 918846 - protein, 83 aa, Homo sapiens
ARSGGGSNRRRSRERRGQNPASLAQGEVAPVGAQRDTQTFQQRPQRQNKIVQGAAHPHSAETLPRTSLAAVFPLAPPPTWNKA

SEQ ID NO: 918847 - protein, 118 aa, Homo sapiens
MGLIALCNLALAIQTVNAWILMVLMKWFSLCKQSKVAFSILPATSQSTSTYGTPDLAWSSLGESNRSQSLPSRNCVSGGEDHTQENQVVTRGAMRQYIVHFPTARVKGLGSEALVPEF

SEQ ID NO: 918848 - protein, 144 aa, Homo sapiens
MKRRKASPQTCGPFPDLICYLSSEAKKMASAQDSRRVGLHTAHNLLCKEGLLVVFVSSGASEVTVKLATSQENMHLKGLLGHPNCGTKITCVPFFSQLGARSDVIDKLGPFSPGVTSVLVADLGALTKTGPVQASIFWCLCGVK

SEQ ID NO: 918849 - protein, 155 aa, Homo sapiens
MAGVAGIQGNKSLGCTDLRALGLAHETSFSSLASRAGMGGPAAMMMHVYMLNFVKDSGIAGIRGKRDLHENEEPRSQEPTWKHHSALEKPPNYSGCGGSRHGLTVLGNWLGSLDFTKPLILSSHFKYEIQLDNHVFSHVFWSNILWVKFISTKLL

SEQ ID NO: 918850 - protein, 155 aa, Homo sapiens; identical to SEQ ID NO: 918849

SEQ ID NO: 918851 - protein, 1066 aa, Homo sapiens
AILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGDPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTEFKSTKEGFSIPVSADGFKFGISEPGNQEKESEKPLENDTGFQAQDISGQKNGRGVIFGQTSSTFTFADVAKSTSGEGFQFGKKDPNFKGFSGAGEKLFSSQCGKMANKANTSGDFEKDDDAYKTEDSDDIHFEPVVQMPEKVELVIGEEGEKVLYSQGVKLFRFDAEVRQWKERGLGNLKILKNEVNGKPRMLMRREQVLKVCANHWITTTMNLKPLSGSDRAWMWSASDFSDGDAKLERLAAKFKTPELAEEFKQKFEECQQLLLDIPLQTPHKLVDTGRAAKLIQRAEEMKSGLKDFKTFLTNDQTKVTEEENKGSGTGAAGASDTTIKPNPENTGPTLEWDNCDLREDALDDSVSSSSVHASPLASSPVRKNLFHFGESTTGSNFSFKSALSPSKSPAKLNQSGTSVGTDEESDVTQEEERDGQYFEPVVPLPDLVEVSSGEENEKVVFSHRAELYRYDKDVGQWKERGIGDIKILQNYDNKQVRIVMRRDQVLKLCANHTITPDMTLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNASLKSNNSETSSVAQSGSESKVEPKKCELSKNSDIEQSSDSKVKNLSASFPMEESSINYTFKTPEKEPPLWHAEFTKEELVQKLSSTTKSADHLNGLLREAEATSAVLMEQIKLLKSEIRRLERNQEQEESAANVEHLKNVLLQFIFLKPGSERERLLPVINTMLQLSPEEKGKLAAVAQGEE

SEQ ID NO: 918852 - protein, 377 aa, Homo sapiens
GFTPLGTLVLQDTRLGIIGEELNTTDLYSYRKVTDNISSCMENFNLGKSLEDFRFSHMAKYVWIAEYFYQGFKRWIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVSKENYLDLYMQ

SEQ ID NO: 918853 - protein, 142 aa, Homo sapiens
TYTSFFWNMFPSKAFSFSEEGIGDQKPIPQNMALQLAELKKPLKVSVTLPSSTLSLPKHRIKSFSKEEKLKLVNAAGQTFVTNYSVGPPDFVPGHCMFFKSIDNPKDNLLTPQNHPYFPISLSPRKRVYKDLYLIGYVTMAR

SEQ ID NO: 918854 - protein, 574 aa, Homo sapiens
SVDAAADAARSNRVTVFPVGIGDRYDAAQLRILAGPAGDSNMVKLQQIEDLPTMVTLGNSFLHKLCSRFVRIRMDEDGNEKRPGDVWTLPDQCHTVTCQPDGQTLLKSHRVNCDRGPRPSCPNSQSPVKVEDTCGCRWTCPYFVNLSKIKNATAACERSIEDKKCYCERLKRIPAVFHEDENLFLVKDFKISIFNYRFILQQQEEERIKAEELYEKDTEELKIMEEQYRTQTEVKKQSKLTLKSLEVELKTVRSNSNQTSHTHEKERDLWQENHLMRDEIARLRLEIDTIKHQNRETENKYFKDIEIIKENNEDLEKTLKLNEETLTKTITWYSKELNVLMDENTMLNFELEKEKQSTPRLETEMESYRCRLAAALCDHDQCQSLKRDLQLAFQSTVNEWCHLQENTNSHIQILSQQLSKAESTSSGLETELRYEREALKEKTLGIEHMQGVLSRTQCPLKDIEHMYQNDQPILEKYVRKQQSIEDGLFQLQSQNLLYQQQCNDAHKKADNQEKTIINIQVKCEDTVEKLQAECRKLEENNKGLMKECTLLKERQCQYEKEKEKGEMKNLVVIL

SEQ ID NO: 918855 - protein, 269 aa, Homo sapiens
ELTMDLNVRMWRSRRTTLEIGHHTSHVQEAQSALQICLTHPELQNEICCQLIKQTRRRQPQNQPGPLQGWQLLALCVGLFLPHHPFLWLLRLHLKRNADSRTEFGKYAIYCQRCVERTQQNGDREARPSRMEILSTLLRNPYHHSLPFSIPVHFMNGIYQVVGFDASTTVEEFLNTLNQDTGMRKPAQSGFALFTDDPSGRDLEHCLQGNIKVKPSPFQEPSPTNSKEATLYKKSKLCKKFNSGVFQNFNQSNLHDKKKKMQDFNHKGP

SEQ ID NO: 918856 - protein, 98 aa, Homo sapiens
ARLRFAPAAGAMGLSRVRAVFFDLDNTLIDTAGASRRGMLEMGSRYVAHAGPELLNSSDPATLAFQSAGITGMSHHARPKKHKFYFHIFMTRMKDVGL

SEQ ID NO: 918857 - protein, 259 aa, Homo sapiens
ARLRFAPAAGAMGLSRVRAVFFDLDNTLIDTAGASRRGMLEVIKLLQSKYHYKEEAEIICDKVQVKLSKECFHPYNTCITDLRTSHWEEAIQETKGGAANRKLAEECYFLWKSTRLQHMTLAEDVKAMLTELRKEVRLLLLTNGDRQTQREKIEACACQSYFDAVVVGGEQREEKPAPSIFYYCCNLLGVQPGDCVMVGDTLETDIQGGLNAGLKATVWINKNGIVPLKSSPVPHYMVSSVLELPALLQSIDCKVSMST

SEQ ID NO: 918858 - protein, 246 aa, Homo sapiens
MYTNNEIDFNSEQKVFKEISGKNIGKLKHILLVCTLTKEDNRCVGKIPEDEQLHVLPLYKMANTDEFGSEENQNAKVGSGAIQVLTAFPREVRRLPEPAKSCRQRQLEARKAAAEKKKIQKEKLSTPEKIKQEALELAGITSDPGLSLKGGLSQQGLKPSLKVEPQNHFSSFKYSGNAVVESYSVLGNCRPSDPYSMNSVYSYHSYYAQPSLTSVNGFHSKYALPSFSYYGFPSSNPVFPSHFRVP

SEQ ID NO: 918859 - protein, 117 aa, Homo sapiens
LTEKPWALGAGDFNSALKGSPGFQDKLWNPMKGEEGRIPAAGASQLDRAWQSFGLPLGSSEKLFGALKSEEKLWDPFSLEEGPAEEPPSKGAVKEEKGGGGAEEEEEELWSDSEHNF

SEQ ID NO: 918860 - protein, 622 aa, Homo sapiens
MYTNNEIDFNSEQKVFKEISGKNIGKLKHILLVCTLTKEDNRCVGKIPEDEQLHVLPLYKMANTDEFGSEENQNAKVGSGAIQVLTAFPREVRRLPEPAKSCRQRQLEARKAAAEKKKIQKEKLSTPEKIKQEALELAGITSDPGLSLKGGLSQQGLKPSLKVEPQNHFSSFKYSGNAVVESYSVLGNCRPSDPYSMNSVYSYHSYYAQPSLTSVNGFHSKYALPSFSYYGFPSSNPVFPSQFLGPGAWGHSGSSGSFEKKPDLHALHNSLSPAYGGAEFAELPSQAVPTDAHHPTPHHQQPAYPGPKEYLLPKAPLLHSVSRDPSPFAQSSNCYNRSIKQEPVDPLTQAEPVPRDAGKMGKTPLSEVSQNGGPSHLWGQYSGGPSMSPKRTNGVGGSWGVFSSGESPAIVPDKLSSFGASCLAPSHFTDGQWGLFPGEGQQAASHSGGRLRGKPWSPCKFGNSTSALAGPSLTEKPWALGAGDFNSALKGSPGFQDKLWNPMKGEEGRIPAAGASQLVFYQHKNLNQPNHGLALWEAKMKQLAERARARQEEAARLGLGQQEAKLYGKKRKWGGTVVAEPQQKEKKGVVPTRQALAVPTDSAVTVSSYAYTKVTGPYSRWI

SEQ ID NO: 918861 - protein, 333 aa, Homo sapiens
MASNDDARKLPAGSFGTTDCPHKEPVGWTPAPAPCLKHPCRPSACTGAPLKAPTYGSAHTPGSLQLTTTQGPSSSPPPGSFKLSPSRVPPAFPALGSLQFSSPRVPPASPLNLPGVPAARASAPGVPPAGFSLAPWGLVLHPSLSTSCLQAVSELCAPDTHEQNYSPKDVRAPVAGTCEHQQIKTQFSRGMIFAFRKMKSRKLRDGAHSLVFQHLSRGSTKHDSRQCASVWTFVMLYFLLRGAPDSGQNALGDPVMTTQPPLLLLVEQTTGSSRGENTVGTLDVGRGSKSPKQGAGLGRGEGAVSVVALDASEVIFRALESSPRARAPFVVLE

SEQ ID NO: 918862 - protein, 151 aa, Homo sapiens
MEYDEELIPHLQMCGGAATLEACAGLYGPHCTLRAMNLVADPQVTARQEGTEAMEDLRVWPAKPALGSMLEMEMGCMGQQRAPGALLRYPGLPQGPHMDLVWKCPPRLRVPGSGQSQRQWLGGSGSVFQHQQLNCGAHHTRHVPGEAEGLC

SEQ ID NO: 918863 - protein, 181 aa, Homo sapiens
VRLHGHPVSAVGGETGQRSTMWVFLMGQARVHWHHFHSQASNSTLSHGTPRRTEDAPRATLQQAGWAPFPAALGDLHGSLQSPAPLQGCTPPSTSNDSKHKPRLGKCSWCQTQMTFPFLDFTNYSKPSLFLLFHTGALSLLCGCFSRISNCLFLVEKEEILMLFTIVPIIHLSFLCISWIA

SEQ ID NO: 918864 - protein, 166 aa, Homo sapiens
CIIRGVPAMIKHQGKAAFPVHDRRRSFGSTDKTCLLCLYQKMKGIEIKRREKLKCGTKIERRKRLRDRPEVVGGSFSWSKEQEDRGLISQGRSPDPSHGTKSHARPYEETTKQALWRRCRRHRRRQARERGLEQILPCSLRRNQSWSHLDLRLLASRMVAAAKMAK

SEQ ID NO: 918865 - protein, 328 aa, Homo sapiens
SSHMPERSHIVLPLSEEKSTRGFYFAKLYYEAKEYDLAKKYICTYINVREMDPRAHRFLGLLYELEENTEKAVECYREQLLDCEGEDGWNKLFDLIQSELYVRPDDVHVNIRLVELYRSTKRLKDAVARCHEAERNIALRSSLEWNSCVVQTLKVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVSKDFNKLNILNFV

SEQ ID NO: 918866 - protein, 143 aa, Homo sapiens
MAGILSMEFRLLSSGPSRNCLILWEQERIPGPWQLLNAAQHSRFESYRPGTGLEEDTSEAAGLTRPELGGASAEGETYAELSKRPNLRTRAGHGSNQGGFKPQNPHRCDAFICFIQKQARKEMGLDCILSAKPYPTFSLCHPQ

SEQ ID NO: 918867 - protein, 148 aa, Homo sapiens
HNHFLAPLGSMSHDVSCSFLRSYKENRREEGPSVLEAGVLSGYPCWEPHPHSQWNCMSNLIFYHQNVLYVLLVISSFILRKILCKTFYPNVQTGNRCSQAVTCTGSHPPAMWLQPSLAIAATAALHPAALGPIRCWLHPKMHILGDFS

SEQ ID NO: 918868 - protein, 159 aa, Homo sapiens
MPHFHQMDSSQSLCCVPKGTSQDSRSGKKHPGSQGWELHPRITNALVNACSTCSVAPLASTAGSLHLYKVNNKNIIKQRQSQIATLVLRYNQFMILGEQEARSQQVWTHSRGHEGFYVLSPGFHPSHEGFYALGLGCSAAGQPSTLKHRTWCSIGHKKF

SEQ ID NO: 918869 - protein, 159 aa, Homo sapiens; identical to SEQ ID NO: 918868

SEQ ID NO: 918870 - protein, 152 aa, Homo sapiens
EAPEELRAQEERTVMKKPTNETNSTLKVTRKNSAPLVLALSLLAKSSREVEKPSANVWKPFSIIKEILPNHTKHSDTSPIPPIMGLAAAALRPECHDSDDNSNDDNSNDEVSHLKFSSHSSHPKSLPSLPFIYTGVILCASVRPFCMYNDRQ

SEQ ID NO: 918871 - protein, 156 aa, Homo sapiens
EAPEELRAQEERTVMKKPTNETNSTLKVTRKNSAPLVLALSLLAKSSREVEKPSANVWKPFSIIKEILPNHTKHSDTSPIPPIMGLAAAALRPECHDSDDNSNDDNSNDEVSHLKFSSHSSHPKSLPSLPFIYTGVILCASVRPFCMYNDHLRHCL

SEQ ID NO: 918872 - protein, 703 aa, Homo sapiens
MEDKLKAANIQTSESETRLYNKCQDLESLIQEKDDVIQNLELQLEEQLELENQNLRLINQNQTEEIRTMQSKLQEVQGKKSSTVSTLKLSEGQRLSSLTFGCFLSRARSPPQVVKSEEMSKISSKEPEFTEGKDMEEMEIPEKSVDNQVLENNRGQRTLHQTPCGSEQNRKTRTSFATDGGISQNSGAPVSDWSSDEEDGSKGRSKSRCTSTLSSHTSEEGVQCSRMGSEMYLTASDDSSSIFEEETFGIKRPEHKKLYSWQQEAQWKALNSPLGKGNSELSKKEQDSSSDELNKKFQSQRLDYSSSSSEANTPSPILTPALMPKHPNSLSGKGTQLVPSSHLPPPKLRIPNVFSISVALAKRHLSQPQLSSDRMFGTNRNAISMIRPLRPQETDLDLVDGDSTEVLENMDTSCDDGLFSYDSLDSPNSDDQEHCDSAKKVAYSKPPTPPLHRFPSWESRIYAVAKSGIRMSEAFNMESVNKNSAATLSYTTSGLYTSLIYKNMTTPVYTTLKGKATQISSSPFLDDSSGSEEEDSSRSSSRTSESDSRSRSGPGSPRAMKRGVSLSSVASESDYAIPPDAYSTDTEYSQPEQKLPKTCSSSSDNGKNEPLEKSGYLLKMSGKVKSWKRRWFVLKGGELLYYKSPSDVIRKPQGHIELSASCSILRGDNKQTVQVLNFFFFFFFFVSCQTQFSIIQPNGKEIG

SEQ ID NO: 918873 - protein, 560 aa, Homo sapiens
MEDKLKAANIQTSESETRLYNKCQDLESLIQEKDDVIQNLELQLEEQLELENQNLRLINQNQTEEIRTMQSKLQEVQGKKSSTVSTLKLSEGQRLSSLTFGCFLSRARSPPQVVKSEEMSKISSKEPEFTEGKDMEEMEIPEKSVDNQVLENNRGQRTLHQTPCGSEQNRKTRTSFATDGGISQNSGAPVSDWSSDEEDGSKGRSKSRCTSTLSSHTSEEGVQCSRMGSEMYLTASDDSSSIFEEETFGIKRPEHKKLYSWQQEAQWKALNSPLGKGNSELSKKEQDSSSDELNKKFQSQRLDYSSSSSEANTPSPILTPALMPKHPNSLSGKGTQLVPSSHLPPPKLRIPNVFSISVALAKRHLSQPQLSSDRMFGTNRNAISMIRPLRPQETDLDLVDGDSTEVLENMDTSCDDGLFSYDSLDSPNSDDQEHCDSAKKVAYSKPPTPPLHRFPSWESRIYAVAKSGIRMSDAGSKAGESAQWDSYFFSSAEATPVQWGQHFWMHRVCLALGGRLRKPAALGVGWGYGDGDGFLEPGAGTGLWRLGGIWGRWLNSVFSG

SEQ ID NO: 918874 - protein, 263 aa, Homo sapiens
MGSWLHSSHSRCGLCFRLNDEVPKYRDQILNPGLMVFPKPVTALEYAFSRSDLTSYAGYTEDLKKFLKPYTLEEQKNLTVCPDGALFEQKGPVYVACQSPISLLQACRGMNDLDFGYSQRNPCILVKMNRIIGLKSEGVPRIDCVSKNEDIPNVAVYPHNGIIDLKYFPYYGEKLHVGYLQPLVAVQVSFAPNDTGKEVTVECKIDGSANLKSQDDRDKFLGRVMFKITACAYKPGPGEFYYHGRYTQTMLSLSDYMRYCRVY

SEQ ID NO: 918875 - protein, 263 aa, Homo sapiens; identical to SEQ ID NO: 918874

SEQ ID NO: 918876 - protein, 201 aa, Homo sapiens
MSVHRHLGPRVRPGPGCCWPLVPAGHPRSGRAGSPALRGAEGRRRRSPGLSQGGLETLPRLDTEREDRDARPPYGLQRLPVQMAPSARRQGGRLGAGGSFVLLSADAVRDGLGTILRGGAEEGSYDNWPHTRPWEAQGARSPRKGRYICRGPGSRLRPPGMGPACSQAKGRGGKAPTRPVSVTLCPSPNVGPPRTFLQWHQ

SEQ ID NO: 918877 - protein, 198 aa, Homo sapiens
HKKNHSEGEEWMLRNKTRNCKREISDRKENVGNATGKEFQENKDKGQGGLKGGPEGGKAGGRFLVFNSLVRLLASAPSTPQPSKLRRKPPPRACSRGGGFSRHSLSHGNQPPASPPGRGCARSERGSRTPGTGNRAAGGEQASEPGSTPNGLDCESAREKTVWLGLDPCRPPPPPHTPSPGVPFITLCLQLQKKLPTS

SEQ ID NO: 918878 - protein, 337 aa, Homo sapiens
SQSSLQSLTYTEGLGSCPSQHRGHGAATAPWLGLARVSPSPEISPFMGPPHTPSPALWAFSTDVGTLTIAAPTRGTNTGMFTIPAPTWGRSLFQHRHGDAHYSSTDVGTLAISAPTRGTDTGTLTIPAPTRGTDTGTLTIPAPTRGRSLFQHRHGDDHYSSTDTGTFTISAPTRGRSLFQHRHGDAHYSSTDKGHRHGDAHYSSTDKGHRYGDAHSTSTDTGTLTIAAPTRGTDMGTLTIPAPTRGTDMGTLTIPAPTRGRSLFQHRHGDTHYSSTDTGHRHGDAHYSSTDTGTLTIPAPTRGTDTGTLTVPAPIRGTNMRTLTIAAPIQGCSLFQR

SEQ ID NO: 918879 - protein, 170 aa, Homo sapiens
TYTLSPNRTKWEMLEAFPLRTGRGQGCQLSLFIFNIVLEVLARAIRPEKQIKGIQIGKEVKLSLFIDEIILYLENPKDSTKRFLELINNFSKDSGHKTNVQKSVAFPYTITFKLGAKSRIQCHLQHTNTHTHTHTHTHTPLGIHITRGVKGLYEGNYKTLLKEIIDDTNK

SEQ ID NO: 918880 - protein, 108 aa, Homo sapiens
PSVNDSLNFHRYRIGSFWWVLGLADFKNEAAEPHGLPDYQQPALVTLCKEFTLIEEKCTNNVNEKPEILGNRGLSPSAQLMNDINWCIIHYFSRRMILRCMVCFTSQI

SEQ ID NO: 918881 - protein, 108 aa, Homo sapiens; identical to SEQ ID NO: 918880

SEQ ID NO: 918882 - protein, 108 aa, Homo sapiens; identical to SEQ ID NO: 918880

SEQ ID NO: 918883 - protein, 349 aa, Homo sapiens
MSNVYTVKRTENYEIHEKVLNEVVGAMMYHTFSLTREDLENFKALRVIVQVGSGYDNVAIKAAGELEIAVCSIPSAAVEETADSTTGHILNLYWGNRSLYQALREGTRVQSVEQIGEVASVKARIRGEILGLIGFGRTQQEDGIERSLGVHRVYTQQDLLYQNDCVFLHCNLNEQNYHLIHDFTIKQMRQGAFLVNAARGGLEGRIRGAALDVNESEPFSFARGLLKDAWNLICTPLTACYSQQVSLEMSEAVATEIRQAIISRIPGSLRNCVNKEFFVTSALWRTSAAREDIIPGDIPVTDNLPTVVHPSQGPSPNSPQNTGTVESIPTSNSRECRKKTDNVVCLRKL

SEQ ID NO: 918884 - protein, 349 aa, Homo sapiens; identical to SEQ ID NO: 918883

SEQ ID NO: 918885 - protein, 349 aa, Homo sapiens; identical to SEQ ID NO: 918883

SEQ ID NO: 918886 - protein, 137 aa, Homo sapiens
MPTMLESSELEVITSEAQGPPESLTVRCWMILSDPSPQVKEDMLHKEGLQVYGGGFIGMDVCSNSELCGTKISSKHLKKTFLDRENPFKESTDGPPLIVALVFMSASASAISRPQQEHSQVREGRPKAPGPFILLSC

SEQ ID NO: 918887 - protein, 137 aa, Homo sapiens; identical to SEQ ID NO: 918886

SEQ ID NO: 918888 - protein, 137 aa, Homo sapiens; identical to SEQ ID NO: 918886

SEQ ID NO: 918889 - protein, 434 aa, Homo sapiens
MLAGIATARFYTASPLPPSGPPFLSFEEDPRQQALELVVQEVSSVLRSAEEKVVVCHVVGQAIQFLVSETPALGAGCRLYDMRLSPFHLQDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTFELNAKSKELHLQISEAGRSSEGLLATATVPLDLFKKQPSGPQSFTLTSGSACGSSVLGSVTAEFSYMEPGELKSWPIPPPVPAAKIEKDRTVMPCGTVVTTVTAVKTKPRVDVGRASPLSSDSPVKTPIKVKVIEKDISVQAIACRSAPVSKTLSSSDTELLVLNGSDPVAEVAIRQLSESSKLKLKSPRKKSTIIISGISKVPSWWLGRCSSGHLSVTCCSSAL

SEQ ID NO: 918890 - protein, 497 aa, Homo sapiens
MLAGIATARFYTASPLPPSGPPFLSFEEDPRQQALELVVQEVSSVLRSAEEKVVVCHVVGQAIQFLVSETPALGAGCRLYDMRLSPFHLQDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTFELNAKSKELHLQISEAGRSSEGLLATATVPLDLFKKQPSGPQSFTLTSGSACGSSVLGSVTAEFSYMEPGELKSWPIPPPVPAAKIEKDRTCIFKAETQVATEEKHYYHIRDLQVSQDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 918891 - protein, 497 aa, Homo sapiens; identical to SEQ ID NO: 918890

SEQ ID NO: 918892 - protein, 497 aa, Homo sapiens; identical to SEQ ID NO: 918890

SEQ ID NO: 918893 - protein, 497 aa, Homo sapiens; identical to SEQ ID NO: 918890

SEQ ID NO: 918894 - protein, 497 aa, Homo sapiens; identical to SEQ ID NO: 918890

SEQ ID NO: 918895 - protein, 751 aa, Homo sapiens; identical to SEQ ID NO: 846008

SEQ ID NO: 918896 - protein, 114 aa, Homo sapiens
MGGLALPGFILLQVGLSRRSGSTGKMQACMVPGLALCLLLGPLAGAKPVQEEGDPYAELPAMPYWPFSTSDFWNYVQHFQALGAYPQIEDMARTFFAHFPLGSTLGFHVPYQED

SEQ ID NO: 918897 - protein, 145 aa, Homo sapiens
MGAAPRLPAPRRANPGFSEHLVKGGDRPRREACALARGTRRRSLRVECLLGAPTAPGNTPVVRGVAFAALRWLQHPMGARGVIESRRRTDGWTLRALRGLSKGTAEESTLWPNAGGHIGVCQIVKPSGTMLKRVALCTPLPKHFH

SEQ ID NO: 918898 - protein, 157 aa, Homo sapiens
VSCVMNSPVMIMEDEGLMFSHTGTLRPLAEERMALAYEFLVLFLNGCPEAHGSPKSLQQCLQTGNGMTLRQMEDGLSVCNCKDISYCSCTVLVIRDSWIVKDLHWELTTGEHIFSQPPLISHGSFQTSQHALVTSPAEGTRFNPHAAVGGPQQQMTF

SEQ ID NO: 918899 - protein, 175 aa, Homo sapiens
EEHTPKLLVLVMNPDPTQKPLSVQCASVSCCIRRDDDSTDFMDLLGEFKEMKPARHLGQHLTLRFTPVIWAHLTTMAFAIPGACIRSHTPAPTPTVMENYNTDVHTGSSFYCPVPREALEQNQKKVKNKQPYTVVIILSPVMEPYLGLKYFDTDEASLCNFQRKGFCDTLSCLKE

SEQ ID NO: 918900 - protein, 175 aa, Homo sapiens; identical to SEQ ID NO: 918899

SEQ ID NO: 918901 - protein, 172 aa, Homo sapiens
MIFMHTMFSPRLYHVPGIPETKLQGFVQFFKFFPEFNHSYVIHSHLFKFLCDKLLGGLSCGRAVQKLLCTYTIKSGMGITSKRQEKRQCGWDLLLESSTFQKPLTITEKKLGTYLTPTENITIPTVDSRGHKVGWGEQQEGVTGGEGARRYESCVYEGRMWMGVERDQKPEH

SEQ ID NO: 918902 - protein, 1010 aa, Homo sapiens
LRQACMTERLSVCTAVIAPKQGNENRKQQFVQGRDNVHKENPFLDVTFYKETKSPFHEIKNRCKANSVVPSNKRENNISSSVLKISKSQNQPSLEIAKPSYFRDSGTISVPQFPMDLNSKMSSVYLKEIAKKKNDKKEAYVRDFTNIYWSQNRPDVKKQKLQNDKKTVEAENIFSKCYENDYPSLSSQNTCKRKDLISSNYCNCSSIQCNVRDSRKNFAILENANWEEAECLDSYVLTRLEKSQNWDCNVRHILRRNRGNCWIINNCKTKCENMKKTEEKWNWLLLLEIDLLSKEDYHCAKVINAYEEQSKLLVREILGSQTALITTVWLNGKGENDNTLQLRYNTTQKVFHVNNPFESFIIEIFYFHKSISGNKKDNSILTCCNILKCKKQIGIIGIQNLITRNMNTNIKNGILSIYLQDSVSEPLDILLKTNIAFLLNNFDSLTRIENDFELEEECIFKCMLYLKYPKNIVENHTAYLVKILTSSRLLEDNMKPMLKKRKLFRTEQVFEKSKKKLINSFSMTTQNTGFPIFETYEKIPLLMDFDDMDEISLIREITCQNMSCPQQVVNVENWAHYNSSTVKAHGNSCPQFIQNNRGYINENFYEVNMHSQDLNMERKQGHNKISNFDCEHIFEDLCNVRQQAIPASHNIIHNEETHTTSITQVLNFWNLLSEIEEKKYDLILKEEVKVTAESLTNSCQVHKDTKIEKEEKDSFFPMDDMFSVQSVSLISKEVNVEENKYVNQNYVTNTNEYESILPEREIANSKDFHRKNDSALYINHQFETGLSEGNDECFQDLAAKYLSTEALTIVKDFEMKRKFDLVLEELRMFHEISRENELLSTVETNNGQENYFGENDAEKVKMEIEKDLKMVVVNKIRASSSFHDTIADPNMGKSHQSLFKWKTVPNNGEQEVPNESCYPSRSEEELLYSTSEKDCETPLPKRPAFLPDECKEEFNYLLRGGSHFPHGISRVRPLKTCSRPIRIGLSRKARIKQLHPYLKQMCYGNLKENF

SEQ ID NO: 918903 - protein, 168 aa, Homo sapiens
MAAAWSAAESLIGRPLSRHRLVMQFLLDPQENWTASDTLIEQDWSQSFATSCLDIKTLAKAVLSMNGCQIIVCVGRGHWCVISIPSGYERSRLKVTLPEEGRGALPFLVSVAISSGSCSDNNAAVPTVLEGATTVISAAAVLRDPHDGAREIILEAMTISAVAIAAEM

SEQ ID NO: 918904 - protein, 197 aa, Homo sapiens
MGVNDLWQILEPVKQHIPLRNLGGKTIAVDLSLWVCEAQTVKKMMGSVMKPHLRNLFFRISYLTQMDVKLVFVMEGEPPKLKADVISKRNQSRYGSSGKSWSQKTGRSHFKSVLRECLHMLECLGIPWVQAAGEAEAMCAYLNAGGHVDGCLTNDGDTFLYGAQTVYRNFTMNTKVFIFFLFFSICLRTTFFKGLIK

SEQ ID NO: 918905 - protein, 156 aa, Homo sapiens
IAEQTLLIFHRYTNLFFRISYLTQMDVKLVFVMEGEPPKLKADVISKRNQSRYGSSGKSWSQKTGRSHFKSVLRECLHMLECLGIPWVQAAGEAEAMCAYLNAGGHVDGCLTNDGDTFLYGAQTVYRNFTMNTKVFIFFLFFSICLRTTFFKGLIK

SEQ ID NO: 918906 - protein, 127 aa, Homo sapiens
PAFCFQCLHMLECLGIPWVQAAGEAEAMCAYLNAGGHVDGCLTNDGDTFLYGAQTVYRNFTMNTKDPHVDCYTMSSIKSKLGLDRDALVGLAILLGCDYLPKGVPGVGKEQALKLIQILKGQSLLQR

SEQ ID NO: 918907 - protein, 890 aa, Homo sapiens
MWGEEEAEIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVLQSYSNIEEDCTMCPSWCLTVRARGHSYFAGFEHHIPQYSLDVPKRGSDVILRPTSALWTRGHQIILICTYPEGSSWKQHTFYLQCNASPQYLKALPVPLMGSEAKKEGAENPEEGSGGGKRHLQEVSMYSREEPLQLKLDTHKSLYFKPTWVGCSSTSPFTFRNPSRLPLQFEWRVSEQHRKLLAVQPSRGLIQPNERLTLTWTFSPLEETKYLFQVGMWVWEAGLSPNANPAATTHYMLRLVGVGLTSSLSAKEKELAFGNVLVNSKQSRFLVLLNDGNCTLYYRLYLEQGSPEAVDNHPLDNKAGEKQELCCVSLVAVYPLLSILDVSSMGSAEGITRKHLWRLFSLDLLNSYLERDPTPCELTYKVPTRHSMSQIPPVLTPLRLDFNFGAAPFKAPPSVVFLALKNSGVVSLDWYGLKGATGGPGRQVPRG

SEQ ID NO: 918908 - protein, 133 aa, Homo sapiens
MQTSTEDHARQRQRPKKAPGLDFSYDPSNQMCFYMSIACKPPVQHPTRPPLCIILFYAIRHLRNLKFKDGSHSDKVRELVAADPGSSPDSRAPALAFDHPANPIIPLDLKFMCKYRNYFTLRTWRIIIKGPCG

SEQ ID NO: 918909 - protein, 112 aa, Homo sapiens
MLPVQPAELCHGSETARKERQALQRQRPAPDRTWEEGAQTRCWWEKETVLARWKTCGSYPATLTYVLYDSAQSWGAQPTERPAHSLKDAHRDVTALLFLTTEKGNGRNTRLW

SEQ ID NO: 918910 - protein, 160 aa, Homo sapiens
MDSRCPNSLSPAGRGQMDGRCLSSRAGRGRMDGCYPLGELSAALGVPSGSQGAISPLVWMSLPPKGGAEGSTGGAVSSPGVAKGGGQAEVQDITYLEVLPVDDVEPPPTALQGSVTVRDARYESEHGSPTPRIPVGGQLGTGPCSGSSTFCRINSSIRFS

SEQ ID NO: 918911 - protein, 215 aa, Homo sapiens
FERLGTETGIWVDLWVRGAVELGEMVPAAPQLCLIWSCLPIGPQLLGSKSTIICTNAMVYLSEWLQLFQFLPRQCLGIEEGYGMGGPGRDGSPKPGSDHRRMNCSESFILLTSLHRSFVCWFWFNIPGDSCLGRFPHPWCQLPLKYAEHRPHRSQAKFIHTQTEALIIWALRTLFLVAIIHPGRHPAAPRLLASSASPSLLSRLETNQKTHPSEI

SEQ ID NO: 918912 - protein, 215 aa, Homo sapiens; identical to SEQ ID NO: 918911

SEQ ID NO: 918913 - protein, 136 aa, Homo sapiens
MQNNLSKHAHTGDWQWGVAGSINISMSTLKNNKEEGKLLHLGTAPETLPDPAPLTDSLLAAPYIFLSAGAVQKGDFGPKGIGMKGDQSERRWQWTRKLGCRCYCSPLGSGESLSLSSKRGEDHIFILETKKCSQGR

SEQ ID NO: 918914 - protein, 161 aa, Homo sapiens
MQNNLSKHAHTGDWQWGVAGSINISMSTLKNNKEEGKLLHLGTAPETLPDPAPLTDSLLAAPYIFLSAGAVQKGDFGPKGIGMKGDQSERRWQWTRKLGCRCYCSPLGSGESLSLSSKRGLSSVAGGQFVNLYLKRLNSNFIYLSGYVIVYINIYVFIYCI

SEQ ID NO: 918915 - protein, 136 aa, Homo sapiens; identical to SEQ ID NO: 918913

SEQ ID NO: 918916 - protein, 161 aa, Homo sapiens
RPLRSPHSGSGWTPARPPSPPAGAPEALRPPASTTRAPAPLTLSFSARGLAWAGESPASRKRARRPPSLRGPARRPTGARGCGPGLGPPLLTFQLLFFFSFPPVPSAGLTDQSERRWQWTRKLGCRCYCSPLGSGESLSLSSKRGEDHIFILETKKCSQGR

SEQ ID NO: 918917 - protein, 864 aa, Homo sapiens
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEEKPGLGSGGRVTPHALLPAQVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDGPPSVGVSIGSAIHTQLRSSVYPLLAAVGSLGQVLQVSVHHLQTLNATVVELQAGQQDLEPAIREHRDRLLELLQEAQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARFLMAFQAAPTTNRQQHQRWNLFANPRLDVLPLAYPRGVGLSFLFAAPLILLVFATFLVGGNVQTLVCQSWENGELFEFADTPGNLPPSMNLSQLLGLRKNISIHQAYQQCKEGAALWTVLQLNDSYDLEEHLDINQGSISGVLAQQLGMTPTLRLLSQYTNKLRQELQSLKVDTQSLDLLSSAARRDLEALQSSGLQRIHYPDFLVQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 918918 - protein, 575 aa, Homo sapiens
MNFVITHLPPFQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARFLMAFQAAPTTNRQQHQRWNLFANPRLDVLPLAYPRGVGLSFLFAAPLILLVFATFLVGGNVQTLVCQSWENGELFEFADTPGNLPPSMNLSQLLGLRKNISIHQAYQQCKEGAALWTVLQLNDSYDLEEHLDINQGSISGVLAQQLGMTPTLRLLSQYTNKLRQELQSLKVDTQSLDLLSSAARRDLEALQSSGLQRIHYPDFLVQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 918919 - protein, 326 aa, Homo sapiens
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDVPQELQAVAQQFSLPQEQVSEELDGVGVSIGSAIHTQLRSSVYPLLAAVGSLGQVLQVSVHHLQTLNATVVELQAGQQDLEPAIREHRDRLLELLQEARCQGDCAGALSWARTLELGADFSQV

SEQ ID NO: 918920 - protein, 148 aa, Homo sapiens
QAWWHMPVVPATWEAEAGESLEPKSRLSSCGGGERLKKDGRIVVRGSRGETGTHKPEQGTDPSEWALTLSSLFVHTSAAVLGSITRGSPIASPHPQSLCVMLSTVTLHYPVGAKALDIRTEGKQWWLRGRTDTFVLSEHFAEELLVAL

SEQ ID NO: 918921 - protein, 189 aa, Homo sapiens
MGGASGLQEAGRGGLPDPESLGTEAYYCQTLRSCRGNQGPFGPDQSLSQTILWVTGKLLAFSVTVPLLGIPFHTDGSSPPKLEGYLSDTLGEQSGSGLHFPEDSAGQYHVSRDFGFLLARWQILSLCPISCCRALESGVTWPGWPRAELEKAEGVGHVPGSVYRLLSGGMGGPGHCSEGLIERCNDGEL

SEQ ID NO: 918922 - protein, 165 aa, Homo sapiens
MGGASGLQEAGRGGLPDPESLGTEAYYCQTLRSCRGNQGPFGPDQSLSQTILWVTGKLLAFSVTVPLLGIPFHTDGSSPPKLEGYLSDTLGEQSGSGLHFPEDSAGQYHVSRDFGFLLARWQILSLCPISCCRALESGVTWPGWPRAELEKAEALTMEYWECPFL

SEQ ID NO: 918923 - protein, 215 aa, Homo sapiens
MGGASGLQEAGRGGLPDPESLGTEAYYCQTLRSCRGNQGPFGPDQSLSQTILWVTGKLLAFSVTVPLLGIPFHTDGSSPPKLEGYLSDTLGEQSGSGLHFPEDSAGQYHVSRDFGFLLARWQILSLCPISCCRALESGVTWPGWPRAELEKAEGLSIPKPDVISLLEQGKESCMVSRDVPGGWCPDIYIWKREGPRISKTLKKRKDLSCQISELL

SEQ ID NO: 918924 - protein, 184 aa, Homo sapiens
MGGASGLQEAGRGGLPDPESLGTEAYYCQTLRSCRGNQGPFGPDQSLSQTILWVTGKLLAFSVTVPLLGIPFHTDGSSPPKLEGYLSDTLGEQSGSGLHFPEDSAGQYHVSRDFGFLLARWQILSLCPISCCRALESGVTWPGWPRAELEKAEGVCEMVGAYKSVQLGLTGSGGHFVFWTCFGL

SEQ ID NO: 918925 - protein, 255 aa, Homo sapiens
MGGASGLQEAGRGGLPDPESLGTEAYYCQTLRSCRGNQGPFGPDQSLSQTILWVTGKLLAFSVTVPLLGIPFHTDGSSPPKLEGYLSDTLGEQSGSGLHFPEDSAGQYHVSRDFGFLLARWQILSLCPISCCRALESGVTWPGWPRAELEKAEVSLLLPRLECNGMNSAHCNFCLPGSSDSPASASQVAGIRGSNHGILGMSLSVKEVVSHNRNIHEHEGVGHVPGSVYRLLSGGMGGPGHCSEGLIERCNDGEL

SEQ ID NO: 918926 - protein, 177 aa, Homo sapiens
MKEFPGLFLWKMWSLDKKKENMLKTHDPGISRLEPVTKTKPWREPLWERNWQGQHLDSRGYLAGPGREDGRNPLKLFESLQFHRPDFISHIGERIKRLKLIVQERKLQSMLKSERDALFDIDRERQGHQNRMRPLPKRGTPCPFTFLLPGCPEEQAYQQEGNDSEVQTQSHFLELIP

SEQ ID NO: 918927 - protein, 216 aa, Homo sapiens
MYPKKCSSFNLTMASARMQILGVVLTLLGWVNGLVSCVLPMWKVTTFIGNSIVVASQMQCKVYDSLLALPQDLQAARAVCVITLLVALFGLLVYLAGAKCTTCVEEKDSKARLVLTSGIVFVTSGVLTLIPVCWTAHAIIWDFYNPLVAEAQKWELGASLYLGWAASGLLLLGGRLLCCTCPSGGSRGPSHYMARYWTSAPAISRGTSEYPTKNYV

SEQ ID NO: 918928 - protein, 149 aa, Homo sapiens
WTFNAVLEGTNIVSSMRTETDLPCSLFCPQQLAQSLQNEEIPAEIDGFCKRKVAVIKCKETTFGRKPIPWEQHLLNGEFCKHFQFTHSYNKYLLSMALMISGHFPKITAKNMFSTFSSPSRKIYFKGQDYEFEHCFSHTVTNPGIWSRQ

SEQ ID NO: 918929 - protein, 149 aa, Homo sapiens; identical to SEQ ID NO: 918928

SEQ ID NO: 918930 - protein, 148 aa, Homo sapiens
MINYGLSLLASRACQLRPVQSEPPPPPPGAARGQPPDGGQLGASRPVCGDPCPAPQQACGRQRATPPSLRPLTSLHCWVSAARTLATVLVTATLAGLEQAPRAQRPQPRPPRSRLPMVAAPEGRWPPEGRLAPARRAPAELGKSVREA

SEQ ID NO: 918931 - protein, 128 aa, Homo sapiens
MRKINSTLITPPCDKSCRFPFPGFWPDLVTWMQIFQSWIFYCSCSPTTFLTACFLNKIIKCNNRVVFPREIIFYYTQCNCEHLSAPPWPSAARSCGAAVVRRKAEDGVQGTGTGTALEPDGIPGLVFT

SEQ ID NO: 918932 - protein, 162 aa, Homo sapiens
MQVTERGWASSRQFLQLLLLMSVLWPSPILLGMPHGHKCQPLQALASQCGGDIKILGCQTWKEPGASWMDTAVDGVEAAPWAASRQCPAQHPPGFLAGRICRAAVGFREASPWSPSYFHELSLSTPLQKERGKPDLPSQRLWFLSYIALSESNAKCALWKSP

SEQ ID NO: 918933 - protein, 181 aa, Homo sapiens
KFCSRGETEGAGGGPESGSRRSGSKSPPPTTASPARAAARYLSMTEATSCGNSFISKADPGSCPPPLPGSPAPEPLPPPLRRRSSPSSVVLLRLPPGACHRPSAASQEGAETARRRHGSKTRRAERPLLSPGSSRGEGTDRRRCACSEGSAAGKGGRALTSEPARWELLKQVVATWLPGSG

SEQ ID NO: 918934 - protein, 181 aa, Homo sapiens; identical to SEQ ID NO: 918933

SEQ ID NO: 918935 - protein, 134 aa, Homo sapiens
MHTTSQYTKTLSCSTERDSKKGQLFSLEDITVNSCSSAHVGKKTIQTSFSCALSYTLCSGDNQSINRHLVPAPSLFHVWGEHSPQRSSPFLQWLQCKHYTTHNHGYSKAWYILPGAPQYAHLRATQYGGSDSSH

SEQ ID NO: 918936 - protein, 287 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFTVTQPEVADWSEGVQVPSVLFSYSLLKTGALSLPRKTGLQLPLLRPLNG

SEQ ID NO: 918937 - protein, 287 aa, Homo sapiens; identical to SEQ ID NO: 918936

SEQ ID NO: 918938 - protein, 193 aa, Homo sapiens
SQSMAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPVAIIELELGKYGQESEFLCLEFDEVKVNQILKTLSEVEESISTLISQPN

SEQ ID NO: 918939 - protein, 287 aa, Homo sapiens; identical to SEQ ID NO: 918936

SEQ ID NO: 918940 - protein, 175 aa, Homo sapiens
SQSMAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTLSWRVDGKSQSRHSAQIHTPVAIIELELGKYGQESEFLCLEFDEVKVNQILKTLSEVEESISTLISQPN

SEQ ID NO: 918941 - protein, 193 aa, Homo sapiens; identical to SEQ ID NO: 918938

SEQ ID NO: 918942 - protein, 193 aa, Homo sapiens; identical to SEQ ID NO: 918938

SEQ ID NO: 918943 - protein, 193 aa, Homo sapiens; identical to SEQ ID NO: 918938

SEQ ID NO: 918944 - protein, 287 aa, Homo sapiens; identical to SEQ ID NO: 918936

SEQ ID NO: 918945 - protein, 193 aa, Homo sapiens; identical to SEQ ID NO: 918938

SEQ ID NO: 918946 - protein, 217 aa, Homo sapiens
MKELELLKPRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFTVTQPEVADWSEGVQVPSVLFSYSLLKTGALSLPRKTGLQLPLLRPLNG

SEQ ID NO: 918947 - protein, 159 aa, Homo sapiens
SSIFLVQYEEKAYAESEDWRGRSWMSEDWYKIVIQERHQAVISSLYRPVGGQCILVSGSRKMTYHEDLLSNKDCGGEMNGEGAGKGLVIKGPPLLPQHLGRSEMWLQDWGIAKSEMSSSATVAILEGGLSHEREPGGALPAGGCRILAWVFCLLRGTDR

SEQ ID NO: 918948 - protein, 159 aa, Homo sapiens; identical to SEQ ID NO: 918947

SEQ ID NO: 918949 - protein, 192 aa, Homo sapiens
NLSILFYIMGLAWKRYLHNHVQSSIIHNNQKVEATQVSVDGWTDQQNAVYAYSGISAVNRRHFSAPQKLHADCEKEMLDGGVPGTTVRVSFDFSCLEMVRELWMWNVEEEEHEVGISTWGGQHCGCPAKSLPGPHPGGVSAPQSASQLMVKLLVWQKSVHKLRKIAAQSEEWSCVLNKISTHPFVSKEHDGT

SEQ ID NO: 918950 - protein, 154 aa, Homo sapiens
MQGIDRWIPSIPPLQNHSAVNRRHFSAPQKLHADCEKEMLDGGVPGTTVRVSFDFSCLEMVRELWMWNVEEEEHEVGISTWGGQHCGCPAKSLPGPHPGGVSAPQSASQLMVKLLVWQKSVHKLRKIAAQSEEWSCVLNKISTHPFVSKEHDGT

SEQ ID NO: 918951 - protein, 165 aa, Homo sapiens
PVVCNLGYILEQPGKLSKLPMPQWGTPGQGYRQKAYLAGLVLVIQNSLERSGSFSSNGPCPAKEVSNKEETHQGFRVYGEKAQHVEKLQNISSRTLEALVTVCHLIWMNTSVFRFGNPFSCTYPKFSKASWFPALVNSAQNERKVVVLAFKSPPNATDPGLPVLH

SEQ ID NO: 918952 - protein, 450 aa, Homo sapiens
MAQTVPPCELPCKEYDVARNTGAYTSSGLATASFRTSKYLLEEWFQNCYARYHQAFADRDQSERQRHESQQLATETQALAQRTQQDSTRTVGERLQDTHSWKSELQREMEALAAETNLAPWAPGSQRAWEPRPLGTPQKVPFSITTDNRMPVSAGAPTLATCELLKEAELIRNIQELLKRTIMQAVSQIRLNREHKETCEMDWSDKMEAYNIDETCGRHHSQSTEVQAHPYSTTFQERPAEGASPPPTRGRQTPGSKKRARALGTREGGLRGPEVLQRGPPGQRCWERGRGGTRGLSARGWVGCGGTQRSCGQGALGGREPEGLGFVGQHGVHRSPCTSSRSMGRGQGMGAQQGSQPSAEPPRPSPGCPPPRSASTPETRAKFTQDNLCRAQRERLASANLRVLVDCILRDTSEDLRLQCDAVNLAFGRRCEELEDARYKLHHHLHKAVE

SEQ ID NO: 918953 - protein, 570 aa, Homo sapiens
MAQTVPPCELPCKEYDVARNTGAYTSSGLATASFRTSKYLLEEWFQNCYARYHQAFADRDQSERQRHESQQLATETQALAQRTQQDSTRTVGERLQDTHSWKSELQREMEALAAETNLAPWAPGSQRAWEPRPLGTPQKVPFSITTDNRMPVSAGAPTLATCELLKEAELIRNIQELLKRTIMQAVSQIRLNREHKETCEMDWSDKMEAYNIDETCGRHHSQSTEVQAHPYSTTFQERPAEGASPPPTRGRQTPGSKKRARALGTREGGLRGPEVLQRGPPGQRCWERGRGGTRGLSARGWVGCGGTQRSCGQGALGGREPEGLGFVGQHGVHRSPCTSSRSMGRGQGMGAQQGSQPSAEPPRPSPGCPPPRSASTPETRAKFTQDNLCRAQRERLASANLRVLVDCILRDTSEDLRLQCDAVNLAFGRRCEELEDARYKLHHHLHKTLREITDQEHNVAALKQAIKDKEAPLHVAQTRLYLRSHRPNMELCRDAAQFRLLSEVEELNMSLTALREKLLEAEQSLRNLEDIHMSLEKDIAAMTNSLFIDRQKCMAHRTRYPTILQLAGYQ

SEQ ID NO: 918954 - protein, 118 aa, Homo sapiens
AFLMGFFHGVFPGPPASSHWEFWVPYTPEVHTSALPSPGSHPPNTPRLLSEVEELNMSLTALREKLLEAEQSLRNLEDIHMSLEKDIAAMTNSLFIDRQKCMAHRTRYPTILQLAGYQ

SEQ ID NO: 918955 - protein, 142 aa, Homo sapiens
MTTNAACEGAQGAAILTVACLSAVSPKCLKPSCAPTTLGTCCQDLLRPCHGICDCVNGSLVSELSQEALLSVNGRIPPSPQKIIYIHSYWSVKLPSQIVESKCQKHCFSKDFQERNVWSSCAEITKCSFFFQTSLSAVNSWH

SEQ ID NO: 918956 - protein, 1728 aa, Homo sapiens
QDCYNIEDMVYRLLGHVFPSTHTENELKEKKFPPDDEFVEAASKLTDEIIKEISEHEIRLSMAEDNAESMQLEPIENLVDSICNNILKTSEFQAEVQKDADKKGCSFLSKLAGFIMKEIMYHHLQPFLHGEESSFSDLSDYDHVSELAKSGKEKTQPSLYSATFLEDIIIDLVHKFCSLLIITEDSKKNEMAELDIMGLALKLANSLIREFKKSDIKVLPNAEKMFSFPPIDKETVDKISNFVYEQFIEKCTSHDIQKGDESNIAIGMIAALTQKAISAFRIQPLFSGDWSSTFFSFLNPDNITQRVQHLPQNTFTQISRCAKENQLSLPDQSYKDTSSTPDCKNMMSTLEINRGTMNRKKSFKTKDTSVKKGDIQNPVLSSINAIMKSGMINLTSGLATGVTNKKEVDENKVGICTQKHSENVSKVTSTTTVKSKDTQEPNLSETFNNNEIEKKRNLIPTDKKGKDDEIYTHFSLIIDDTEYEKEVLGSDSEIGYKKKIDNARESSFKKDDKLFQLSSLKSKRNLGTTTDTLEIRIRTSSNEGRRDSPTQTCRDEEHHSDYEHVQNVIENIFEDVLELSSSPEPAYYSKLSYDQSPPGDNVLNVIQEISRDSAQSVTTKKVSSSTNKNISAKEKEEEEREKEKVREEIKSEPSKPDDPQNQRESKPGIFPAKFLEDVITEMVKQLIFSSIPETQIQDRCQNVSDKQNQAKLYDTAMKLINSLLKEFSDAQIKVFRPDKGNQFPGGKVSSVPKVPPRYKEPTTDEAPSSIKIKSADKMPPMHKMMRKPSSDKIPSIDKTLVNKVVHSSVCNILNDYGSQDSIWKNINSNGENLARRLTSAVINEIFQRQVNLIFCDEVSVSACLPLESKDVVKKVQKLAQTASKECQTSSPYTIILPHKFLENVISALFSKIFSTISSTKTKEPEDNLSTELNFLQMKLVSAVATEISQDKYMTIQYVETLQSDDDEIIQLVVQSVYNNLLPQFGSQEIIQNCVTSGCKILSENIVDLVLREVASNQLQSYFCGELTPHQCVEVENIVEKILKDVFQTTDVPLPKPSHADKLSYNIIEEIAVKFLSKLLSIFPKVHKERTKSLETDMQKITSKVLNSVQEFISKSFLMVNAISNSEFQPQVEEEVSNSELVLEAVKIMEKVIKIIDELKSKEKSSSRKGLTLDAKLLEEVLALFLAKLIRLPSSSSKDEKNLSKTELNKIASQLSKLVTAEISRSSISLIASDPEEHCLNPENTERIYQVVDSVYSNILQQSGTNKEFYYDIKDTNTAFPKKVASLIIDGVSSFPLDTINSTISNADLSGELDVNRIVQKAQEHAFNVIPELEQEKLDQNLSEEESPIKIVPHVGKKPVKIDPKIISEHLAVISIKTQPLEKLKQECLKRTGHSIAELRRASISGRNYSLGSPDLEKRKTERRTSLDKTGRLDVKPLENIRKPDITKVELLKDVQSKNDLIVRLVAHDIDQVYLENYIKEERDSDEDEVVLTQTFAKEEGIKVFEDQVKEVKKPIQSKLSPKSTLSTSSLKKFLSLSKCCQTTASANIESTEAISNQVIESKETHVKRAVAELDMATPKTMPETASSSWEEKPQCKKEEKNLVTEPTHYFIHRIMSSSSYNQEDLISSTGEAEDCHSDPSAKILEESSQEQKPEHGNSVKFITIFERSKDVLGSANPSKEVISETPKPDVSKQGSKMLTKMSSALSKVFSQCNTNISRSSSPAHQDEH

SEQ ID NO: 918957 - protein, 1503 aa, Homo sapiens
QDCYNIEDMVYRLLGHVFPSTHTENELKEKKFPPDDEFVEAASKLTDEIIKEISEHEIRLSMAEDNAESMQLEPIENLVDSICNNILKTSEFQAEVQKDADKKGCSFLSKLAGFIMKEIMYHHLQPFLHGEESSFSDLSDYDHVSELAKSGKEKTQPSLYSATFLEDIIIDLVHKFCSLLIITEDSKKNEMAELDIMGLALKLANSLIREFKKSDIKVLPNAEKMFSFPPIDKETVDKISNFVYEQFIEKCTSHDIQKGDESNIAIGMIAALTQKAISAFRIQPLFSGDWSSTFFSFLNPDNITQRVQHLPQNTFTQISRCAKENQLSLPDQSYKDTSSTPDCKNMMSTLEINRGTMNRKKSFKTKDTSVKKGDIQNPVLSSINAIMKSGMINLTSGLATGVTNKKEVDENKVGICTQKHSENVSKVTSTTTVKSKDTQEPNLSETFNNNEIEKKRNLIPTDKKGKDDEIYTHFSLIIDDTEYEKEVLGSDSEIGYKKKIDNARESSFKKDDKLFQLSSLKSKRNLGTTTDTLEIRIRTSSNEGRRDSPTQTCRDEEHHSDYEHVQNVIENIFEDVLELSSSPEPAYYSKLSYDQSPPGDNVLNVIQEISRDSAQSVTTKKVSSSTNKNISAKEKEEEEREKEKVREEIKSEPSKPDDPQNQRESKPGIFPAKFLEDVITEMVKQLIFSSIPETQIQDRCQNVSDKQNQAKLYDTAMKLINSLLKEFSDAQIKVFRPDKGNQFPGGKVSSVPKVPPRYKEPTTDEAPSSIKIKSADKMPPMHKMMRKPSSDKIPSIDKTLVNKVVHSSVCNILNDYGSQDSIWKNINSNGENLARRLTSAVINEIFQRQVNLIFCDEVSVSACLPLESKDVVKKVQKLAQTASKECQTSSPYTIILPHKFLENVISALFSKIFSTISSTKTKEPEDNLSTELNFLQMKLVSAVATEISQDKYMTIQYVETLQSDDDEIIQLVVQSVYNNLLPQFGSQEIIQNCVTSGCKILSENIVDLVLREVASNQLQSYFCGELTPHQCVEVENIVEKILKDVFQTTDVPLPKPSHADKLSYNIIEEIAVKFLSKLLSIFPKVHKERTKSLETDMQKITSKVLNSVQEFISKSFLMVNAISNSEFQPQVEEEVSNSELVLEAVKIMEKVIKIIDELKSKEKSSSRKGLTLDAKLLEEVLALFLAKLIRLPSSSSKDEKNLSKTELNKIASQLSKLVTAEISRSSISLIASDPEEHCLNPENTERIYQVVDSVYSNILQQSGTNKEFYYDIKDTNTAFPKKVASLIIDGVSSFPLDTINSTISNADLSGELDVNRIVQKAQEHAFNVIPELEQEKLDQNLSEEESPIKIVPHVGKKPVKIDPKIISEHLAVISIKTQPLEKLKQECLKRTGHSIAELRRASISGRNYSLGSPDLEKRKTESSQEQKPEHGNSVKFITIFERSKDVLGSANPSKEVISETPKPDVSKQGSKMLTKMSSALSKVFSQCNTNISRSSSPAHQDEH

SEQ ID NO: 918958 - protein, 168 aa, Homo sapiens
DISTFSLSLKIVMILLPAFTQMAFLSASHLEERVPWSRGWAFPLVALSRGERQWLVTSSLWACGPYSLFSPSPAPTQVNVLVQVGAKARPLRRESLCSASSPPGPETPGAGVAGVPPPGRDSWDPRSRAGAATWRRGGDRAGRALGAGCPRSRAVSLSRSPGSLLAGE

SEQ ID NO: 918959 - protein, 581 aa, Homo sapiens
MVISAKETKLMKMEQKAMRTRWMDAPLPETSRFRTQLRPRGAPDPPRSVLRRTLLRLHCISKVCAEENAAPPSQRPPSAGAGAERRTRTRILTLTPKALQLQVHARSPKRGRRFALPPAGDWAPPSRGSGAGCHQGARPRCPGAWRRVCSCQCTCSCSHRCLCQEPDAQPDPALQRGCGSTACDSSPTPHSARSRGQRSRPSLAAAEPSEDRGHKLSRAGSRTLVARPRAQTWRQLAPDPLHGSPGSSLPTRRCSLGSLVRALVGARDDPMGQLAMPSPQAAPTVAPWARGLAPPVDIRPQEDGSHQVDIWPQIDTKVPDVQQAPTEPQTHVDIRPQVDNQAPGTHQALSGHPGPRLISSSQVITKPQVSGEHQVQVSKQALGGHNCVQMPLAIWQKPPAQVPQDRSHQVDIRPQMELPGQASPVIPPGPHLHIVLVQLEPLELIETQAHAEVTCSAEIQRFPVPAVEPVPAPGADSPPGTALELEEAPEPSCRCPGTAQDQPSEELPDFMAPPVEPPASALELKVWLELEVAERGGQHSSSQQLPHCSQSWAHRAAALLLKGLLLLLLGLFACLQEADRG

SEQ ID NO: 918960 - protein, 2332 aa, Homo sapiens
NIVINRLSPMANVIDDGWCQNGSTAVGSQCPFLPSEQGNNEETISSVDELKIPKDCDRYDDLCSYMSWKTRKDTQWPENNLADKDQVSVATSFDITDENIATKRSDHFDAARSYGQYWTQEDSSKQAETYLTKLKSSASLSEKSYNQAVGLGKTQSALFQCDIGNEPFLPFGKIKSVPSLDLAEKVGSSDVIYHVKVLTSESLVLQDLKQPTFEEVADYSNFNLEGLQGKVESDVITLDGLNENAVVCSERVAELQRKPTRESEYHSSDLRMLRMSPDTVPKAPKHLKAGDTSKGGIAKVTQSNLKSGITTTPVDSDIGSHLSLSLEDLSQLAVSSLETTTGQHTDTLNQKTLADTHLTEETLKVTAIPEPADQKTATPTVLSSSHSHRGKPSIFYQQGLPDSHLTEEALKVSAAPGLADQTTGMSTLTSTSYSHREKPGTFYQQELPESNLTEEPLEVSAAPGPVEQKTGIPTVSSTSHSHVEDLLFFYRQTLPDGHLTDQALKVSAVSGPADQKTGTATVLSTPHSHREKPGIFYQQEFADSHQTEETLTKVSATPGPADQKTEIPAVQSSSYSQREKPSILYPQDLADSHLPEEGLKVSAVAGPADQKTGLPTVPSSAYSHREKLLVFYQQALLDSHLPEEALKVSAVSGPADGKTGTPAVTSTSSASSSLGEKPSAFYQQTLPNSHLTEEALKVSIVPGPGDQKTGIPSAPSSFYSHREKPIIFSQQTLPDFLFPEEALKVSAVSVLAAQKTGTPTVSSNSHSHSEKSSVFYQQELPDSDLPRESLKMSAIPGLTDQKTVPTPTVPSGSFSHREKPSIFYQQEWPDSYATEKALKVSTGPGPADQKTEIPAVQSSSYPQREKPSVLYPQVLSDSHLPEESLKVSAFPGPADQMTDTPAVPSTFYSQREKPGIFYQQTLPESHLPKEALKISVAPGLADQKTGTPTVTSTSYSQHREKPSIFHQQALPGTHIPEEAQKVSAVTGPGNQKTWIPRVLSTFYSQREKPGIFYQQTLPGSHIPEEAQKVSPVLGPADQKTGTPTPTSASYSHTEKPGIFYQQVLPDNHPTEEALKISVASEPVDQTTGTPAVTSTSYSQYREKPSIFYQQSLPSSHLTEEAKNVSAVPGPADQKTVIPILPSTFYSHTEKPGVFYQQVLPHSHPTEEALKISVASEPVDQTTGTPTVTSTSYSQHTEKPSIFYQQSLPGSHLTEEAKNVSAVPGPGDRKTGIPTLPSTFYSHTEKPGSFYQQVLPHSHLPEEALEVSVAPGPVDQTIGTPTVTSPSSSFGEKPIVIYKQAFPEGHLPEESLKVSVAPGPVGQTTGAPTITSPSYSQHRAKSGSFYQLALLGSQIPEEALRVSSAPGPADQTTGIPTITSTSYSFGEKPIVNYKQAFPDGHLPEEALKVSIVSGPTEKKTDIPAGPLGSSALGEKPITFYRQALLDSPLNKEVVKVSAAPGPADQKTETLPVHSTSYSNRGKPVIFYQQTLSDSHLPEEALKVPPVPGPDAQKTETPSVSSSLYSYREKPIVFYQQALPDSELTQEALKVSAVPQPADQKTGLSTVTSSFYSHTEKPNISYQQELPDSHLTEEALKVSNVPGPADQKTGVSTVTSTSYSHREKPIVSYQRELPHFTEAGLKILRVPGPADQKTGINILPSNSYPQREHSVISYEQELPDLTEVTLKAIGVPGPADQKTGIQIASSSSYSNREKASIFHQQELPDVTEEALNVFVVPGQGDRKTEIPTVPLSYYSRREKPSVISQQELPDSHLTEEALKVSPVSIPAEQKTGIPIGLSSSYSHSHKEKLKISTVHIPDDQKTEFPAATLSSYSQIEKPKISTVIGPNDQKTPSQTAFHSSYSQTVKPNILFQQQLPDRDQSKGILKISAVPELTDVNTGKPVSLSSSYFHREKSNIFSPQELPGSHVTEDVLKVSTIPGPAGQKTVLPTALPSSFSHREKPDIFYQKDLPDRHLTEDALKISSALGQADQITGLQTVPSGTYSHGENHKLVSEHVQRLIDNLNSSDSSVSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHGKKKVSGL

SEQ ID NO: 918961 - protein, 228 aa, Homo sapiens
NCPPGFQTCLGIFPDKYCFESQMMWKVKTLEHPDSGPKYQMLKTQNTQVTAYECPHTKCQETLEYPGADQCRKSWSLSGVANNEPQRPGMRKLCGADRVDCVYPACITAQEPGKADTLGFISWGNETHRANVLKNIPFYEKLEYSTALRYSGPISFLQQVRSCHSKEAQMMAASGNICLQNLSLVHPVTILHCHRLQSACLEIVDTWIYIEQAGSKGLKEMPWTCIVE

SEQ ID NO: 918962 - protein, 225 aa, Homo sapiens
MVAVIVSIFITQEYEGGRNEAGERHGRGRARLPNGDTYEGSYEFGKRHGQGIYKFKNGARYIGEYVRNKKHGQGTFIYPDGSRYEGEWANDLRHGHGVYYYINNDTYTGEWFAHQRHGQGTYLYAETGSKYVGTWVNGQQEGTAELIHLNHRYQGKFLNKNPVGPGKYVFDVGCEQHGEYRLTDMVLQVKTESVTGVATVCPVTVSLSVVQHAPLNVPLLKGTTG

SEQ ID NO: 918963 - protein, 303 aa, Homo sapiens
MVAVIVSIFITQEYEGGRNEAGERHGRGRARLPNGDTYEGSYEFGKRHGQGIYKFKNGARYIGEYVRNKKHGQGTFIYPDGSRYEGEWANDLRHGHGVYYYINNDTYTGEWFAHQRHGQGTYLYAETGSKYVGTWVNGQQEGTAELIHLNHRYQGKFLNKNPVGPGKYVFDVGCEQHGEYRLTDMERGEEEEEEELVTVVPKWKATQITELALWTPTLPKKPTSTDGPGQDAPGAESAGEPGEEAQALLEGFEGEMDMRPGDEDADVLREESREYDQEEFRYDMDEGNINSEDEETRQSDLQD

SEQ ID NO: 918964 - protein, 271 aa, Homo sapiens
MSDLGSEELEEEGENDIGGIYKFKNGARYIGEYVRNKKHGQGTFIYPDGSRYEGEWANDLRHGHGVYYYINNDTYTGEWFAHQRHGQGTYLYAETGSKYVGTWVNGQQEGTAELIHLNHRYQGKFLNKNPVGPGKYVFDVGCEQHGEYRLTDMERGEEEEEEELVTVVPKWKATQITELALWTPTLPKKPTSTDGPGQDAPGAESAGEPGEEAQALLEGFEGEMDMRPGDEDADVLREESREYDQEEFRYDMDEGNINSEDEETRQSDLQD

SEQ ID NO: 918965 - protein, 303 aa, Homo sapiens; identical to SEQ ID NO: 918963

SEQ ID NO: 918966 - protein, 181 aa, Homo sapiens
MVAVIVSIFITQEYEGGRNEAGERHGRGRARLPNGDTYEGSYEFGKRHGQGIYKFKNGARYIGEYVRNKKHGQGTFIYPDGSRYEGEWANDLRHGHGVYYYINNDTYTGEWFAHQRHGQGTYLYAETGSKYVGTWVNGQQEGTAELIHLNHRYQGKFLNKNPVGPGKYVFDVGTVDVRSSR

SEQ ID NO: 918967 - protein, 303 aa, Homo sapiens; identical to SEQ ID NO: 918963

SEQ ID NO: 918968 - protein, 74 aa, Homo sapiens
DSAKCIVLSSSALKATGCPYRPGPTRVYTREFQATSKKGISRLDKQMRKFTDIRKKSRSAHAVKISIEGNKMPL

SEQ ID NO: 918969 - protein, 112 aa, Homo sapiens
DPPGCRQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 918970 - protein, 612 aa, Homo sapiens
MSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 918971 - protein, 476 aa, Homo sapiens [sequence omitted]

SEQ ID NO: 918972 - protein, 594 aa, Homo sapiens
MNRLYVTQRDYELIGPLLCSVSVEIIGQEKNTVLPRDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 918973 - protein, 801 aa, Homo sapiens
MDSEYYSGDQSDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLGARARVPMPSNKDYVVRPKWNVEMESSRFQATSKKGISRLDKQMRKFTDIRKKSRSAHAVKISIEGNKMPL

SEQ ID NO: 918974 - protein, 819 aa, Homo sapiens
MDSEYYSGDQSDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 918975 - protein, 781 aa, Homo sapiens
MDSEYYSGDQSDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRLLKFV

SEQ ID NO: 918976 - protein, 787 aa, Homo sapiens [sequence omitted]

SEQ ID NO: 918977 - protein, 201 aa, Homo sapiens
MDSEYYSGDQSDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESETPQTLASRRGSSD

SEQ ID NO: 918978 - protein, 819 aa, Homo sapiens; identical to SEQ ID NO: 918974

SEQ ID NO: 918979 - protein, 263 aa, Homo sapiens
MNCKLLKENGNFQRETTSPLSSLPTSSSGAYNWALPAYSDWLTKGQISAVVTKGSFSTCLHLLGSLCLNLYWPSSDPKARMFPSLSKTKMNNGNLEGLFGFINRLRIKGKGLWPCHRQTRGSSARVLSESHGDGWFFTVCRSRNTNEMRGFLNHRCFPGTQGSGKVQLHLPPVFHQGNPSGSKDVYFLLLAKWLLNKEIKSLFRMKERKTPGEEALWIAPVSNASQLAGVILQVPVSNARFLAYCGREPGASGPDGKDSGLAE

SEQ ID NO: 918980 - protein, 824 aa, Homo sapiens
MITLLPRGSDQDPPEEDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 918981 - protein, 793 aa, Homo sapiens
MMVVLPQYRMNGIQDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 918982 - protein, 297 aa, Homo sapiens
MDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 918983 - protein, 819 aa, Homo sapiens; identical to SEQ ID NO: 918974

SEQ ID NO: 918984 - protein, 108 aa, Homo sapiens
MPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 918985 - protein, 511 aa, Homo sapiens
MDSEYYSGDQSDDGGATPVQDERDSGSDGEDDVNEQHSGSDTGSVERHSENETSDREDGLPKGHHVTDSENDEPLNLNASDSESEELHRQKDSDSESEERAEPPASDSENEDVNQHGSDSESEETRKLPGSDSENEELLNGHASDSENEDVGKHPASDSEIEELQKSPASDSETEDALKPQISDSESEEPPRHQASDSENEEPPKPRMSDSESEELPKPQVSDSESEEPPRHQASDSENEELPKPRISDSESEDPPRHQASDSENEELPKPRISDSESEDPPRNQASDSENEELPKPRVSDSESEGPQKGPASDSETEDASRHKQKPESDDDSDRENKGEDTEMQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTVSIRWKYFLLDCAFFWCFYGSD

SEQ ID NO: 918986 - protein, 161 aa, Homo sapiens
FVTTRPAFQELLKEALNMERKKLVPATAKTYQNVKSIDTVKKLHQLIGKITSYSAAEMEKAGADLSFSDAWLGRGGNKIKYPMNERLLLTVFVKDTVASRHNSQILCLWILTKTGLSTYLHEAAISERDIGTPFWGWPSQLTTYFSEYSQRYQIFIIGDQS

SEQ ID NO: 918987 - protein, 164 aa, Homo sapiens
MPPGRWHAAYPAQAQSSRERGRLQTVKKEEEDESYTPVQAARPQTLNRPGQELFRQLFRQLRYHESSGPLETLSRLRELCRWWLRPDVLSKAQILELLVLEQFLSILPGELRVWVQLHNPESGEEAVALLEELQRDLDGTSWRTSFHNLNICGHIVVPFRASVR

SEQ ID NO: 918988 - protein, 164 aa, Homo sapiens
FYFHSMLSDAYCYFPSYLTSNSCILLPPDHLIGAHVLPHSTSNQRESSPTERLDVAGVQCCADGSDKCHGHMRYDKRSLKKVENQLSYEIFQRSQKTPAALLSPWKQDEHLHFLEWDKNLCSYLCPMHLHVAGQRTLLLPAHLSSDMRGNRHNLEAAKKQLFLK

SEQ ID NO: 918989 - protein, 164 aa, Homo sapiens; identical to SEQ ID NO: 918988

SEQ ID NO: 918990 - protein, 139 aa, Homo sapiens
MSTVKEAAHRLSKSEMSLYAVLDLKKGASPEDFKKSYSHSALLPHPPFEYHLGRKLALRYHPDKNPGNAQAAEIFKEINAAHAILSDSKKRKIYDQHGSLGIYLYDHFGEEGVRYYFILNSCWFKVHNSPGPLRIRKEG

SEQ ID NO: 918991 - protein, 189 aa, Homo sapiens
MSTVKEAAHRLSKSEMSLYAVLDLKKGASPEDFKKSYSHSALLPHPPFEYHLGRKLALRYHPDKNPGNAQAAEIFKEINAAHAILSDSKKRKIYDQHGSLGIYLYDHFGEEGVRYYFILNSCWFKTLVILCTLLTCCCFCCCCCFCCGALKPPPEQDSGRKYQQNVQSQPPRSGAKCDFRSEENSEDDF

SEQ ID NO: 918992 - protein, 169 aa, Homo sapiens
GVCIVNCKGKQDCGCRAQGGLRATFTLCSVMWELALHTTPLPCLLLCEGSARRNSSLVVFTPRGTSVPIHWTGCADCPQVGTAGPGSSTALPSGQPRTRHLASIRRMYSINHRRIFQSLLRDGDLTVHLLSSAPECRTPSSVMSTPAYNSTIDWALGSSGFSGSVLSQQ

SEQ ID NO: 918993 - protein, 232 aa, Homo sapiens
GITLQFSPFLPFCKVSCFYLMVSLACRHNEGWWKGMKQFLPAKAVDHEETPVRYSSSEVNHLSPREVTTVLQADSAEYAQPLVGGIVGTLHQRSTFKPEEGKEAGYADLDPYNSPGQEVYHAYAEPLPITGPEYATPIIMDMSGHPTTSVGQPSTSTFKATGNQPPPLVGTYNTLLSRTDSCSSAQAQYDTPKAGKPGLPAPDELVYQVPQSTQEVSGAGRDGECDVFKEIL

SEQ ID NO: 918994 - protein, 232 aa, Homo sapiens; identical to SEQ ID NO: 918993

SEQ ID NO: 918995 - protein, 232 aa, Homo sapiens; identical to SEQ ID NO: 918993

SEQ ID NO: 918996 - protein, 232 aa, Homo sapiens; identical to SEQ ID NO: 918993

SEQ ID NO: 918997 - protein, 232 aa, Homo sapiens; identical to SEQ ID NO: 918993

SEQ ID NO: 918998 - protein, 232 aa, Homo sapiens; identical to SEQ ID NO: 918993

SEQ ID NO: 918999 - protein, 232 aa, Homo sapiens; identical to SEQ ID NO: 918993

SEQ ID NO: 919000 - protein, 232 aa, Homo sapiens; identical to SEQ ID NO: 918993

SEQ ID NO: 919001 - protein, 1274 aa, Homo sapiens
MLITWCYTTEMLRINGATYKSLNLKLREEEEDWECFGDCDTGHRFDTCKRERNEMEEEWIRKVHQILRWPDQGVDLGHISLIELLHSQFDLVLVGLDILNEHNCVVSFALHGRISGQGELDDGIVVILVSPGALLRYLGCFGASVSWATRRLKELKQREFARNVASKSRKDERKQEKALQRLHKLAELRKETVCAPGSGPMFKSTTVTVRENCNEISQRVVVDSVNNQQDFKYTLIHSEENTKDATTVAEDPESANNYTAKNNQVGDQAQGIHRHKIGFSFAFPKKASVKLESSAAAFSEYSDDASVGKGFSRKSRFVPSACHLQQSSPTDVLLSSEEKTNSFHPPEAMCRDKETVQTQEIKEVSSEKDALLLPSFCKFQLQLSSDADNCQNSVPLADQIPLESVVINEDIPVSGNSFELLGNKSTVLDMSNDCISVQATTEENVKHNEASTTEVENKNGPETLAPSNTEEVNITIHKKTNFCKRQCEPFVPVLNKHRSTVLQWPSEMLVYTTTKPSISYSCNPLCFDFKSTKVNNNLDKNKPDLKDLCSQQKQEDICMGPLSDYKDVSTEGLTDYEIGSSKNKCSQVTPLLADDILSSSCDSGKNENTGQRYKNISCKIRETEKYNFTKSQIKQDTLDEKYNKIRLKETHEYWFHKSRRKKKRKKLCQHHHMEKTKESETRCKMEAENSYTENAGKYLLEPISEKQYLAAEQLLDSHQLLDKRPKSESISLSDNEEMCKTWNTEYNTYDTISSKNHCKKNTILLNGQSNATMIHSGKHNLTYSRTYCCWKTKMSSCSQDHRSLVLQNDMKHMSQNQAVKRGYNSVMNESERFYRKRRQHSHSYSSDESLNRQNHLPEEFLRPPSTSVAPCKPKKKRRRKRGRFHPGFETLELKENTDYPVKDNSSLNPLDRLISEDKKEKMKPQEVAKIERNSEQTNQLRNKLSFHPNNLLPSETNGETEHLEMETTSGELSDVSNDPTTSVCVASAPTKEAIDNTLLEHKERSENINLNEKQIPFQVPNIERNFRQSQPKSYLCHYELAEALPQGKMNETPTEWLRYNSGILNTQPPLPFKEAHVSGHTFVTAEQILAPLALPEQALLIPLENHDKFKNVPCEVYQHILQPNMLANKVKFTFPPAALPPPSTPLQPLPLQQSLCSTSVTTIHHTVLQQHAAAAAAAAAAAAAGTFKVLQPHQQFLSQIPALTRTSLPQLSVGPVGPRLCPGNQPTFVAPPQMPIIPASNQGNQANRLKNNNEQSNQTVHIPLENKTRPYAPS

SEQ ID NO: 919002 - protein, 266 aa, Homo sapiens
MDEAGSSASGGGFRPGVDSLDEPPNSRIFLVISKYTPESVLRERFSPFGDIQDIWVVRDKHTKESKGIAFVKFARSSQACRAMEEMHGQCLGPNDTKPIKVFIAQSRSSGSHRDVEDEELTRIFVMIPKSYTEEDLREKFKVYGDIEYCSIIKNKVTGESKGLGYVRYLKPSQAAQAIENCDRSFRAILAEPKNKASESSEQDYYSNMRQEALGHEPRVNMFPFEQQSEFQVLTRMIAEARKQSPNACQLYQEFLSLKNSFSAFLI

SEQ ID NO: 919003 - protein, 266 aa, Homo sapiens; identical to SEQ ID NO: 919002

SEQ ID NO: 919004 - protein, 266 aa, Homo sapiens; identical to SEQ ID NO: 919002

SEQ ID NO: 919005 - protein, 266 aa, Homo sapiens; identical to SEQ ID NO: 919002

SEQ ID NO: 919006 - protein, 238 aa, Homo sapiens
MDEAGSSASGGGFRPGVDSLDEPPNSRIFLVISKYTPESVLRERFSPFGDIQDIWVVRDKHTKESKGIAFVKFARSSQACRAMEEMHGQCLGPNDTKPIKVRVPGSGCPRGKEWASWTSLHLLLCRGEGGVEHPFPAADQTAPGLGTGAALRRGSPPTKLRRVAGKGTGCGVFAPRERTRQPRPPGDRTAVAGLPLSLALTNPPALEFTAKLVLAYFEYFSDLPLSDAQISIYKKRKN

SEQ ID NO: 919007 - protein, 266 aa, Homo sapiens; identical to SEQ ID NO: 919002

SEQ ID NO: 919008 - protein, 266 aa, Homo sapiens; identical to SEQ ID NO: 919002

SEQ ID NO: 919009 - protein, 127 aa, Homo sapiens
MIWQNSLRDIIIIVTIRLFHRNQKMLPKSVVLEYIYLTGSDLSAYVSSSSGSSLAPSSLNLRLSGISSNHGALSPASFQVQAWPTKKAMTHHLLVPRRFPPRIWKKGKMVLRTLVQRHEGVRATSAT

SEQ ID NO: 919010 - protein, 150 aa, Homo sapiens
MKRLNWIIFRFPLSQNGPYDSSKNVLRQEARFFTTLSSFGDFPMNYPLPKNDTPIPTIHFSGASWQQTESSLAGREPWQTPTFRLPKGKDKLKAEQEEYSVTERGKRVFKEWAFSQTRRSGVTDRKMIMRFSDELVTGAFSHRSLSGIKS

SEQ ID NO: 919011 - protein, 158 aa, Homo sapiens
TVIQIMPLREREQKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGDQYWESGEGQSWRNYIRKHLALLPLENVDEYQIFQTLEV

SEQ ID NO: 919012 - protein, 151 aa, Homo sapiens
MCCVLGWPGAQGQAAFVASTCLLYSSPGLSSWLQAAQPLTTRGGSGPCPQIVAHLSRPFVCLEDIPTAHKQLAFAQRRVSMEEGMAIKNSWFSKRLPRFEKRWLMMTTATALSTENSTGLGSAHRTASISGCPDSRRFKTRVTAAIFLESL

SEQ ID NO: 919013 - protein, 151 aa, Homo sapiens; identical to SEQ ID NO: 919012

SEQ ID NO: 919014 - protein, 1415 aa, Homo sapiens
MGEKRVHPQKTKENVCFVNLDVNKDECSTEHLQQKLVNVSPDLPKLISSMNVQQPKENEIVVLSGLASGNLQADFEVSQCPWLPDICLVQCARGNRPNSTNCIIFEINKFLIGLELVQERQLHLETNILKLEDDTNCSLSSIEEDFLTASEHLEEESEVDESRNDYENINVSANVLESKQLKGATQVEWNCNKEKWLYALEDKYINKYPTPLIKTERSPENLTKNTALQSLDPSAKPSQWKREAVGNGRQATHYYHSEAFKGQMEKSQALYIPKDAYFSMMDKDVPSACAVAEQRSNLNPGDHEDTRNALPPRQDGEVTTGKYATNLAESVLQDAFIRLSQSQSTLPQESAVSVSVGSSLLPSCYSTKDTVVSRSWNELPKIVVVQSPDGSDAAPQPGISSWPEMEVSVETSSILSGENSSRQPQSALEVALACAATVIGTISSPQATERLKMEQVVSNFPPGSSGALQTQAPQGLKEPSINEYSFPSALCGMTQVASAVAVCGLGEREEVTCSVAPSGSLPPAAEASEAMPPLCGLASMELGKEAIAKGLLKEAALVLTRPNTYSSIGDFLDSMNRRIMETASKSQTLCSENVVRNELAHTLSNVILRHSIDEVHHKNMIIDPNDNRHSSEILDTLMESTNQLLLDVICFTFKKMSHIVRLGECPAVLSKETIRRRETEPSCQPSDPGASQAWTKATESSSSSPLSNSHNTSLVINNLVDGMYSKQDKGGVRPGLFKNPTLQSQLSRSHRVPDSSTATTSSKEIYLKGIAGEDTKSPHHSENECRASSEGQRSPTVSQSRSGSQEAEESIHPNTQEKYNCATSRINEVQVNLSLLGDDLLLPAQSTLQTKHPDIYCITDFAEELADTVVSMATEIAAICLDNSSGKQPWFCAWKRGSEFLMTPNVPCRSLKRKKESQGSGTAVRKHKPPRLSEIKRKTDEHPELKEKLMNRVVDESMNLEDVPDSVNLFANEVAAKIMNLTEFSMVDGMWQAQGYPRNRLLSGDRWSRLKASSCESIPEEDSEARAYVNSLGLMSTLSQPVSRASSVSKQSSCESITDEFSRFMVNQMENEGRGFELLLDYYAGKNASSILNSAMQQACRKSDHLSVRPSCPSKQSSTESITEEFYRYMLRDIERDSRESASSRRSSQDWTAGLLSPSLRSPVCHRQSSMPDSRSPCSRLTVNVPIKANSLDGFAQNCPQDFLSVQPVSSASSSGLCKSDSCLYRRGGTDHITNMLIHETWASSIEALMRKNKIIVDDAEEADTEPVSGGSPSQAEKCANRLAASRMCSGPTLLVQESLDCPRKDSVTECKQPPVSSLSKTASLTNHSPLDSKKETSSCQDPVPINHKRRSLCSREVPLIQIETDQREACAGEPEPFLSKSSLLEEAEGHSNDKNIPDVVRGGDTAVSACQIHR

SEQ ID NO: 919015 - protein, 1577 aa, Homo sapiens
MGEKRVHPQKTKENVCFVNLDVNKDECSTEHLQQKLVNVSPDLPKLISSMNVQQPKENEIVVLSGLASGNLQADFEVSQCPWLPDICLVQCARGNRPNSTNCIIFEINKFLIGLELVQERQLHLETNILKLEDDTNCSLSSIEEDFLTASEHLEEESEVDESRNDYENINVSANVLESKQLKGATQVEWNCNKEKWLYALEDKYINKYPTPLIKTERSPENLTKNTALQSLDPSAKPSQWKREAVGNGRQATHYYHSEAFKGQMEKSQALYIPKDAYFSMMDKDVPSACAVAEQRSNLNPGDHEDTRNALPPRQDGEVTTGKYATNLAESVLQDAFIRLSQSQSTLPQESAVSVSVGSSLLPSCYSTKDTVVSRSWNELPKIVVVQSPDGSDAAPQPGISSWPEMEVSVETSSILSGENSSRQPQSALEVALACAATVIGTISSPQATERLKMEQVVSNFPPGSSGALQTQAPQGLKEPSINEYSFPSALCGMTQVASAVAVCGLGEREEVTCSVAPSGSLPPAAEASEAMPPLCGLASMELGKEAIAKGLLKEAALVLTRPNTYSSIGDFLDSMNRRIMETASKSQTLCSENVVRNELAHTLSNVILRHSIDEVHHKNMIIDPNDNRHSSEILDTLMESTNQLLLDVICFTFKKMSHIVRLGECPAVLSKETIRRRETEPSCQPSDPGASQAWTKATESSSSSPLSNSHNTSLVINNLVDGMYSKQDKGGVRPGLFKNPTLQSQLSRSHRVPDSSTATTSSKEIYLKGIAGEDTKSPHHSENECRASSEGQRSPTVSQSRSGSQEAEESIHPNTQEKYNCATSRINEVQVNLSLLGDDLLLPAQSTLQTKHPDIYCITDFAEELADTVVSMATEIAAICLDNSSGKQPWFCAWKRGSEFLMTPNVPCRSLKRKKESQGSGTAVRKHKPPRLSEIKRKTDEHPELKEKLMNRVVDESMNLEDVPDSVNLFANEVAAKIMNLTEFSMVDGMWQAQGYPRNRLLSGDRWSRLKASSCESIPEEDSEARAYVNSLGLMSTLSQPVSRASSVSKQSSCESITDEFSRFMVNQMENEGRGFELLLDYYAGKNASSILNSAMQQACRKSDHLSVRPSCPSKQSSTESITEEFYRYMLRDIERDSRESASSRRSSQDWTAGLLSPSLRSPVCHRQSSMPDSRSPCSRLTVNVPIKANSLDGFAQNCPQDFLSVQPVSSASSSGLCKSDSCLYRRGGTDHITNMLIHETWASSIEALMRKNKIIVDDAEEADTEPVSGGSPSQAEKCANRLAASRMCSGPTLLVQESLDCPRKDSVTECKQPPVSSLSKTASLTNHSPLDSKKETSSCQDPVPINHKRRSLCSREVPLIQIETDQREACAGEPEPFLSKSSLLEEAEGHSNDKNIPDVVRGGDTAVSACQIHSDSLDTRDVPEAEASTEARAPDEAPNPPSSSEESTGSWTQLANEEDNPDDTSSFLQLSERSMSELVEEKKILKGQSESTEAPASGPPTGTASPQRSLLVINFDLEPECPDAELRATLQWIAASELGIPTIYFKKSQENRIEKVSCTRFGKQESFVFSSPLETQ

SEQ ID NO: 919016 - protein, 1603 aa, Homo sapiens
MGEKRVHPQKTKENVCFVNLDVNKDECSTEHLQQKLVNVSPDLPKLISSMNVQQPKENEIVVLSGLASGNLQADFEVSQCPWLPDICLVQCARGNRPNSTNCIIFEINKFLIGLELVQERQLHLETNILKLEDDTNCSLSSIEEDFLTASEHLEEESEVDESRNDYENINVSANVLESKQLKGATQVEWNCNKEKWLYALEDKYINKYPTPLIKTERSPENLTKNTALQSLDPSAKPSQWKREAVGNGRQATHYYHSEAFKGQMEKSQALYIPKDAYFSMMDKDVPSACAVAEQRSNLNPGDHEDTRNALPPRQDGEVTTGKYATNLAESVLQDAFIRLSQSQSTLPQESAVSVSVGSSLLPSCYSTKDTVVSRSWNELPKIVVVQSPDGSDAAPQPGISSWPEMEVSVETSSILSGENSSRQPQSALEVALACAATVIGTISSPQATERLKMEQVVSNFPPGSSGALQTQAPQGLKEPSINEYSFPSALCGMTQVASAVAVCGLGEREEVTCSVAPSGSLPPAAEASEAMPPLCGLASMELGKEAIAKGLLKEAALVLTRPNTYSSIGDFLDSMNRRIMETASKSQTLCSENVVRNELAHTLSNVILRHSIDEVHHKNMIIDPNDNRHSSEILDTLMESTNQLLLDVICFTFKKMSHIVRLGECPAVLSKETIRRRETEPSCQPSDPGASQAWTKATESSSSSPLSNSHNTSLVINNLVDGMYSKQDKGGVRPGLFKNPTLQSQLSRSHRVPDSSTATTSSKEIYLKGIAGEDTKSPHHSENECRASSEGQRSPTVSQSRSGSQEAEESIHPNTQEKYNCATSRINEVQVNLSLLGDDLLLPAQSTLQTKHPDIYCITDFAEELADTVVSMATEIAAICLDNSSGKQPWFCAWKRGSEFLMTPNVPCRSLKRKKESQGSGTAVRKHKPPRLSEIKRKTDEHPELKEKLMNRVVDESMNLEDVPDSVNLFANEVAAKIMNLTEFSMVDGMWQAQGYPRNRLLSGDRWSRLKASSCESIPEEDSEARAYVNSLGLMSTLSQPVSRASSVSKQSSCESITDEFSRFMVNQMENEGRGFELLLDYYAGKNASSILNSAMQQACRKSDHLSVRPSCPSKQSSTESITEEFYRYMLRDIERDSRESASSRRSSQDWTAGLLSPSLRSPVCHRQSSMPDSRSPCSRLTVNVPIKANSLDGFAQNCPQDFLSVQPVSSASSSGLCKSDSCLYRRGGTDHITNMLIHETWASSIEALMRKNKIIVDDAEEADTEPVSGGSPSQAEKCANRLAASRMCSGPTLLVQESLDCPRKDSVTECKQPPVSSLSKTASLTNHSPLDSKKETSSCQDPVPINHKRRSLCSREVPLIQIETDQREACAGEPEPFLSKSSLLEEAEGHSNDKNIPDVVRGGDTAVSACQIHSDSLDTRDVPEAEASTEARAPDEAPNPPSSSEESTGSWTQLANEEDNPDDTSSFLQLSERSMSELVEEKKILKGQSESTEAPASGPPTGTASPQRSLLVINFDLEPECPDAELRATLQWIAASELGIPTIYFKKSQENRIEKFLDVVQLVHRKSWKVGDIFHAVVQYCKMHEEQKDGRLSLFDWLLELG

SEQ ID NO: 919017 - protein, 136 aa, Homo sapiens
MSSRFHSVATDDLISVPVSGCRVSGRDWILQFLDLILWGWTGRLIPYLGYCDWFRSQRGKADVSSFSEEPPASVVCVPIYLLTVVDKRALLFGNSQQHFVVSLLLRYMKVFVILIPPRETQYLSLVLIFIFVMISD

SEQ ID NO: 919018 - protein, 204 aa, Homo sapiens
MPFDATPSMATLEERLVPESNSLVQTVVIRGNVPPASAGPALPQCVATCSSGLIQMSVLRGRHCAILFGPYVLPWTGSFLPDMDIMVTCSPDDYPKGTGVDIEDKAVNLTASCTQVLRVKEGDAGPPRLGFGLCGGGAGVVVKLQLGEQTETAIGQSQGNALRQFCNNPVENCVYETSCICLIECMFLYYFTQPNICWCHPEGC

SEQ ID NO: 919019 - protein, 127 aa, Homo sapiens
VKTSFSEMVDRAKLRRNGLYFQVTHSFGNSYTEDDHKDNFLYSKMFFLRTFHTNPLMWKPQEPLKAQLQPHLPCGLLQADPYQALCALETASEVKWGGIGATATLYACCTSQTAGQYSMRGTNIHPG

SEQ ID NO: 919020 - protein, 151 aa, Homo sapiens
MPAFPGDEGCLLRFTSCRVLYRANDNEDPPEDPQNFASPPHSSQESFGMDRTSGAVSVDSVPSYSAHTRPVWKPTTNYTSNWISRLIMCLLPNPRQMEIWHCKCDLLSASESANTLSSFQVFSIFPVPERLDLKSITELLSLNSYGPVYHS

SEQ ID NO: 919021 - protein, 262 aa, Homo sapiens
MSSLQRRSITMVSSNSSFISSNWLRDDIITSSKMGSASSSIRPRLVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 919022 - protein, 275 aa, Homo sapiens
DVDALNLRDFFNYLPLSSQDPAPVRKCHDPSDLLVPELNTIVPLESTKAYNMVYIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 919023 - protein, 281 aa, Homo sapiens
MSHYTWPPYFCSLLSFEEQEFLILVKPNLPIFNFIIVWPRLVVKTSHHWGMLLRHAQAAVNVAHHDALLATSIWRVDYQKGIVWASSALQAAGSLIFPAKTCGLQEPQLYFTEPQQLLDVFRELEEQNLSLIQNSQETEKTLEELSHTLKHTQIRITGSQVGETAHTRPWPWPGPGCLKSSERSSVCGPDPGERVVELGVGRAQAPVPTLKQPMARARPLQGPSALGAFCCCQAPGRPLEWLEVHSDPDPPVHSSTNMLHTGTESSHLLRRAWKLLLLHIS

SEQ ID NO: 919024 - protein, 148 aa, Homo sapiens
MAENLFIHVFLTPLPPSISPNYGVQATISTGPDHCPSILNELSAPICVFQQFTLYLIAGVTLLKHKRVCVTSLLKPSSGSSFFSEKIPIPYGDHKVPPLSLQHENRDISLLCPWNCLQSLQQCSAYERCLLEDFPFQQASFICNWQFL

SEQ ID NO: 919025 - protein, 196 aa, Homo sapiens
TQLSDQHLLEMEYCCGSRKGIFLSLGTYSVMPKLEAFIHISTAFSNGNLKHIDEVVYPCPVEPKKKSSIPLSNWSNKGIKVANKERRKVSVRWCPTKRTLGSHTAHTGFTAGPLGSNTGDGLCVQQLVSPPGTDSLATKLSSASWTVRILSDWISNCNVKNGCKVADSFALCWWYIVGKATNAWLQDPLKLEQALL

SEQ ID NO: 919026 - protein, 245 aa, Homo sapiens
FMEEMIFEVGTRSMFNMHNYYDKAWEKLLFGVCFFHALVQERKKFGPLGWNIPYGFNESDLRISIRQLQLFINEYDTIPFEAISYLTGECNYGGRVTDDWDRRLLLTMLADFYNLYIVENPHYKFSPSGNYFAPPKGTYEDYIEFIKKLPFTQHPEIFGLHENVDISKDLQQTKTLFESLLLTQGGSKQTGASGSTDQILLEITKDILNKLPSDFDIEMALRKYPVRYEESMNTVLVQEMERFNK

SEQ ID NO: 919027 - protein, 154 aa, Homo sapiens
MRHGGLHHPQLVTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILGKYKEQGRTEPQPGARRWSSFPALAPLTYDNYTTET

SEQ ID NO: 919028 - protein, 1345 aa, Homo sapiens
MKFLHIKTSSYPNLKVVAYHYCQADNTYTCLVPEFVHSIAALLCRSHQLAAYRDLLIKEPQLQSMLSLRSCVQDPVAAFKRGVLEPLTNLRNDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKAFFVCDPVPSAGICTLCGRPTFRVTLQGLSKKTGISSSHLQALWIGYSTEGLSAALASLRNLYTPNVKSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETGPQDQDCLLPTLTPSLSGDEAPDRTQSSGDPRERCGYLSVTCEETCSVLLIDYATFLKLANDDDDGCLDCLQPGVRLPGMGTTPFEGLFLCCPIFSLRALTAAAGRGKLEVCELLLGHGAAIVRLLLERGCDVNLSDKQGRTPLMVAACEGHLSTVEFLLSKDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGMHLGFVSLASVMRSKCSLLLCSFPTLLLLALPSPDSGESNPSLIVVGLPSDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 919029 - protein, 355 aa, Homo sapiens
MKFLHIKTSSYPNLKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPSDSWW

SEQ ID NO: 919030 - protein, 1500 aa, Homo sapiens
MKFLHIKTSSYPNLKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKAFFVCDPVPSAGICTLCGRPTFRVTLQGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETGPQDQDCLLPTLTPSLSGDEAPDRTQSSGDPRERCGYLSVTCEETCSVLLIDYATFLKLANDDDDGCLDCLQPGVRLPGMGTTPFEGLFLCCPIFSLRALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 919031 - protein, 1880 aa, Homo sapiens
MLKAVLKKSREGGKGGKKEAGSDFGPETSPVLHLDHSADSPVSSLPTAEDTYRVSLAKGVSMSLPSSPLLPRQSHLVQSRVNKKSPGPVRKPKYVESPRVPGDAVIMPFREVAKPTEPDEHATITSSSENDDRSGSSLEWNKDGSLRLGVQKGVLHDRRADNCSPVAEEETTGSAESTLPKAESSAGDGPVPYSQGSSSLIMPRPNSVAATSSTKLEDLSYLDGQRNAPLRTSIRLPWHNTAGGRAQEVKARFAPYKPQDILLKPLLFEVPSITTDSVFVGRDWLFHQIEENLRNTELAENRGAVVVGNVGFGKTAIISKLVALSCHGSRMRQIASNSPGSSPKTSDPTQDLHFTPLLSPSSSTSASSTAKTPLGSISAENQRPREDAVKYLASKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKAFFVCDPVPSAGICTLCGRPTFRVTLQGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETGPQDQDCLLPTLTPSLSGDEAPDRTQSSGDPRERCGYLSVTCEETCSVLLIDYATFLKLANDDDDGCLDCLQPGVRLPGMGTTPFEGLFLCCPIFSLRALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 919032 - protein, 1214 aa, Homo sapiens
MKFLHIKTSSYPNLKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKAFFVCDPVPSAGICTLCGRPTFRVTLQGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETGPQDQDCLLPTLTPSLSGDEAPDRTQSSGDPRERCGYLSVTCEETCSVLLIDYATFLKLANDDDDGCLDCLQPGVRLPGMGTTPFEGLFLCCPIFSLRALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPASLVPSSIVSCQ

SEQ ID NO: 919033 - protein, 140 aa, Homo sapiens
MRVCFAGNAAWAMATSKPDILIILLQKLMEEGNVMYKVSGSALFFAIETAWEHPLNWVHNGYSCATAQSPCNRSAKSGWVGWLTPVTPALLEAEVGRSLEARNSRPTWPIWQNPIFTKNTKISQVPVIPATREAEAGELF

SEQ ID NO: 919034 - protein, 1915 aa, Homo sapiens
RRLCCGSCWSGGRLGSRRRGSRGAPSWPRPEARPWVWGTALRSWKLSRQKQVLKMLKAVLKKSREGGKGGKKEAGSDFGPETSPVLHLDHSADSPVSSLPTAEDTYRVSLAKGVSMSLPSSPLLPRQSHLVQSRVNKKSPGPVRKPKYVESPRVPGDAVIMPFREVAKPTEPDEHEAKADNEPSCSPAAQELLTRLGFLLGEGIPSATHITIEDKNETMCTALSQGISPCSTLTSSTASPSTDSPCSTLNSCVSKTAANKSPCETISSPSSTLESKDSGIIATITSSSENDDRSGSSLEWNKDGSLRLGVQKGVLHDRRADNCSPVAEEETTGSAESTLPKAESSAGDGPVPYSQGSSSLIMPRPNSVAATSSTKLEDLSYLDGQRNAPLRTSIRLPWHNTAGGRAQEVKARFAPYKPQDILLKPLLFEVPSITTDSVFVGRDWLFHQIEENLRNTELAENRGAVVVGNVGFGKTAIISKLVALSCHGSRMRQIASNSPGSSPKTSDPTQDLHFTPLLSPSSSTSASSTAKTPLGSISAENQRPREDAVKYLASKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 919035 - protein, 1431 aa, Homo sapiens
MKFLHIKTSSYPNLKVVAYHYCQADNTYTCLVPEFVHSIAALLCRSHQLAAYRDLLIKEPQLQSMLSLRSCVQDPVAAFKRGVLEPLTNLRNDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKAFFVCDPVPSAGICTLCGRPTFRVTLQGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETGPQDQDCLLPTLTPSLSGDEAPDRTQSSGDPRERCGYLSVTCEETCSVLLIDYATFLKLANDDDDGCLDCLQPGVRLPGMGTTPFEGLFLCCPIFSLRALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 919036 - protein, 1500 aa, Homo sapiens; identical to SEQ ID NO: 919030

SEQ ID NO: 919037 - protein, 852 aa, Homo sapiens
MKFLHIKTSSYPNLKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKAFFVCDPVPSAGICTLCGRPTFRVTLQGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETGPQDQDCLLPTLTPSLSGDEAPDRTQSSGDPRERCGYLSVTCEETCSVLLIDYATFLKLANDDDDGCLDCLQPGVRLPGMGTTPFEGLFLCCPIFSLRALTAAAGRGKLEVCELLLGHGAAVSRTNRRGVPPLFCAARQGHWQIVRLLLERGCDVNLSDKQGRTPLMVAACEGHLSTVEFLLSKGSSVMPSKVSFGRTQRELQQTHSVLSDSNSKFSVNGNFLINSRENR

SEQ ID NO: 919038 - protein, 143 aa, Homo sapiens
FMNGFRVLMQGLEGVGFSCFALLPSAICFTVTRSSSGEKHFYRGDFPLVLCDAQEQTYVEAFKYFVSRGSGPGGPEAPTPITPLTTSPLQPPLRLPQNPRHVLLNLFKAATAGVRRAKQESAWAMRMREARAHSPVTVTPTVG

SEQ ID NO: 919039 - protein, 143 aa, Homo sapiens; identical to SEQ ID NO: 919038

SEQ ID NO: 919040 - protein, 182 aa, Homo sapiens [sequence omitted]

SEQ ID NO: 919041 - protein, 143 aa, Homo sapiens
LAAQLGKMSTSGSVTLGRGKLSCVWGSGGWQHRTCKHTQTKVLEVSHSKEMRVGSWVVELTPTPSLLSGPDQLGFYSKRLPSVNLCVMHILSLTAASELPCLNDTGRELMATGHLFLTGAHCVLTPSFTLECGREQEHGVGEE

SEQ ID NO: 919042 - protein, 155 aa, Homo sapiens
PDKTGFKMKVGGVNGEKNGIAGSNDFQLDVSLNSTIKQNCHSFTLQLENNTPTSHQCKYFRLISNMNVTNALLYIKESGEALGLSTGNGDTAAVGCMRFVITDLRVAVTFGATRSSFQNCPSVTENSRRVVHGPSILEGLLALLRLRITGPAQAN

SEQ ID NO: 919043 - protein, 129 aa, Homo sapiens
MFYTHSTCINKGLLDASDFLHAKEDHGSPASTRRQKKGMERMLSLSPLKGISPADALTLAFQSLELRNTIILLFQSHQFVVLCYDIVRELTQQGAHWIEDHESCTPVSTLPLTAGSAHVVMPVLPGLQV

SEQ ID NO: 919044 - protein, 134 aa, Homo sapiens
MLNIGPHSLLACRVSAERSAVSVMGFPLWSGPSAAGLLQFTGGPLQTLFAWVSAAVAAEQWILVNCKCCRLIVPLEVLSQRSTRLLGILQRRCCVLLHASYQETQEMKVYYNIGGGNYDHFVNVISIGFSTVKL

SEQ ID NO: 919045 - protein, 214 aa, Homo sapiens
RHRSWSQREEASGQPNRMMRKTEAQGTFPRPRAENAAELKFKSSLSDPPNPTLSPRPAMAHIPGGPVTILHLGSPKALFLSFTASLYLIPITKGFFSLSLFLLFVRMESTGPGEKNLRQSDVRSVDKTQESPGRGAGAKASARLAAAVMFGNDGSTLENLLGKGWAILRFRQACPGDFERPNHCWVSDPLLGRCPDANWEKLGQANQVLPEPSL

SEQ ID NO: 919046 - protein, 724 aa, Homo sapiens
MKYAICKTELVLFPPNVSPRCPEYAICKTELVLSPQNVSPGCPEYAICKTELVLFPQNVSPGCPEYAICKTELVLFPPNVSSPRCPEYAICKTELVLSPQNVSPRCPEYAICKTELILFPQNVSPGCREYAICKTELVLFPPNVSPRCPEYAICKTELVLFPPNVSSPRCPEYAICKTELILFPQNVSRGCPEYAICKTELVLFPQNVSPGCPEYAICKTELVLFPQNVSPGCPEYAICKTELVLFPPNVSPGCPEYTICKTELVLFPPNVSPGCPEYAICKTELVLFPPNVSPGCPEYAICKTELVLFPPNVSPGCPEYAICKTELVLFPPNVSPGCPEYAICKTELVLFPQNVSPGCPEYSICKTELILFPPNVSPGCPEYAICKTELVLFPPNVSPGCTEYAICKTELVLFPPNVSPGCPEYAICKTELVLFPQNVSPGCPEYAICKTELVLFPPNVSPGCPEYAICKTELVLFPPNVSPGCPEYAICKTELVLFPPNVSPGCPEYAICKTELVLFPQNVSPGCPEYSICKTELVLFPPNVSPGCPEYSICKTELVLFPQNVSPGCPEYAICKTELVLFLPNVSPGCPEYAICKTELVLFPPNVSPGCPEYAICKTELVLFPPNVSPGCPEYAIGKTELVLFPQNVSPGCPEYAICKTELVLFPPNVSPGCPEYAIGKTELVLFPPNVSPGCPEYAICKTELVLFPPNVCPLLEPGNWISS

SEQ ID NO: 919047 - protein, 164 aa, Homo sapiens
DCHHIYVHKYPMFSFHLQRLKRSKSRKRKAIKETKRRLPDETITLKNSCILLKEYKYPTNDNKSPIPLLSTLFGNNGLGTLQITLQHHQLLTFFQEIPEGKLGSWRRRGEDHAFPRQKTKPFASAINRTPSGKLELLILPVMELSICLRSREFRSSHGPPTAGI

SEQ ID NO: 919048 - protein, 127 aa, Homo sapiens
MIGLMKRKGNGVFKTSVMNQMLPLTSYVHVIQRFPPLKQNNSAYLTRHHGSLLSPWISSSMPLPFHSASTRIMAPKIHEFKSKFHRLRDEPKLPNAQAPPVYGYSSSIYESFFHFLPTLTNLMNGKW

SEQ ID NO: 919049 - protein, 169 aa, Homo sapiens
GRTLCRAAMLENSGAMAACLGLVFSLKESQEDVLIPAGLSSILTIPGVLTGSSSPVSLAAIHSVNTLAPMAAFTDEETKDHSGGDVCKVTQLRRSSCGLYPDLMPLPACFLLPSRDSAGQQVYDRSIYISQNMVSVICFLTQIKVILRTWTAQFRIKCSAKSGSGQEFT

SEQ ID NO: 919050 - protein, 709 aa, Homo sapiens
QLRAGVMAGGRRRRRRLAELTVDEFLASGFDSKSEYSPEAETREAREAARSPDEPGGSPSASRRKGRASEHKDQLSRLKDRDAEFYKFLQENDQSQLNFSDSDSSEEEEEPFHSLPYVLEEASEDEDGAEEGEDGDRVPRGLKGKKNCVPVTLAMVERWKQAAKQRLTPKLFHEVVQAFRAAVATTQGDQESAEANKFQVTDSAVFNALVVFNALVTFCIRDLTGCLQKLLIGKVAKDSSRMLQPSSSLLWGKLRVDIKAYLGSVIQLVSCVAETVVLAAVLWHISVLVPCFLTFPKQCSRECRVCRHKKDTFLGPILKQMYIMYVRNCKFTSPGALPFISSMQRTLTELLALEPGVAYQHAFLYIRQLAIHLHNAMTTRKKETSVYNWQYMHCLFLWCRVLSTVGPSEALQPLVYSLAQVIIGCIKLIPTARFYPLRMHCIRALTLLSGSSGAFIPVLPFILEMFQQVDFSRKPGRMSSKPINFSVILKLSNVNLQEKAYQDGLVEQLYDLTLEYLHSQAHCIGFPELALPVVLQLKLFLRERKVANYCRQVQQLLGKAVEAWQKLTLEEGTPLTLYYSHWRKLHDREIQLEISGKERLEDLNFPEIKRRKVADRKDEDRKQFKDLFDLNSCEEDDTEGFLERGILGPLSTRHGVEEDKEDKEEGEEDSSNLEDGDPDAEAGLAPGELQRLAQGPEDELEDLQLSEED

SEQ ID NO: 919051 - protein, 140 aa, Homo sapiens
MSPTSTGNASVGLSCFVPTYVTPKWYSLHLRWHSWNVPGLGRQPQAPSSAAPEALAVAAPGVRSEPRLLGVPAPRPPLSGGSVKPGGEGGGGGPAGGELAANMFPMVAGGGACSRPGLRSHPVRHAQPNSLPPPPPPLYY

SEQ ID NO: 919052 - protein, 268 aa, Homo sapiens
LWLAAVSIAATNHKQGCKQEGFYSPAERSSALAVPPARPPGSLLRRTLLCLRCISEVCAEENSAPPSQCSPAPPSQRHTALAPARRRGGQRRRGGQRRRGGEADSGGEAASGGAADSGGAADSGGAAERRTAAARRRGGETDSGGEADSGSAAERRPAAERRTAAERRTAAARRRDGQWRRGRQRRRGAERRWRRLWRGEAQAQAPLPSCERLQHCFMACVVVFHSIVVVYPVYGGCNVYHTPWMISEDHPILRSAALHSGGCFLSVG

SEQ ID NO: 919053 - protein, 134 aa, Homo sapiens [sequence omitted]

SEQ ID NO: 919054 - protein, 134 aa, Homo sapiens [sequence omitted]

SEQ ID NO: 919055 - protein, 400 aa, Homo sapiens
MLEYEKHGELKTKSIDLLDLGPSTDVSALVEEIQKAEPLLTASRTEQVKLLIQRLQEKLGQNSNHTFYLFKVLKAHILPLTNVALNKSGSCFITGSYDRTCKLWDTASGEELNTLEGHRNVVYAIAFNNPYGDKIATGSFDKTCKLWSVETGKCYHTFRGHTAEIVCLSFNPQSTLVATGSMDTTAKLWDIQNGEEVYTLRGHSAEIISLSFNTSGDRIITGSFDHTVVVWDADTGRKVNILIGHCAEISSASFNWDCSLILTGSMDKTCKLWDATNGKCVATLTGHDDEILDSCFDYTGKLIATASADGTARIFSAATRKCIAKLEGHEGEISKISFNPQGNHLLTGSSDKTARIWDAQTGQCLQVLEGHTDEIFSCAFNYKGNIVITGSKDNTCRIWR

SEQ ID NO: 919056 - protein, 415 aa, Homo sapiens
MKLKSLLLRYYPPGIMLEYEKHGELKTKSIDLLDLGPSTDVSALVEEIQKAEPLLTASRTEQVKLLIQRLQEKLGQNSNHTFYLFKVLKAHILPLTNVALNKSGSCFITGSYDRTCKLWDTASGEELNTLEGHRNVVYAIAFNNPYGDKIATGSFDKTCKLWSVETGKCYHTFRGHTAEIVCLSFNPQSTLVATGSMDTTAKLWDIQNGEEVYTLRGHSAEIISLSFNTSGDRIITGSFDHTVVVWDADTGRKVNILIGHCAEISSASFNWDCSLILTGSMDKTCKLWDATNGKCVATLTGHDDEILDSCFDYTGKLIATASADGTARIFSAATRKCIAKLEGHEGEISKISFNPQGNHLLTGSSDKTARIWDAQTGQCLQVLEGHTDEIFSCAFNYKGNIVITGSKDNTCRIWR

SEQ ID NO: 919057 - protein, 99 aa, Homo sapiens
CVICCQQYGTARIFSAATRKCIAKLEGHEGEISKISFNPQGNHLLTGSSDKTARIWDAQTGQCLQVLEGHTDEIFSCAFNYKGNIVITGSKDNTCRIWR

SEQ ID NO: 919058 - protein, 253 aa, Homo sapiens [sequence omitted]

SEQ ID NO: 919059 - protein, 72 aa, Homo sapiens
MTTMPESLNSPVSGKAVFMEFGPPNQQMSPSPMSHGHYSMHCLHSAGHSQPDGAYSSASSFSRPLGYPYVNS

SEQ ID NO: 919060 - protein, 253 aa, Homo sapiens [sequence omitted]

SEQ ID NO: 919061 - protein, 151 aa, Homo sapiens
MSFPPPSRAEAWTVSSSMKLQDLTSMEWAIHTARILPLLIQQQWDRLAVGTAEMCPARSPGGSQRGCEQVATAAGSSHTVLLMLRDQREKSGKRVEQGQTIMTWITIPKTCRRRPRGVGRAWFSSAYELHGLAKFLNPGISRVDINYQDSD

SEQ ID NO: 919062 - protein, 151 aa, Homo sapiens; identical to SEQ ID NO: 919061

SEQ ID NO: 919063 - protein, 131 aa, Homo sapiens
MQSLCSGDGNLQTNASLSQSSENSLTRETAFTHEFKKKKIPDPYFLPTSMLISSGTKKNATEPPSSRGSQSCVEIKNPSPVTGVLPKGPASLGIPEVQPASRPEPESRHLPVYLSLHVAGDRGARGMAGVL

SEQ ID NO: 919064 - protein, 165 aa, Homo sapiens [sequence omitted]

SEQ ID NO: 919065 - protein, 142 aa, Homo sapiens
MYDPINEGKAGSPPAVSKATHRLDKHRLFCFPLWRSPLQPIRGEQAWSETLSPSVARTVRKCKAVSRDAYSSKLRGWNYQSICACWLLLAVCTRSGNTTVNCTCKGSRLCAPYENLMPDDLRWNSFIWEPTLNPCIHEKTVF

SEQ ID NO: 919066 - protein, 332 aa, Homo sapiens
MVRELWMWNVEEEEHEVGICTWGGQHCGCPAKSLPGPHPGGVSAPQSASQLMVKLLVWQKSVHKLRKVSATSSIAVYPCPGQYFMGERKVLLPGQGWLAWSHLCGAALAEVQSGPECRKQAVSDCLPGAGVVPGRLQTRADQRAAWWPRWKVTGFAAPGDPAEPEPGHPASPAASQVGLVLVKWRPVHKAYDPVPEASPLSANFRNPGPAEAPGPMGKTKGRGSAGGAECRQCRPGSTAAELAGRSRHRAVTRASRGGCAPLQRLLPCVQPIRGDSTCTPSSLSLSRAAAARSLLPWRDSRVQEPGLSRWSRVSSAKNPARVAPQGGTGGRI

SEQ ID NO: 919067 - protein, 208 aa, Homo sapiens
MRKRRSTGWGREDIICPSNAIPVRCLSIPKPDVISLLEQGKESCMVSRDVPGGWCPGVLKVVCKWVVALSGRRQWDVPLGCERLVELGPPDLEIMGTETYYCQTLRRCHGIQGCFGSAQSLSQIIVSVTGELLSSTRPYEGLMCPQIPKPVTLSIGVFLAMFQSEVLGESAELEPDGSLMGRGLGGGHMENVSGLCIPHLQNGNNKNI

SEQ ID NO: 919068 - protein, 343 aa, Homo sapiens
MQVSFDFSCFRNGARTLDVERGGGGTRSGDLHLGWSALRMPSKVTAWSTSRRGLCASVGIAADGETFGVAEECPQTSEGIRYILHSRVSLPRAIFMGERKVLLPGQGWLAWSHLCGAALAEVQSGPECRKQAVSDCLPGAGVVPGRLQTRADQRAAWWPRWKVTGFAAPGDPAEPEPGHPASPAASQVGLVLVKWRPVHKAYDPVPEASPLSANFRNPGPAEAPGPMGKTKGRGSAGGAECRQCRPGSTAAELAGRSRHRAVTRASRGGCAPLQRLLPCVQPIRGDSTCTPSSLSLSRAAAARSLLPWRDSRVQEPGLSRWSRVSSAKNPARVAPQGGTGGRI

SEQ ID NO: 919069 - protein, 141 aa, Homo sapiens
MVRELWMWNVEEEEHEVGICTWGGQHCGCPAKSLPGPHPGGVSAPQSASQLMVKLLVWQKSVHKLRKKENAYKLRAPVVQLVVSLGRVALEPTPIEENPSEDMSSLQVLIYFLGGLPGSSEVWTPYCPAGDSPLLQNCLQK

SEQ ID NO: 919070 - protein, 136 aa, Homo sapiens
MEKRRSKNIKDIEEEERFVLPNIRTFIKLQQFKEHEKILTHRNTHKTQNCRGMHRFPETSDAQYDGLTHYTGLTRTYTSSAYRVGPAGGTPTKFTGAVLAYATGIAAISRARHCYTEADAAAGINCGKPLSPTIAP

SEQ ID NO: 919071 - protein, 170 aa, Homo sapiens
MHVAQDSFESYVGPPLTHPLGQSFGTQYTLCFCGSPMGREWVVGARIWKLPVDEEDVSATTRLTPTGCPCRPAGCHRTRAHCNQSFQKLGMLEVSRQEANSSRDPVALGCRWPLLTKFMLVAGDTGSPTCSKSPSQAVGELDCTKSDTNSRWLKDLSGNVKLSSHERTPL

SEQ ID NO: 919072 - protein, 259 aa, Homo sapiens
MMSSGLSNWKDEVAINPDGERTDCLLSGSLNPVPPERETPPSRGRQIPQTGHLQLAYGWCPSGTRLPEEGESSNLCCSAASTGDTHANRVWNGPQQTPADLQKRGPTGRKKTNKQKAIAPTSTKRMTTQKLTEGHQQQRTKVDKSMKMRKTGKKRLKISETRMPPLLQRITTPWQQGKKNWMENEFDKLTEVGFRKWVITNSSELQEHVLIQCKEAKNFDKRLEELLTRITSLEKNINDLMELKNIAQELCEAYTSINS

SEQ ID NO: 919073 - protein, 183 aa, Homo sapiens
SGRRQQDSCAINHFLKIDNMELLTLGQVLCGVLDPGRGGTQGPRQEVTDSWEWTKWTALGHKVDMGGENEIGVEVSGLDKKNKHLRNKSPLSSHAWDSHTESSHLRCQSPPRSHAWDSHTQSGHLRRRSPPHSCPQDSHTESSHLRCRSPPRSRPQDSHAKSSHLRRQSCPCSHAWHNRLRNT

SEQ ID NO: 919074 - protein, 251 aa, Homo sapiens
SARAMWGPGVTAEGLSVAPAPPPLLPLLLLLALALVAPSRGGGGCAELACGERERCCDATNATAVRCCKLPLHAFLDNVGWFVRKLSGLLILLVLFAIGYFLQRIICPSPRRYPRGQARPGQRPGPPGGAGPLGGAGPPDDDDDSPALLRDEAAAGSQDSLLDSGGGGRGRGGGGRSDPSCASEHEMRVVSPVFLQLPSYEEVKYLPTYEESMRLQQLSPGEVVLPVSVLGRPRGGVAAEPDGGEGRYPLI

SEQ ID NO: 919075 - protein, 173 aa, Homo sapiens
SSLLCTRKPSAMRIIRVSHDFGIYIPITYLYKYGPKKTKHHFIFDNAPCMIFVPNKPNVTVALVHYQCQTQFLIKPYKYIDPILISLTISSPRQEKRIHSTKYTSLRLALEFFFALIQTEEICFTIPSIVPTERSQKSDCVCQASEPKPACIHPDSLKQLKNHKRSENGRFLT

SEQ ID NO: 919076 - protein, 136 aa, Homo sapiens
MPYQPNCFAYPPHGAKPIYSPILNSSLHNPLFCIVGYFHLWIPGFAILTKPLYKLTKGNLADPIDPKSFLHSSFHSLKTALETAPTLALADSSQPFSLHTAEVQGCAVGILTQGLGSHPVGFLSKQLDLTVLGWPS

SEQ ID NO: 919077 - protein, 129 aa, Homo sapiens
MSSQGSPSVALSTTTVSSVAVQAGDSKIVIAVIKCGKWVQLQLAESQPNLLEIGSSQDETKKLLHDHELLLAKLKLENAGGDLKDGHHHYEGAVVILDAGAQYGKVIDRRVRELSCSLKFSPWKHQHLL

SEQ ID NO: 919078 - protein, 119 aa, Homo sapiens
MELRNGLPVHEVPLASSDSVAANPHLGAPQACWSTAPVGFCAWNPPQDHKPHSVSFYRSGTRSPAWLGTCLRSLGSKYWNRDSNPHLQRELRSLVLSMSAAVSRGLRPCLTFPDCLERL

SEQ ID NO: 919079 - protein, 190 aa, Homo sapiens
GPLGRGIIMDTSLRGQLPLEPCCEEARATCQNKGPEESKPLNARRDKCNSCSRFVDFVGTDPSETLLLKKTDRLSKISVDLYNRSLVLTLAKFKKGPDWGSSPPSDLETQAPFISCIINLSMNLPKASGRERTWMILHGSFWGASPGSKCSFIVLTRNQSHGYISFCKKGWEMQSSCVPRKAGEMGFMNI

SEQ ID NO: 919080 - protein, 190 aa, Homo sapiens; identical to SEQ ID NO: 919079

SEQ ID NO: 919081 - protein, 142 aa, Homo sapiens
MLAKMCIYPKERKSLCQKDTCTLMFIITLFTIAKIRNQSKCPSVDEWRKKMWFIYIVEYYLTIKKQNHCYMNILQKNMSFAATWMKLKVIMLSEISQTQKDKYCMYSYEVSCFTILSHNTQRENVAAIQRKEHLGENPQNWK

SEQ ID NO: 919082 - protein, 197 aa, Homo sapiens
AHDGGRRRPLLPGPMNKAGDAALESALGPASSLGFGDRSPGRSLRIGGQGLRGVCDSGPPAGQQRPPSMARSSASFSPPRPGMAGFGWEPARDIQVGSATAQALSQADAARGSLSTTQAAGSVGKERGPRCLGPVTWPLLSPSSAAGFRDLGKVWITLPAFWGGKPVAPLASTVALRSKGSQADRWFHLHHPTPSGR

SEQ ID NO: 919083 - protein, 177 aa, Homo sapiens [sequence omitted]

SEQ ID NO: 919084 - protein, 167 aa, Homo sapiens
MFAAPSSTSVLPLRLTIFFCCFSKSRTPNVPWPSPSQGLCSSGFLLQGILSLPDVVVYPGVIAAIYLEESLVPGELPSTARMHAANDIHIRDFQKRTKKYDLHCASKQNNNTGQTLFPIDSGMELQADLKHKVQLHPRPLSLNSQCHRMFRDHSMSIILLSKCSDEG

SEQ ID NO: 919085 - protein, 667 aa, Homo sapiens
MDCVDNEKEWNSAVEKLKSEALRILLSKDYVEKEHLQLSHQKLSQLQEEFGQLMVERNTWLKKANEFFNSANKEVIKCTYEHLIWHTSTRPQGQSKPYKTDPKSPEPVPRPVRELHIKEVCSRHEGPMSTVDVAVTSSEKGDTIRKSEIKTGQMKGSQVSGIHEMMGCIKRRVDHLTEQCSAHKEYALKKQQLTASVEGYLRKVEMQFQSLKEFYETEIPQKEQDDAKAKHCSDSAEKQWQLFLKKSFITQDLGLEFLNLINMAKENEILDVKNEVYLMKNTMENQKAEREELSLLRLAWQLKATESKPGKQQWAAFKEQLKKTSHNLKLLQEALMPVSALDLGGSLQFILDLRQKWNDMKPQFQQLNDEVQYIMKESEELTGRGAPVKEKSQQLKDLIHFHQKQKERIQDYEDILYKVVQFHQVKEELGRLIKSRELEFVEQPKELGDAHDVQIHLRCSQEKQARVDHLHRLALSLGVDIISSVQRPHCSNVSAKNLQQQLELLEEDSMKWRAKAEEYGRTLSRSVEYCAMRDEINELKDSFKDIKKKFNNLKFNYTKKNEKSRNLKALKYQIQQVDMYAEKMQALKRKMEKVSNKTSDSFLNYPSDKVNVLLEVMKDLQKHVDDFDKVVTDYKKNLDLTEHFQEVIEECHFWYEDASATVVRRLE

SEQ ID NO: 919086 - protein, 1132 aa, Homo sapiens
MDCVDNEKEWNSAVEKLKSEALRILLSKDYVEKEHLQLSHQKLSQLQEEFGQLMVERNTWLKKANEFFNSANKEVIKCTYEHLIWHTSTRPQGQSKPYKTDPKSPEPVPRPVRELHIKEVCSRHEGPMSTVDVAVTSSEKGDTIRKSEIKTGQMKGSQVSGIHEMMGCIKRRVDHLTEQCSAHKEYALKKQQLTASVEGYLRKVEMQFQSLKEFYETEIPQKEQDDAKAKHCSDSAEKQWQLFLKKSFITQDLGLEFLNLINMAKENEILDVKNEVYLMKNTMENQKAEREELSLLRLAWQLKATESKPGKQQWAAFKEQLKKTSHNLKLLQEALMPVSALDLGGSLQFILDLRQKWNDMKPQFQQLNDEVQYIMKESEELTGRGAPVKEKSQQLKDLIHFHQKQKERIQDYEDILYKVVQFHQVKEELGRLIKSRELEFVEQPKELGDAHDVQIHLRCSQEKQARVDHLHRLALSLGVDIISSVQRPHCSNVSAKNLQQQLELLEEDSMKWRAKAEEYGRTLSRSVEYCAMRDEINELKDSFKDIKKKFNNLKFNYTKKNEKSRNLKALKYQIQQVDMYAEKMQALKRKMEKVSNKTSDSFLNYPSDKVNVLLEVMKDLQKHVDDFDKVVTDYKKNLDLTEHFQEVIEECHFWYEDASATVVRVGKYSTECKTKEAVKILHQQFNKFIAPSVPQQEERIQEATDLAQHLYGLEEGQKYIEKIVTKHKEVLESVTELCESLTELEEKLKQGDVLKMNPNLEDFHYDYIDLLKEPAKNKQTIFNEERNKGQVQVADLLGINGTGEERLPQDLKVSTDKEGGVQDLLLPEDMLSGEEYECVSPDDISLPPLPGSPESPLAPSDMEVEEPVSSSLSLHISSYGVQAGTSSPGDAQESVLPPPVAFADACNDKRETFSSHFERPYLQFKAEPPLTSRGFVEKSTALHRISAEHPESMMSEVHERALQQHPQAQGGLLETREKMHADNNFTKTQDRLHASSDAFSGLRFQSGTSRGYQRQMVPREEIKSTSAKSSVVSLADQAPNFSRLLSNVTVMEGSPVTLEVEVTGFPEPTLTWYKKGQKLSADGHLQVLHKETRHSVFIPKVCKADAGLYVARAQNSSGALSSNVILHVTEFV

SEQ ID NO: 919087 - protein, 337 aa, Homo sapiens
PGSSWIPGPMDEGPDLDLGPPVDPDEDSDNSAIYVQGLNDNVTLDDLVDFFKQCGVVKMNKRTEQPMIHTYLDKETRKPKGDATVSCEDSPTAKAAVEWFDGKDFQGSKLKVSLARKRPPVNSMQGGMPPHEGRGMPPPLCGGPGGPGSPGGPMGHMGGRGGDRGGLPPRGPQGSRGNTSGGGNVQHQAGDRQCPNPGCGNQNFAWRTESNKCKAPKPEGFLPPPFPPPGGDHGRGGPGGMWGGRGGLMDHGGPGGMFRGGCGRDRSGFCGGWAWTEVALVEEDKVALGGPRTFDSNPEIESRMVTARGRRKERMKNCSVYVEFQFHKMERFRRLVA

SEQ ID NO: 919088 - protein, 393 aa, Homo sapiens
MGVYGQESGGFSGLGENRSMSGPDNWGRGRGGFDRGGMSRGGRGGGCGGMGSAGEQVGFNKPGGPMDEGPDLDLGPPVDPDEDSDNSAIYVQGLNDNVTLDDLVDFFKQCGVVKMNKRTEQPMIHTYLDKETRKPKGDATVSCEDSPTAKAAVEWFDGKDFQGSKLKVSLARKRPPVNSMQGGMPPHEGRGMPPPLCGGPGGPGSPGGPMGHMGGRGGDRGGLPPRGPQGSRGNTSGGGNVQHQAGDRQCPNPGCGNQNFAWRTESNKCKAPKPEGFLPPPFPPPGGDHGRGGPGGMWGGRGGLMDHGGPGGMFRGGCGRDRSGFCGGWAWTEVALVEEDKVALGGPRTFDSNPEIESRMVTARGRRKERMKNCSVYVEFQFHKMERFRRLVA

SEQ ID NO: 919089 - protein, 488 aa, Homo sapiens
MVGDTCDEQNDTQKQFCEEQNTGILHDEILIHEEKQIEVVEKMNSELSLSCKKEKDFLHENSTLREEIAMLRLELDTMKHQSQLRKKKYLEDIESVKKKNDNLLKALQLNELTMDDDTAVLVIDNGSGMCKAGFAGDDAPRAVFPSIVGRPRQQGMMGGMHQKESYVGKEAQSKRGILTLKYPMEHGIITNWDDMEKIWHHTFYNELRVAPEEHPILLTEAPLNPKANREKMTQIMFETFNTPAMYVAIQAMLSLYTSGRTTGIVMDSGDGVTHTVPIYDGNALPHATLRLDLAGRELTDYLMKILTERGYRFTTMAEREIVRDIKEKLCYVALDFEQEMAMAASSSSLEKSYELPDGQVITIGNEWFRCPEALFQPCFLGMESCGIHETTFNSIMKSDVDIRKDLYTNTVLSGGTTMYPGMAHRMQKEIAALAPSMLKIRIIAPPKRKYSVWVGGSILASLSTFQQMWISKQEYDESGPSIVHRKCF

SEQ ID NO: 919090 - protein, 169 aa, Homo sapiens
MDMEVLGQEQSSEQLDLEEISRKISFLDKWREIFSYHREKKRKFKTRSSPALFALSFVGVIFAQNHEGNHTSADENEDGTGLSQPKGQGHLPSSGLCSIPNPSIISSKLGGFPISLAMATMPEATGRWAGMQSSRNTALSSLAFKPLDGALTCILYRYLIAVLSSNEDR

SEQ ID NO: 919091 - protein, 187 aa, Homo sapiens [sequence omitted]

SEQ ID NO: 919092 - protein, 205 aa, Homo sapiens
SAAAAISFNLRPRPVAELQRTAPPLLKRLSLNCARKRASPDSGARGNATRPVPLAWPLFGGLGWRSSRPGWFRTPAFRTWLGDGLGAPPSWPRSAAIAPVRARSVGGAGSRSRAVIGRVQATAETPSSTDRARNQRRGSQRPRTAGILRPRRAAFARRNRCLIHQRDAYLARPLGSGGPGRMGGWLLSGSRHVFHPTYCLEFAVT

SEQ ID NO: 919093 - protein, 205 aa, Homo sapiens; identical to SEQ ID NO: 919092

SEQ ID NO: 919094 - protein, 174 aa, Homo sapiens
LLPTVLMLKPHPSGATCCLGPRSLCTLLGNFEESLLQGRFAPSGHIEGFTAETGASGSYCPHHVTLPVTVTFFEVSEQNAPTHFLGFVDLNLLGRKSYSVPKVGTTQVTFNPNQTVVKMFLVTFDFLDMAAATCPYCAIASFWCLWVRRKMLTPPTASSATRCTLGSGAPAQAS

SEQ ID NO: 919095 - protein, 152 aa, Homo sapiens
MSLRCCWTWERGNWDMGLCQKVLLVTGQRGKGQREKNLKSENLDCRRLPRSWEKGEKTRMKTERGRGMKCCQMSKGIWREGTGRLLQKGHGAEGLCCEPAKEVCVGTVGSECVGNNMENWELPWNLQGRAEEKKNGIHAVPILQMKTRGLFL

SEQ ID NO: 919096 - protein, 156 aa, Homo sapiens
MASNVTNKTDPRSMNSRVFIGNLNTLVVKKSDVEAIFSKYGKIVGCSVHKGFAFFQYVNERNARAAVAGEDGRMIAGQVLDINLAAEPKVNRGKAGVKRSAAEMYGSSFDLDCDFQRDYYDRMYSYPARVPPPPPIARAVVPSKQKNSASHTLIYV

SEQ ID NO: 919097 - protein, 602 aa, Homo sapiens
MGDDLILMHVSLRLKPAKIDHKQYFRKQVLHGKDFQVDCKASGSPVPEISWSLPDGTMINNAMQADDSGHRTRRYTLFNNGTLYFNKVGVAEEGDYTCYAQNTLGKDEMKVHLTVITAAPRIRQSNKTNKRIKAGDTAVLDCEVTGDPKPKIFWLLPSNDMISFSIDRYTFHANGSLTINKVKLLDSGEYVCVARNPSGDDTKMYKLDVVSKPPLINGLYTNRTVIKATAVRHSKKHFDCRAEGTPSPEVMWIMPDNIFLTAPYYGSRITVHKNGTLEIRNVRLSDSADFICVARNEGGESVLVVQLEVLEMLRRPTFRNPFNEKIVAQLGKSTALNCSVDGNPPPEIIWILPNGTRFSNGPQSYQYLIASNGSFIISKTTREDAGKYRCAARNKVGYIEKLVILEIGQKPVILTYAPGTVKGISGESLSLHCVSDGIPKPNIKWTMPSGYVVDRPQINGKYILHDNGTLVIKEATAYDRGNYICKAQNSVGHTLITVPVMIVAYPPRITNRPPRSIVTRTGAAFQLHCVALGVPKPEITWEMPDHSLLSTASKERTHGSEQLHLQGTLVIQNPQTSDSGIYKCTAKNPLGSDYAATYIQVI

SEQ ID NO: 919098 - protein, 650 aa, Homo sapiens
MVESVRLENQPCDLRVGSWIHVYPNGSLFIGSVTEKDSGVYLCVARNKMGDDLILMHVSLRLKPAKIDHKQYFRKQVLHGKDFQVDCKASGSPVPEISWSLPDGTMINNAMQADDSGHRTRRYTLFNNGTLYFNKVGVAEEGDYTCYAQNTLGKDEMKVHLTVITAAPRIRQSNKTNKRIKAGDTAVLDCEVTGDPKPKIFWLLPSNDMISFSIDRYTFHANGSLTINKVKLLDSGEYVCVARNPSGDDTKMYKLDVVSKPPLINGLYTNRTVIKATAVRHSKKHFDCRAEGTPSPEVMWIMPDNIFLTAPYYGSRITVHKNGTLEIRNVRLSDSADFICVARNEGGESVLVVQLEVLEMLRRPTFRNPFNEKIVAQLGKSTALNCSVDGNPPPEIIWILPNGTRFSNGPQSYQYLIASNGSFIISKTTREDAGKYRCAARNKVGYIEKLVILEIGQKPVILTYAPGTVKGISGESLSLHCVSDGIPKPNIKWTMPSGYVVDRPQINGKYILHDNGTLVIKEATAYDRGNYICKAQNSVGHTLITVPVMIVAYPPRITNRPPRSIVTRTGAAFQLHCVALGVPKPEITWEMPDHSLLSTASKERTHGSEQLHLQGTLVIQNPQTSDSGIYKCTAKNPLGSDYAATYIQVI

SEQ ID NO: 919099 - protein, 145 aa, Homo sapiens
MSNLGLFPHLLNKPLDFEFNLRHRLQVHGFKFMALVRGREKKDKPWGLGPSQPPGFFPEHFGIGHLQVQTRDSSQHSLPGHSAELGASVTWDSAQHHPVYPMWMPCSSSTEPLEPLTAGSLQAVKWEPSQAPPASVLPKSIEGNH

SEQ ID NO: 919100 - protein, 273 aa, Homo sapiens
QSLREVKRLILCQGVESRLIPMPFNFKIGRLIIGQNGILSTPAVSCIIRKIKAAGGIILTASHCPGGPGGEFGVKFNVANGVLNGALDVEKVDDEQEQNSSFQETYSQYGKCNLLKYKSAIVLHAVQKYMLTWASGIRQVAAPSSSCLIQIQPTFSQVTMVAPPQGGADPLHEAACNMAACFFKGVKRESPERQSRISSKSGLGVEQISLDVPLIWKTKDTSYLPPTYATHNGLWSPTHTSAHSHRHSLCPQNITEESSVSAAWCEHWEYKEK

SEQ ID NO: 919101 - protein, 138 aa, Homo sapiens
MGDVGAAGLLEFAGGPLQTLFAWVSPAEAAEQQILLPDPSSGSFVPEEHPPVQGVFGLLLGGVSQLDARHKYWVRRLPTLLSDLAANQGSHHPQPLQEGTHQRGEACQDETGDQLNPGEIREGSRHLWGENDSIHSII

SEQ ID NO: 919102 - protein, 2024 aa, Homo sapiens
MHKRKQRIPSWGPSVGSEEIKKLRKQLEEIQKENGRYIELLKANDICLYDDPTIHWKGNLKNSKVSVVIPSDQVQKKIIVYSNGNQPGGNSQGTAVQGITFNVSHNLQKQTANVVPVQRTCNLVTPVSISGVYPSENKPWHQTTVPALATNQPVPLCLPAAISAQSILELPTSESESNVLGATSGSLIAVSIESEPHQHHSLHTCLNDQNSSENKNGQENPKVLKKMTPCVTNIPHSSSATATKVHHGNKSCLSIQDFRGDFQNTFVVSVTTTVCSQPPRTAGDSSPMSISKSADLTSTATVVASSAPGVGKATIPISTLSGNPLDNGWTLSCSLPSSSVSTSDLKNINSLTRISSAGNTQTTWTTLQLAGNTIQPLSQTPSSAVTPVLNESGTSPTTSNHSRYVATDINLNNSFPADGQPVEQVVVTLPSCPSLPMQPLIAQPQVKSQPPKNILPLNSAMQVIQMAQPVGSAVNSAPTNQNVIILQPPSTTPCPTVMRAEVSNQTVGQQIVIIQAANQNPLPLLPAPPPGSVRLPINGANTVIGSNNSVQNVPTPQTFGGKHLVHILPRPSSLSASNSTQTFSVTMSNQQPQTISLNGQLFALQPVMSSSGTTNQTPMQIIQPTTSEDPNTNVALNTFGALASLNQSISQMAGQSCVQLSISQPANSQTAANSQTTTANCVSLTTTAAPPVTTDSSATLASTYNLVSTSSMNTVACLPNMKSKRLNKKPGGRKHLAANKSACPLNSVRDVSKLDCPNTEGSAEPPCNDGLLESFPAVLPSVSVSQANSVSVSASHSLGVLSSESLIPESVSKSKSAEKSSPPSQESVTSEHFAMAAAKSKDSTPNLQQETSQDKPPSSLALSDAAKPCASANVLIPSPSDPHILVSQVPGLSSTTSTTSTDCVSEVEIIAEPCRVEQDSSDTMQTTGLLKGQGLTTLLSDLAKKKNPQKSSLSDQMDHPDFSSENPKIVDSSVNLHPKQELLLMNNDDRDPPQHHSCLPDQEVINGSLINGRQADSPMSTSSGSSRSFSVASMLPETTREDVTSNATTNTCDSCTFDSTSQPPSITSLSVNNLIHQSSISHPLASCAGLSPTSEQTTVPATVNLTVSSSSYGSQPPGPSLMTEYSQEQLNTMTSTIPNSQIQEPLLKPSHESRKDSAKRAVQDDLLLSSAKRQKHCQPAPLRLESMSLMSRTPDTISDQTQMMVSQIPPNSSNSVVPVSNPAHGDGLTRLFPPSNNFVTPALRQTEVQCGSQPSVAEQQQTQASQHLQALQQHVPAQGVSHLHSNHLYIKQQQQQQQQQQQQQQQQQAGQLRERHHLYQMQHHVPHAESSVHSQPHNVHQQRTLQQEVQMQKKRNLVQGTQTSQLSLQPKHHGTDQSRSKTGQPHPHHQQMQQQMQQHFGSSQTEKSCENPSTSRNHHNHPQNHLNQDIMHQQQDVGSRQQGSGVSSEHVSGHNPMQRLLTSRGLEQQMVSQPSIVTRSSDMTCTPHRPERNRVSSYSAEALIGKTSSNSEQRMGISIQGSRVSDQLEMRSYLDVPRNKSLAIHNMQGRVDHTVASDIRLSDCQTFKPSGASQQPQSNFEVQSSRNNEIGNPVSSLRSMQSQAFRISQNTGPPPIDRQKRLSYPPVQSIPTGNGIPSRDSENTCHQSFMQSLLAPHLSDQVIGSQRSLSEHQRNTQCGPSSAIEYNCPPTHENVHIRRESESQNRESCDMSLGAINTRNSTLNIPFSSSSSSGDIQGRNTSPNVSVQKSNPMRITESHATKGHMNPPVTTNMHGVARPALPHPSVSHGNGDQGPAVRQANSSVPQRSRHPLQDSSGSKIRQPERNRSGNQRQSTVFDPSLPHLPLSTGGSMILGRQQPATEKRGSIVRFMPDSPQVPNDNSGPDQHTLSQNFGFSFIPEGGMNPPINANASFIPQVTQPSATRTPALIPVDPQNTLPSFYPPYSPAHPTLSNDISIPYFPNQMFSNPSTEKRDDYSFALKHLLGPPCMDQHVVDNGYFLEKDKGMISRREEYFKSIVIFYCTG

SEQ ID NO: 919103 - protein, 1936 aa, Homo sapiens
MHKRKQRIPSWGPSVGSEEIKKLRKQLEEIQKENGRYIELLKANDICLYDDPTIHWKGNLKNSKVSVVIPSDQVQKKIIVYSNGNQPGGNSQGTAVQGITFNVSHNLQKQTANVVPVQRTCNLVTPVSISGVYPSENKPWHQTTVPALATNQPVPLCLPAAISAQSILELPTSESESNVLGATSGSLIAVSIESEPHQHHSLHTCLNDQNSSENKNGQENPKVLKKMTPCVTNIPHSSSATATKVHHGNKSCLSIQDFRGDFQNTFVVSVTTTVCSQPPRTAGDSSPMSISKSADLTSTATVVASSAPGVGKATIPISTLSGNPLDNGWTLSCSLPSSSVSTSDLKNINSLTRISSAGNTQTTWTTLQLAGNTIQPLSQTPSSAVTPVLNESGTSPTTSNHSRYVATDINLNNSFPADGQPVEQVVVTLPSCPSLPMQPLIAQPQVKSQPPKNILPLNSAMQVIQMAQPVGSAVNSAPTNQNVIILQPPSTTPCPTVMRAEVSNQTVGQQIVIIQAANQNPLPLLPAPPPGSVRLPINGANTVIGSNNSVQNVPTPQTFGGKHLVHILPRPSSLSASNSTQTFSVTMSNQQPQTISLNGQLFALQPVMSSSGTTNQTPMQIIQPTTSEDPNTNVALNTFGALASLNQSISQMAGQSCVQLSISQPANSQTAANSQTTTANCVSLTTTAAPPVTTDSSATLASTYNLVSTSSMNTVACLPNMKSKRLNKKPGGRKHLAANKSACPLNSVRDVSKLDCPNTEGSAEPPCNDGLLESFPAVLPSVSVSQANSVSVSASHSLGVLSSESLIPESVSKSKSAEKSSPPSQESVTSEHFAMAAAKSKDSTPNLQQETSQDKPPSSLALSDAAKPCASANVLIPSPSDPHILVSQVPGLSSTTSTTSTDCVSEVEIIAEPCRVEQDSSDTMQTTGLLKGQGLTTLLSDLAKKKNPQKSSLSDQMDHPDFSSENPKIVDSSVNLHPKQELLLMNNDDRDPPQHHSCLPDQEVINGSLINGRQADSPMSTSSGSSRSFSVASMLPETTREDVTSNATTNTCDSCTFDSTSQPPSITSLSVNNLIHQSSISHPLASCAGLSPTSEQTTVPATVNLTVSSSSYGSQPPGPSLMTEYSQEQLNTMTSTIPNSQIQEPLLKPSHESRKDSAKRAVQDDLLLSSAKRQKHCQPAPLRLESMSLMSRTPDTISDQTQMMVSQIPPNSSNSVVPVSNPAHGDGLTRLFPPSNNFVTPALRQTEVQCGSQPSVAEQQQTQASQHLQALQQHVPAQGVSHLHSNHLYIKQQQQQQQQQQQQQQQQQAGQLRERHHLYQMQHHVPHAESSVHSQPHNVHQQRTLQQEVQMQKKRNLVQGTQTSQLSLQPKHHGTDQSRSKTGQPHPHHQQMQQQMQQHFGSSQTEKSCENPSTSRNHHNHPQNHLNQDIMHQQQDVGSRQQGSGVSSEHVSGHNPMQRLLTSRGLEQQMVSQPSIVTRSSDMTCTPHRPERNRVSSYSAEALIGKTSSNSEQRMGISIQGSRVSDQLEMRSYLDVPRNKSLAIHNMQGRVDHTVASDIRLSDCQTFKPSGASQQPQSNFEVQSSRNNEIGNPVSSLRSMQSQAFRISQNTGPPPIDRQKRLSYPPVQSIPTGNGIPSRDSENTCHQSFMQSLLAPHLSDQVIGSQRSLSEHQRNTQCGPSSAIEYNCPPTHENVHIRRESESQNRESCDMSLGAINTRNSTLNIPFSSSSSSGDIQGRNTSPNVSVQKSNPMRITESHATKGHMNPPVTTNMHGVARPALPHPSVSHGNGDQGPAVRQANSSVPQRSRHPLQDSSGSKIRQPERNRSGNQRQSTVFDPSLPHLPLSTGGSMILGRQQPATEKRGSIVRFMPDSPQVPNDNSGPDQHTLSQNFGFSFIPEGGMNPPINANASFIPQVTQPSATRTPAWATEPDSIY

SEQ ID NO: 919104 - protein, 2075 aa, Homo sapiens
MHKRKQRIPSWGPSVGSEEIKKLRKQLEEIQKENGRYIELLKANDICLYDDPTIHWKGNLKNSKVSVVIPSDQVQKKIIVYSNGNQPGGNSQGTAVQGITFNVSHNLQKQTANVVPVQRTCNLVTPVSISGVYPSENKPWHQTTVPALATNQPVPLCLPAAISAQSILELPTSESESNVLGATSGSLIAVSIESEPHQHHSLHTCLNDQNSSENKNGQENPKVLKKMTPCVTNIPHSSSATATKVHHGNKSCLSIQDFRGDFQNTFVVSVTTTVCSQPPRTAGDSSPMSISKSADLTSTATVVASSAPGVGKATIPISTLSGNPLDNGWTLSCSLPSSSVSTSDLKNINSLTRISSAGNTQTTWTTLQLAGNTIQPLSQTPSSAVTPVLNESGTSPTTSNHSRYVATDINLNNSFPADGQPVEQVVVTLPSCPSLPMQPLIAQPQVKSQPPKNILPLNSAMQVIQMAQPVGSAVNSAPTNQNVIILQPPSTTPCPTVMRAEVSNQTVGQQIVIIQAANQNPLPLLPAPPPGSVRLPINGANTVIGSNNSVQNVPTPQTFGGKHLVHILPRPSSLSASNSTQTFSVTMSNQQPQTISLNGQLFALQPVMSSSGTTNQTPMQIIQPTTSEDPNTNVALNTFGALASLNQSISQMAGQSCVQLSISQPANSQTAANSQTTTANCVSLTTTAAPPVTTDSSATLASTYNLVSTSSMNTVACLPNMKSKRLNKKPGGRKHLAANKSACPLNSVRDVSKLDCPNTEGSAEPPCNDGLLESFPAVLPSVSVSQANSVSVSASHSLGVLSSESLIPESVSKSKSAEKSSPPSQESVTSEHFAMAAAKSKDSTPNLQQETSQDKPPSSLALSDAAKPCASANVLIPSPSDPHILVSQVPGLSSTTSTTSTDCVSEVEIIAEPCRVEQDSSDTMQTTGLLKGQGLTTLLSDLAKKKNPQKSSLSDQMDHPDFSSENPKIVDSSVNLHPKQELLLMNNDDRDPPQHHSCLPDQEVINGSLINGRQADSPMSTSSGSSRSFSVASMLPETTREDVTSNATTNTCDSCTFDSTSQPPSITSLSVNNLIHQSSISHPLASCAGLSPTSEQTTVPATVNLTVSSSSYGSQPPGPSLMTEYSQEQLNTMTSTIPNSQIQEPLLKPSHESRKDSAKRAVQDDLLLSSAKRQKHCQPAPLRLESMSLMSRTPDTISDQTQMMVSQIPPNSSNSVVPVSNPAHGDGLTRLFPPSNNFVTPALRQTEVQCGSQPSVAEQQQTQASQHLQALQQHVPAQGVSHLHSNHLYIKQQQQQQQQQQQQQQQQQAGQLRERHHLYQMQHHVPHAESSVHSQPHNVHQQRTLQQEVQMQKKRNLVQGTQTSQLSLQPKHHGTDQSRSKTGQPHPHHQQMQQQMQQHFGSSQTEKSCENPSTSRNHHNHPQNHLNQDIMHQQQDVGSRQQGSGVSSEHVSGHNPMQRLLTSRGLEQQMVSQPSIVTRSSDMTCTPHRPERNRVSSYSAEALIGKTSSNSEQRMGISIQGSRVSDQLEMRSYLDVPRNKSLAIHNMQGRVDHTVASDIRLSDCQTFKPSGASQQPQSNFEVQSSRNNEIGNPVSSLRSMQSQAFRISQNTGPPPIDRQKRLSYPPVQSIPTGNGIPSRDSENTCHQSFMQSLLAPHLSDQVIGSQRSLSEHQRNTQCGPSSAIEYNCPPTHENVHIRRESESQNRESCDMSLGAINTRNSTLNIPFSSSSSSGDIQGRNTSPNVSVQKSNPMRITESHATKGHMNPPVTTNMHGVARPALPHPSVSHGNGDQGPAVRQANSSVPQRSRHPLQDSSGSKIRQPERNRSGNQRQSTVFDPSLPHLPLSTGGSMILGRQQPATEKRGSIVRFMPDSPQVPNDNSGPDQHTLSQNFGFSFIPEGGMNPPINANASFIPQVTQPSATRTPALIPVDPQNTLPSFYPPYSPAHPTLSNDISIPYFPNQMFSNPSTEKVNSGSLNNRFGSILSPPRPVGFAQPSFPLLPDMPPMHMTNSHLSNFNMTSLFPEIATVLPDGSAMSPLLTIANSSASDSSKQSSNRPAHNISHILGHDCSSAV

SEQ ID NO: 919105 - protein, 181 aa, Homo sapiens
MHCYLIPGSARSVGEETEAQGTGKDPRRGPLLEQAWGPSLICGSTTPTVIGRYQGHVPTVAFSFGAPYGTTTLKYFQDHRNRAMEKSHTPFSQGGHFPTIFSTNPNLLLMERASTRDRWLHKPSYTRFNLDSHRSTELTNFYQMVQQHRKYYQDKTGTVPRVPYFAMPVREPERYPLPTVL

SEQ ID NO: 919106 - protein, 189 aa, Homo sapiens
MHCYLIPGSARSVGEETEAQGTGKDPRRGPLLEQAWGPSLICGSTTPTVIGRYQGHVPTVAFSFGAPYGTTTLKYFQDHRNRAMEKSHTPFSQGGHFPTIFSTNPNLLLMERASTRDRWLHKPSYTRFNLDSHRSTELTNFYQMVQQHRKYYQDKTGTVPRVPYFAMPVREPERYPLPTVLLPGHLHCC

SEQ ID NO: 919107 - protein, 189 aa, Homo sapiens; identical to SEQ ID NO: 919106

SEQ ID NO: 919108 - protein, 228 aa, Homo sapiens
MHCYLIPGSARSVGEETEAQGTGKDPRRGPLLEQAWGPSLICGSTTPTVIGRYQGHVPTVAFSFGAPYGTTTLKYFQDHRNRAMEKSHTPFSQGGHFPTIFSTNPNLLLMERASTRDRWLHKPSYTRFNLDSHRSTELTNFYQMVQQHRKYYQDKTGTVPRVPYFAMPVREPERYPLPTVLPPLCPKKKWHLLRLAPENLKTYQTFPSGKRVSPQERKKRDCYFEFRA

SEQ ID NO: 919109 - protein, 134 aa, Homo sapiens
MREASRIFLKEDEGRFGKQGTKSFISVVRFCSLFIGFSQEQVFQLLESVNAGCSVYSGSPWQSVLAQERKGRRGEEERLASVKGRAFPQGSMVAIVTASFVCTYSEQLLLFGCWWQGYYGGNRRMRVRYLSEGD

SEQ ID NO: 919110 - protein, 134 aa, Homo sapiens; identical to SEQ ID NO: 919109

SEQ ID NO: 919111 - protein, 134 aa, Homo sapiens; identical to SEQ ID NO: 919109

SEQ ID NO: 919112 - protein, 155 aa, Homo sapiens
MAPKRNAEGLSTVSTCKKAAMCLIEKGCELGEQVLQMPGDLPEHRVERTLLHHTSAQEGWVAQAIQLSETPAISRALQCVQPLRLMQKISKSSKGRRRKWRTLLIMYDTFMTIKKKTSCHIMSYTLEKFPCNMDAAGGHYLNQLLQEQKCQPHVL

SEQ ID NO: 919113 - protein, 154 aa, Homo sapiens
MPLHSSLGNRVRLCLKQTNKHPPTIYANNIREARKLYELFSAEAFRSSSIPMCLWNSTVRSKSAQELREADVRNYLHALPKTVGTTARGKLTRYNEPVTVTEFLKITLFPTTADCFRIEEAPRAVYPHPQNLLHLDPPHSSYYRPLQVTNSVKY

SEQ ID NO: 919114 - protein, 154 aa, Homo sapiens
APMMCYTLAIAPFTFKSRQETANTLQWLSRFSKRSFPAHLYFLISTLLSNIRLLSIPRIFQSHPSSLPLLFPVLGIPSTSLCLKMMEMALELGNSQQKGTSLLQQQGTAFCQKPNELGSRLFSGVCRKFSSTPNTFCLIHYFCPLLLDIELDEC

SEQ ID NO: 919115 - protein, 145 aa, Homo sapiens
MWLRKDDAAGVPQGEQAHQGGLSQRPAGSQADPASAILDLPHLPRQHPAYPHPGSWTGPPVARICMSLPGGLSGWQLWENQEAEGFLKNPSAAAAAGNRKPLDHMSNLGKGTQNPIYNGSLNWGHLRGSCRRGKLVAQWDVQGHR

SEQ ID NO: 919116 - protein, 210 aa, Homo sapiens
MRTEAGAAAAKRLFPEKQTSEQEERSLGLQVGMWVRKPLTPPPPHSSKEELNRPVGRGLNMNPFCENASTQSCMLFIVGSVYYLIDSTILKRVEVLPLLFTILNPKCERNESKKKPPESTELIKSSKITVAAKASILVEAVASAIIVVVVAVIIKVLLVVEAASSSSNSSTSNSSESRSSRSTSFSSSSNCSNSNRSCSIRVSIKCNENP

SEQ ID NO: 919117 - protein, 131 aa, Homo sapiens
KKSDMVWLCPHPNLNLNCSSHNLHMSWERPGRSLFPIIKYLQEVKDKKKEINELRVNTDEGEDVIKNNGYSEPGEGYLRDTASRKQFASVILIYLYLFHEIENTIRKPTNAMVAHTEKSKTSETSSHHSLM

SEQ ID NO: 919118 - protein, 690 aa, Homo sapiens
QGNRQSSASGCSVAIVTAPITAVVVMAGLSGAQIPDGEFTAVVYRLIRNARYAEAVQLLGGELQRSPRSRAGLSLLGYCYYRLQEFALAAECYEQLGQLHPELEQYRLYQAQALYKACLYAEATRVAFLLLDNPAYHSRVLHLQAAIKYSEGDLPGSRSLVEQLPSREGGEESGGENETDGQINLGCLLYKEGQYEAACSKFFAALQASGYQPDLSYNLALAYYSSRQYASALKHIAEIIERGIRQHPELGVGMTTEGIDVRSVGNTLVLHQTALVEAFNLKAAIEYQLRNYEAAQEALTDMPPRAEEELDPVTLHNQALMNMDARPTEGFEKLQFLLQQNPFPPETFGNLLLLYCKYEYFDLAADVLAENAHLIYKFLTPYLYDFLDAVITCQTAPEEAFIKLDGLAGMLTEVLRKLTIQVQEARHNRDDEAIKKAVNEYDETMEKYIPVLMAQAKIYWNLENYPMVEKIFRKSVEFCNDHDVWKLNVAHVLFMQENKYKEAIGFYEPIVKKHYDNILNVSAIVLANLCVSYIMTSQNEEAEELMRKIEKEEEQLSYDDPDKKMYHLCIVNLVIGTLYCAKGNYDFGISRVIKSLEPYNKKLGTDTWYYAKRCFLSLLENMSKHTIMLRDSVIQECVQFLEHCELHGRNIPAVIEQPLEEERMHVGKNTVTYESRQLKALIYEIIGWNI

SEQ ID NO: 919119 - protein, 168 aa, Homo sapiens
KSQPPAGRVASPSFSSLCLHQSGKWLGVMAEAPLHRIKAWPGTCSDAIDIWFAVVIWSPWVCGRRSSGVDTMGRWCPSKNITLGMLVASLEPRLEIEGKWEKNRGLDSDPGALISVDVDLGPYRSALDIVGSGSMRMRNPVFGREEAAEMSLHLYKGKCSPGPLMQRS

SEQ ID NO: 919120 - protein, 128 aa, Homo sapiens
KTKMLRILTRMAKIMSFITFQDTEMRSPRDETGEQNISSSSWDDEASSLGKEEHQNQRGQLGGYCNISAPKTQEALKTPLPTSPLHEKRKGQPKKQEAAVQGEKSTGFRVRHPGSSSSLQFIEAVFPA

SEQ ID NO: 919121 - protein, 126 aa, Homo sapiens
MKLETIILSKLLQGQKTEHPMFSLIEKKKNKEKKTFWAGLGLGKGFLPLSWGARGGAKMGSRDTWGKSVVPRGRTRGQQTSGVRFLHQMKKTARGTTRRVSGQFPKRSSRRAIAGSYTRRGPVEAE

SEQ ID NO: 919122 - protein, 139 aa, Homo sapiens
MKLETIILSKLLQGQKTEHPMFSLIDQSLPKGTGPQPSLKGPGSGINLTMGENRIQLQTTSRANLKGSKNHNMVTAGEPLHTTDSLLLQIRLLDKSSPGFVAVMTTENVKGELSHNTGATGPMQVRNPAGRSLNLKAPK

SEQ ID NO: 919123 - protein, 134 aa, Homo sapiens
MCLCDFSFQSYYKLTETQILCKNFLLPSQHLLQCLPKHHKHLDSPCSSHLDSPPNPRSHSHDTVGHLLGQPPPPVGCSACSLPPAWTAVSSSQRSSFHLSLIFPLLITFFLCSSPDLSFTCPKALRPTCLWLTM

SEQ ID NO: 919124 - protein, 380 aa, Homo sapiens
MQICGSSVASVAAGTSFQVLGPVCWQQLDLKMAVRVLWGGLSLLRVLWCLLPQTGYVHPDEFFQSPEVMAEDILGVQAARPWEFYPSSSCRSVLFPLLISGSTFWLLRLWEELGPWPGLVSGYALLVGPRLLLTALSFALDGAVYHLAPPMGADRWNALALLSGSYVTLVFYTRTFSNTIEGLLFTWLLVLVSSHVTWGPTRKEPAPGPRWRSWLLGGIVAAGFFNRPPFWPLLWSPSTSGALVEPQTWFEVSDPGGPGAAPWGDPHSSGVCGHGQLVFLQPRYIQEPCPDTCQLLALQPESPKPGETWHAGRGSLTWQSTASCSSGCCMPRPARLRGTGCKSAFQASAQMGLLRALGARSLLSSPRSYLLLLYFMPLAL

SEQ ID NO: 919125 - protein, 61 aa, Homo sapiens
MSSKSTSRAAASLSGVRTWKWGLHISFPSGDTDLLGNANKPPVSLMYPCLDQQYRSFRMRA

SEQ ID NO: 919126 - protein, 380 aa, Homo sapiens; identical to SEQ ID NO: 919124

SEQ ID NO: 919127 - protein, 167 aa, Homo sapiens
LSQSQAVAPTSVLRGMLLHLYGDPQVCAEQNAAPPSRYPQPARPPGSDLRRTLLRLRSTTEICAEDNAGERNSAVAKAPRAAPAQRGAPRRRRRREAQGSLAYSGRQRPLLAPGHCRALLLTVSDFQQLLACARVQAEHWSGVFLWRGAMPRVGWAIVHLLAPVVCM

SEQ ID NO: 919128 - protein, 384 aa, Homo sapiens
SGWAWALQDLHLEWPAGTTRPRAVRGLAPRSAAQHPDAPAPPALLARPRPARILAGPQPPPRGAGLGTCSLPCQSPPTPMGSHAVRVSPTGATPCSMAPSPIDHPRAEECRRAAWDWWAALPTAPAEDPLAKPAGLLSWVGTWRTFMSSWRIVNAPISTLCLARASLLKPARPRTHQKEETLDTSEHVKEQTPDTPSLRTVTLTVRDDRNVVAVALRLIKPMGNMPFYKEIIMLEKIRNKNDCKSQSCLDKEATRDIVIKGSKSESKISEGKVITNTFSLHDRMNIRKSKRQQVAQRKNCLKFYLLQQSTSGASRLDKSIYGFDAGPGNTCCTTDSGGPICQPGSNTVLWPIGSLPVVLVYLVKTQRKYPLKDCKCTNERSVSS

SEQ ID NO: 919129 - protein, 141 aa, Homo sapiens
MDSSACKKSHQSKKWRIQAQENFAKKFPYRLSWLTEPDPEPLQPWEVTNDSNTVQLPLQKRLVPTRSIPVRGLGAPDFTSPSGSCPAPLPAPSPPPLCNLWELKLLSRRFPRQLAFLLSTRHTEAACPQTSKAAGLSRGLS

SEQ ID NO: 919130 - protein, 866 aa, Homo sapiens
MSEQSYGGTILQRYGWAWGKPDAVQSSEVGKLSTVNSTWLGAGGEREKVVGARELEMLPDKAVTFCHRTQPVLSDPRRRKEGGDVMGLNCSPKTHMWKPEPPVLHNVTVFENGAETEMNKLKIEALIQLTGVIGRRGNPDILRDTRVTHTERRDCVRTQGEGGTERNPFLLFKALSLRSTVMAALASRYNESPNLLPSSLLPLAGAPYWPNPTKARGQGCEWVQSRQASLPGPEQGDEGGEYGPEQQTGVSAHLGGVWSRGNVSSDEMTQAPDNTRFTNRTQNSMVKAGQHLDQDWEKRETMTMVGRTAADLFSPSFYFIYLFFSDMVICFRLKRANPEADFSDETAESSLRAGRLLGQKGGGRGQAAPLNCLSSIREEICVSPVPFAPGFSHDKGYDQERDLLGMMGASPSPGLRLNMGPGTQGTALRGTKAWGAVLSIPHPSLLPQSPGETSFVTSVAWCSCLRFTGMRVSSLLDETGGAVGCLPQPFSLSISVAGALAPVPQDCPPAHPPCQPLALHTLVLQTRRCCLFSSVLMGTAGRTTWRGVLKTYPSPFHRVAMGTHAQLPPNLLNLWKLLNGNINTGPPSAQSPYEGGMRVRTGLSAQDMQVCLTDGVGADKPQSNQVTKSWERAQLCDTHIVAHNYAQIQMGSCATFFNTPGHSMRDAVISTLYRQEAELQSDRIKPRDTQIVMVQPGFEPRQIPEAAVCVAGLSFLLAKGSRERTYRLEENKIYFHKQQEALMRTTGLVVGSPKELPAFSWLRSTSVCKLMSLALKRADLSYPTGASAGLGAPAALTSPGHLRLPDSAQDLQSSLEGINCGQQWGRSIFSLPNLLWELFDLNSLTSRVFTEAYLFRMCESNKGCKL

SEQ ID NO: 919131 - protein, 73 aa, Homo sapiens
PLAFVSSPCQQHISVSDSLLPSRQPGGYEGLQRSSSPACRPGHTGPMRSATLSAGTSGSYSPPRSSPGPLTRR

SEQ ID NO: 919132 - protein, 127 aa, Homo sapiens
MSAQCTFLPLKVQEERGNPQVELTMRTVTALRGKSRNQPSSFLYQEDWRLQPWLCGASLALSSDCPTWLQVRVRGSWRWKMQLGELTRQVSGNSLNKRTPDHACSSSPGATSTSLSMEQDFSSSSED

SEQ ID NO: 919133 - protein, 733 aa, Homo sapiens
MVMFFRLKRANPEADFSDETAESSLRAGRLLGQKGGGRGQAAPLNCLSSIREEICVSPVPFAPGFSHDKGYDQERDLLGMMGASPSPGLRLNMGPGTQGTALRGTKAWGAVLSIPHPSLLPQSPGETSFVTSVAWCSCLRFTGMRVSSLLDETGGAVGCLPQPFSLSISVAGALAPVPQDCPPAHPPCQPLALHTLVLQTRRCCLFSSVLMGTAGRTTWRGVLKTYPSPFHRVAMGTHAQLPPNLLNLWKLLKWKINTGPPSAQSPYEGGMRVRTGLWAQDMQVCLTDGVGADKPQSNQVTKSWERAQLCDTHIVAHNMRQIQMGSCATFFNTPGHSMRDAVISTLYRQEAELQSDRIKPRDTQIVMVQPGFEPRQIPEAAVCVAGLSFLLAKGSRERTYRLEENKIYFHKQQEALMRTTGLVVGSPKELPAFSWLRSTSVCKLMSLALKRADLSYPTGASAGLGAPAALTSPGHLRLPDSAQDLQSSLEGINCGQQWGRSIFSLPNLLWELFDLNSLTSRVFTEAYLFRMCESNKGCKLWVLLGRNGLFLTTAALLPLSISEVDMGPSISVVSAVWLGGGGEREKVQPFNLPLFDTRKYPTLISPTLISSFLRQKLSWESPRWGSVPIIHYYYARDIQQGSVEFSVLILYPESTRHSKAKLDSGHLIIHRFQHKLACNISHNTKYLIKQAVRDIYRTNTSSDHFICLREQTCHNGPYPAKQAACWEGKMAVT

SEQ ID NO: 919134 - protein, 146 aa, Homo sapiens
MHHKYPYLNMDLEMSKFYQNITFGSVMSLNYITGVQAGFVFQISKTFPFLRLFQFCLIRIILNYLKCQHQKSSSTCRLDINAYGTTDLNRSSPVTTASKGQRVNHRGNSNACTVGSITREPELGTRGAHHHQKILPTCPRVCFPYF

SEQ ID NO: 919135 - protein, 266 aa, Homo sapiens
MGSKTLPAPVPIHPSLQLTNYSFLQAVNGLPTVPSDHLPNLYGFSALHAVHLHQWTLGYPAMHLPRSSFSKVPGTVSSLVDARFQLPAFPWFPHVIQPKPEITAGGSVPALKTKPRFDFANLALAATQEDPAKLGRGEGPGSPAGGLGALLDVTKLSPEKKPTRGRLPSKTKKEFVCKFCGRHFTKSYNLLIHERTHTDERPYTCDICHKAFRRQDHLRDHRYIHSKEKPFKCQECGKGFCQSRTLAVHKTLHSQVKELKTSKIKC

SEQ ID NO: 919136 - protein, 266 aa, Homo sapiens; identical to SEQ ID NO: 919135

SEQ ID NO: 919137 - protein, 138 aa, Homo sapiens
MLKVDILGAAVIKQAYSVYPVGKYSQWMKIQPMDKHRKFFLNMSCQKLSKIPKSCLKNCAMPFVVLVWHGVKRVGSGVILLGLECTLKNSGESIRFVCVPQFLEVEKLSFFPKHQNGRGHRTVRMINNALRLWCLYDP

SEQ ID NO: 919138 - protein, 254 aa, Homo sapiens
QVGTQPNMSDNQPALPSHPEGPRDFNIKLFYFRFSKLCLRDDSGQQRLSKNFCGLVAYAAPELLQGIPYQPMVYDIWSLGMILYIMVCSSMPYDSNIRKMLRIQKEHRVDFPHSKNLTDECKDLIYCMLQPDVSQRLHIHDTLSQCWVQPKAQGLPSMVFNKEGESSQGTELLWTPEPGSAKRSATKLEPGEQTQPEGQPETKPEGLAMQMSRQSDILGFPSKPSTREKEEGPPSSLQRCAPSEPFVAQCASGE

SEQ ID NO: 919139 - protein, 143 aa, Homo sapiens
MPHFTLLPFFCFLELCGILFFPNIVNLWLVESTDGKPTNMEDKLCGKHMLKVVEYYFHPYERPDISSFRLCEFLILQWASNSGSVASDNKNLGETLGGFIFQGSAKPVGSLRHSPGSLSELLLFHQASLEHDFLQKPSQTSLS

SEQ ID NO: 919140 - protein, 1843 aa, Homo sapiens
MADTQTQVAPTPTMRMATAEDLPLPPPPALEDLPLPPPKESFSKFHQQRQASELRRLYRHIHPELRKNLAEAVAEDLAEVLGSEEPTEGDVQCMRWIFENWRLDAIGEHERPAAKEPVLCGDVQATSRKFEEGSFANSTDQEPTRPQPGGGDVRAARWLFETKPLDELTGQAKELEATVREPAASGDVQGTRMLFETRPLDRLGSRPSLQEQSPLELRSEIQELKGDVKKTVKLFQTEPLCAIQDAEGAIHEVKAACREEIQSNAVRSARWLFETRPLDAINQDPSQVRVIRGISLEEGARPDVSATRWIFETQPLDAIREILVDEKDFQPSPDLIPPGPDVQQQQHLFETRALDTLKGDEEAGAEAPPKEEVVPGDVRSTLWLFETKPLDAFRDKVQVGHLQRVDPQDGEGHLSSDSSSALPFSQSAPQRDELKGDVKTFKNLFETLPLDSIGQGEVLAHGSPSREEGTDSAGQAQGIGSPVYAMQDSKGRLHALTSVSREQIVGGDVQGYRWMFETQPLDQLGRSPSTIDVVRGITRQEVVAGDVGTARWLFETQPLEMIHQREQQERQKEEGKSQGDPQPEAPPKGDVQTIRWLFETCPMSELAEKQGSEVTDPTAKAEAQSCTWMFKPQPVDRPVGSREQHLQVSQVPAGERQTDRHVFETEPLQASGRPCGRRPVRYCSRVEIPSGQVSRQKEVFQALEAGKKEEQEPRVIAGSIPAGSVHKFTWLFENCPMGSLAAESIQGGNLLEEQPMSPSGNRMQESQETAAEGTLRTLHATPGILHHGGILMEARGPGELCLAKYVLSGTGQGHPYIRKEELVSGELPRIICQVLRRPDVDQQGLLVQEDPTGQLQLKPLRLPTPGSSGNIEDMDPELQQLLACGLGTSVARTGLVMQETEQGLVALTAYSLQPRLTSKASERSSVQLLASCIDKGDLSGLHSLRWEPPADPSPVPASEGAQSLHPTESIIHVPPLDPSMGMGHLRASGATPCPPQAIGKAVPLAGEAAAPAQLQNTEKQEDSHSGQKGMAVLGKSEGATTTPPGPGAPDLLAAMQSLRMATAEAQSLHQQVLNKHKQGPTPTATSNPIQDGLRKAGATQSNIRPGGGSDPRIPAAPRKVSREEQALPRGLPGGWVTIQDGIYTAHPVRTFDPPGGVQLSQREPQSRHRETALSVQAPRPLQGGPGQSTGPGREEPGGCTQMAWGPPGKAMAEVCPGGLQAAETTLKTAPLGRHILASGPQAAGASPHPHNAFVPPPPTLPAAVTGPDFPAGAHRAEDSIQQASEPLKDPLLHSHSSPAGQRTPGGSQTKTPKLDPTMPPKKKPQLPPKPAHLTQSHPPQRLPKPLPLSPSFSSEVGQREHQRGERDTAIPQPAKVPTTVDQGHIPLARCPSGHSQPSLQHGLSTTAPRPTKNQATGSNAQSSEPPKLNALNHDPTSPQWGPGPSGEQPMEGSHQGAPESPDSLQRNQKELQGLLNQVQALEKEAASSVDVQALRRLFEAVPQLGGAAPQAPAAHQKPEASVEQAFGELTRVSTEVAQLKEQTLARLLDIEEAVHKALSSMSSLQPEASARGHFQGPPKDHSAHKISVTVSSSARPSGSGQEVGGQTAVKNQAKVECHTEAQSQVKIRNHTEARGHTASTAPSTRRQETSREYLCPPRVLPSSRDSPSSPTFISIQSATRKPLETPSFKGNPDVSVKSTQLAQDIGQALLHQKGVQDKTGKKDITQCSVQPEPAPPSASPLPRGWQKSVLELQTGPGSSQHYGAMRTVTEQYEEVDQFGNTVLMSSTTVTEQAEPPRNPGSHLGLHASPLLRQFLHSPAGFSSDLTEAETVQVSCSYSQPAAQ

SEQ ID NO: 919141 - protein, 1750 aa, Homo sapiens
MRWIFENWRLDAIGEHERPAAKEPVLCGDVQATSRKFEEGSFANSTDQEPTRPQPGGGDVRAARWLFETKPLDELTGQAKELEATVREPAASGDVQGTRMLFETRPLDRLGSRPSLQEQSPLELRSEIQELKGDVKKTVKLFQTEPLCAIQDAEGAIHEVKAACREEIQSNAVRSARWLFETRPLDAINQDPSQVRVIRGISLEEGARPDVSATRWIFETQPLDAIREILVDEKDFQPSPDLIPPGPDVQQQQHLFETRALDTLKGDEEAGAEAPPKEEVVPGDVRSTLWLFETKPLDAFRDKVQVGHLQRVDPQDGEGHLSSDSSSALPFSQSAPQRDELKGDVKTFKNLFETLPLDSIGQGEVLAHGSPSREEGTDSAGQAQGIGSPVYAMQDSKGRLHALTSVSREQIVGGDVQGYRWMFETQPLDQLGRSPSTIDVVRGITRQEVVAGDVGTARWLFETQPLEMIHQREQQERQKEEGKSQGDPQPEAPPKGDVQTIRWLFETCPMSELAEKQGSEVTDPTAKAEAQSCTWMFKPQPVDRPVGSREQHLQVSQVPAGERQTDRHVFETEPLQASGRPCGRRPVRYCSRVEIPSGQVSRQKEVFQALEAGKKEEQEPRVIAGSIPAGSVHKFTWLFENCPMGSLAAESIQGGNLLEEQPMSPSGNRMQESQETAAEGTLRTLHATPGILHHGGILMEARGPGELCLAKYVLSGTGQGHPYIRKEELVSGELPRIICQVLRRPDVDQQGLLVQEDPTGQLQLKPLRLPTPGSSGNIEDMDPELQQLLACGLGTSVARTGLVMQETEQGLVALTAYSLQPRLTSKASERSSVQLLASCIDKGDLSGLHSLRWEPPADPSPVPASEGAQSLHPTESIIHVPPLDPSMGMGHLRASGATPCPPQAIGKAVPLAGEAAAPAQLQNTEKQEDSHSGQKGMAVLGKSEGATTTPPGPGAPDLLAAMQSLRMATAEAQSLHQQVLNKHKQGPTPTATSNPIQDGLRKAGATQSNIRPGGGSDPRIPAAPRKVSREEQALPRGLPGGWVTIQDGIYTAHPVRTFDPPGGVQLSQREPQSRHRETALSVQAPRPLQGGPGQSTGPGREEPGGCTQMAWGPPGKAMAEVCPGGLQAAETTLKTAPLGRHILASGPQAAGASPHPHNAFVPPPPTLPAAVTGPDFPAGAHRAEDSIQQASEPLKDPLLHSHSSPAGQRTPGGSQTKTPKLDPTMPPKKKPQLPPKPAHLTQSHPPQRLPKPLPLSPSFSSEVGQREHQRGERDTAIPQPAKVPTTVDQGHIPLARCPSGHSQPSLQHGLSTTAPRPTKNQATGSNAQSSEPPKLNALNHDPTSPQWGPGPSGEQPMEGSHQGAPESPDSLQRNQKELQGLLNQVQALEKEAASSVDVQALRRLFEAVPQLGGAAPQAPAAHQKPEASVEQAFGELTRVSTEVAQLKEQTLARLLDIEEAVHKALSSMSSLQPEASARGHFQGPPKDHSAHKISVTVSSSARPSGSGQEVGGQTAVKNQAKVECHTEAQSQVKIRNHTEARGHTASTAPSTRRQETSREYLCPPRVLPSSRDSPSSPTFISIQSATRKPLETPSFKGNPDVSVKSTQLAQDIGQALLHQKGVQDKTGKKDITQCSVQPEPAPPSASPLPRGWQKSVLELQTGPGSSQHYGAMRTVTEQYEEVDQFGNTVLMSSTTVTEQAEPPRNPGSHLGLHASPLLRQFLHSPAGFSSDLTEAETVQVSCSYSQPAAQ

SEQ ID NO: 919142 - protein, 156 aa, Homo sapiens
ETAACHNQSHCFLQMGNLMPKEKKSRSQAFCSLLCLTNAILANLMSALARAGEPLKETGPLLKRKSQRNALAGLEGAMPYCGKGHMAETSSQPLGAGNGLTDSQQGKLDEIVLVKSVKPVKRTRKRDSDHLELWQCLARILLKIGCHGKLNFASQF

SEQ ID NO: 919143 - protein, 360 aa, Homo sapiens
MGCQASWLRRKLRGKRRPVIAFCLLMILSAMAVTRFPPQRPSAGPDPGPMEPQGHVVLLREDEVGDPGTKDLGHPQHGSPIQETQSEVVTLAPPWLTDHDVQMLRLLAQGEVVDKARVPAHGQVLQVGFSTEAALQDLSSPRLSQLCSQGLCGLIKRPGDLPEVLSFHVDRVLGLRRSLPAVARRFHSPLLPYRYTDGGARPVIWWAPDVQHLSDPDEDQNSLALGWLQYQALLAHSCNWPGQAPCPGIHHTEWARLALFDFLLQGCSVGLFLSCQPLLWGQVSVAKAYTVEEVAKEPKSKSGGSKSSAMSSDRSLAENGAMAEEKPTPQMNGTPGDDRAPSHSESALNNDSKMCNTNPH

SEQ ID NO: 919144 - protein, 360 aa, Homo sapiens; identical to SEQ ID NO: 919143

SEQ ID NO: 919145 - protein, 167 aa, Homo sapiens
QSYLILWSPWVSEKKHYMGHTTVGGDCGGGAGGGGGGDGGSGGGGGGGGSDGGDGGGGGGGDGGGGGGGGSDGGDGGGGDGGGDDHGGDTDNDGGGNGSGDVGGGDGDNGGDGSHGGDGCDGDSGGDGEGDDDVDGGGDVGNDGDGNGDCTQIPKYELKTLTGMLDT

SEQ ID NO: 919146 - protein, 250 aa, Homo sapiens
DGKSPVRMLTCLGTMLLEALDCILPPTRPTDKPLHLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 919147 - protein, 413 aa, Homo sapiens
MGKEKTHTNIVVIGHIDSGKSTTTGHLIYKGGGIDKRTIEKFEKEAAEMGKGSFKYAWVLDKLKAECEHGITIDTSLWKFETSKYYVTIVDAPGHRDFIKNMITETSQADCAVLIVAAGVGEFEAGISKNGQTQEHALLAYTLGVKQLIVGVNKMDSTEPPYSQKRYEENLLTCLGTMLLEALDCILPPTRPTDKPLHLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 919148 - protein, 430 aa, Homo sapiens
MGRRCCRRRVLAAACLGAALLLLCAAPRSLRPAFGNRALGSSWLGGEKRSPLQKLYDLDQDPRSTLAKVHRQRRDLLNSACSRHSRRQRLLQPEDLRHVLVDDAHGLLYCYVPKVACTNWKRVLLALSGQARGDPRAISAQEAHAPGRLPSLADFSPAEINRRLRAYLAFLFVREPFERLASAYRNKLARPYSAAFQRRYGARIVQRLRPRALPDARARGHDVRFAEFLAYLLDPRTRREEPFNEHWERAHALCHPCRLRYDVVGKFETLAEDAAFRSWRSCGHAGQVPFRQDPRGMQVLPAPGPLFKSHCVHSPGRRASGRRAHLARLGGSPSQVALHACACLGLSPEACFLHLLQLTGTSPGPCGPSLCPPHLAHPGKDSCGQGRKPSLGWPHDGAVPGASSAKPWALCCLPPLCVCDCESVHECVSI

SEQ ID NO: 919149 - protein, 159 aa, Homo sapiens
VTMSDERAREGEEFLLGSEMKEEEPSLKGRPLPCSQVNPFRDRICRVFSHKGMFSFEDVLGMASVFSEQACPSLKIEYAFRIYDFNENGFIDEEDLQRIILRLLNSDDMSEDLLMDLTNHVLSESDLDNDNMLSFSEFEHAMAKSPDFMNSFRIHFWGC

SEQ ID NO: 919150 - protein, 185 aa, Homo sapiens
MGQCLRYQMHWEDLEEYQALTFLTRNEILCIHDTFLKLCPPGKYYKEATLTMDQVSSLPALRVNPFRDRICRVFSHKGMFSFEDVLGMASVFSEQACPSLKIEYAFRIYDFNENGFIDEEDLQRIILRLLNSDDMSEDLLMDLTNHVLSESDLDNDNMLSFSEFEHAMAKSPDFMNSFRIHFWGC

SEQ ID NO: 919151 - protein, 261 aa, Homo sapiens
MSFPCLQSGLGNPERPVLGQQFIEQSDAWAWLPLVGVARRMRALWQSCKNALGGWDPGVGDMAVEPAGLGPTLPMGYGLLAYCHFLNGLSPFGPTELRCNPGQFACRSGTIQCIPLPWQCDGWATCEDESDEANCPDAPGGPHLSVLLGQLPRSPSVWENQSLSPVSPCCVPVLGKQQRGTLVVLEAGGAHVLRAAQVMEPRVGADVALGATVTPAPGPQLGCEAGLLGPHGPGGGGRGPPAYQRLALRGKRDILYCQRQA

SEQ ID NO: 919152 - protein, 145 aa, Homo sapiens
MTKGEIRRSLIRLFELQVTVIRFELASSKGKFTSWVLILLIKKIEKSNKESSKDVVGYRKKLAPEDLHAARTHSLPINYGQGSGTMKESAVPVGITGFEVGGWKEQHPEVEETSFILRRREAYLADKIIGFLYRWINYLPTHPPP

SEQ ID NO: 919153 - protein, 189 aa, Homo sapiens
MCFENMRIMRYEEFISMIFRLDYTQPLSDEYITVTDTTFVDIPVRLYLPKRKSETRRRAVIYFHGGGFCFGSSKQRAFDFLNRWTANTLDAVVVGVDYRLAPQHHFPAQFEDGLAAVKFFLLEKILTKYGVDPTRICIAGDSSGGNLATAVTQQKGNIMGRKTILFLIAGVLGAYYVYTPLSDNIEELW

SEQ ID NO: 919154 - protein, 134 aa, Homo sapiens
SEGWKDKMRVPEWSFLVRLLSFSTDGPLCAVSSHGLCSVSAHPWYLSSYRAVLLKLANLCAPFPEDLPGSLGKPKRDSISHNATGWFTQNKAPLLYLRVPGVKDYSAASTAGERGDLCPQVTATQQIAPNEDGE

SEQ ID NO: 919155 - protein, 288 aa, Homo sapiens
MGLGRRQLWHSEQGHQKPLHSSGSCRERGPRNLVYQQKGKHKIITNSLGCLGKNRRYHGPHSGKNFCFPMEPQELKENKSLSKSKALSAFKGALGGGSFITPTGFCYIFSRDNGFSLPTALMSNSESPKEPEQLQKLFIGELSFETTDESLRSHSEQWGMLMDCVVMRDPNTKCSRGFGFVTYATVEEVDAAMNARPHKVDGRVVEPKSYWTPQGVQGPKMDLLKVAQRARYEIGDRLTAQYYPRSGPLSKVSYLGRRSNGNVLWMFPIPHSGKVTGQGAPCEKGAGY

SEQ ID NO: 919156 - protein, 298 aa, Homo sapiens
FLSPWAAALRLPWPWSSGSWAGGGSLVALTSPGGEGGPAMTLLTDATPLVKEPHPLPLVPRPWFLPSLFAAFNVVLLVFFSGLFFAFPCRWLAQNGEWAFPVITGSLFVLTFFSLVSLNFSDPGILHQGSAEQGPLTVHVVWVNHGAFRLQWCPKCCFHRPPRTYHCPWCNICVEDFDHHCKWVNNCIGHRNFRFFMLLVLSLCLYSGAMLVTCLIFLVRTTHLPFSTDKAIAIVVAVSAAVLLVPLSLLLLIQALSVSSADRTYKGKCRQPFRDNKPLPTRGCAKQLVFNQFVPPWD

SEQ ID NO: 919157 - protein, 263 aa, Homo sapiens
FLSPWAAALRLPWPWSSGSWAGGGSLVALTSPGGEGGPAMTLLTDATPLVKEPHPLPLVPRPWFLPSLFAAFNVVLLVFFSGLFFAFPLVSLNFSDPGILHQGSAEQGPLTVHVVWVNHGAFRLQWCPKCCFHRPPRTYHCPWCNICVEVSAPLPVHQPSPHIWLGPGASLIQGPGLGVKLFSGLLKAKGGSNSQPPLVTHVFSTCTCPGRLAVACRGADMHRASASVLGWVRPGEERQPSVPPLGSLTRDTQAPQAGCPPGL

SEQ ID NO: 919158 - protein, 294 aa, Homo sapiens
FLSPWAAALRLPWPWSSGSWAGGGSLVALTSPGGEGGPAMTLLTDATPLVKEPHPLPLVPRPWFLPSLFAAFNVVLLVFFSGLFFAFPCRWLAQNGEWAFPVITGSLFVLTFFSLVSLNFSDPGILHQGSAEQGPLTVHVVWVNHGAFRLQWCPKCCFHRPPRTYHCPWCNICVESYSRMCLTEGQASLLSKGLLQDFDHHCKWVNNCIGHRNFRFFMLLVLSLCLYSGAMLVTCLIFLVRTTHLPFSTDKAIAIVVAVSAAVLLVPLSLLLLIQALSVSSADRTYKGKAVWIL

SEQ ID NO: 919159 - protein, 155 aa, Homo sapiens
RRKKGVKMMRAQRNFSHCLPDSFFLGYPYSSPYLHPKELYLASKRGILRIQPHGGWRLVPTGRDDGQTKTTAVHFIQPIGCLVHRHSTIIHTPEECVDKDHGRLAIHVPILPFICSVLELILSSLALWLFVRFCQGDKSRKIGLEQKAAEGSLLC

SEQ ID NO: 919160 - protein, 151 aa, Homo sapiens
MTEAFGRPIANIKNEERQSKEIENYKSLLKEREDTNKWKNIPCSWIGRINIVKMAILPKVIYRFNAISIKIPLIFFTELEKNYFKIHMKPKKSLYSHDDPKQKEQSWRHHITQLQTVLQGYTFTVHIYGNKEMYTRIQILLSYTNRDDWLV

SEQ ID NO: 919161 - protein, 141 aa, Homo sapiens
MSHIQLLSAFESHRTTCRKNSREFGKKGGEDRQKMHFSFKKQENVRKIEGVLKCVCCCLTQGFWGPLSDGLAAPLRPCLPGSWYSGSELQPHQPLLNDSITPSSIPFTFQTATHLLLINYLVTLATCEPFGAHISHGFMKE

SEQ ID NO: 919162 - protein, 178 aa, Homo sapiens
RGGQRVRPGRGGRRGRAAASMERELEALAARLARPAEPPFQALVEAAGGRGQVLLVGELWEREQSRALLRDFARAGGEGGWGGGGGGGGGGAIRSPLVFVLCRASSLAAREPRRRLREMLRDVRGRRRAGAALVGVLVAEAGPEDAVAPGLRLLEALKLVLNKDYEQGFSLFWLPEVF

SEQ ID NO: 919163 - protein, 172 aa, Homo sapiens
GLPEEQIMTAGEKKATQLQRPAPNPSKTVSLLGDLNVSVKGIICNSILSGNSQDWMKEDRVRGFIPNHGHVGDKDEQVVLGDGFEKGCDLGDSWWTVASLPLSNLHSVDQPLNSYCPLGIAFLDASRQCSYLAVWFHQELYPKEETARRTFALFVGGKWSSYKQIFRHLRNC

SEQ ID NO: 919164 - protein, 172 aa, Homo sapiens; identical to SEQ ID NO: 919163

SEQ ID NO: 919165 - protein, 172 aa, Homo sapiens; identical to SEQ ID NO: 919163

SEQ ID NO: 919166 - protein, 137 aa, Homo sapiens
MDEAGIHSQQTNTGTENQTLHVPTHKWELSNENTWTQGGEHHTLGPVRGWGARGGVALGEVPNVDDGLMGAANPHGTCIPRVAFGNCNGLAVVDFIQKTVLLSMGTIDLYRSSDLYQRQPRSPRKNKQFIAGKSVKL

SEQ ID NO: 919167 - protein, 151 aa, Homo sapiens
MVLLGPRALQSIYVECCLGLTLQGNGLPSVPHTADTEMLSKSPRPGTGDPQGAVWCSVPLWLTWYLIFGSYEDMAECWKKVKKVPGVKDEVRRKNQSSEGSNAHSHQPLTYCCTIPFLTGHRLVQVRNHGDPCKLEIFSTTTLTHPTTLSS

SEQ ID NO: 919168 - protein, 146 aa, Homo sapiens
MHKPFDSGIQIYSDACQKPRKPGVAQEVWLGLRAFPSGPAGRDPGRAAAVASRAAFSQAGTMRPLLCALAGLALLCAVGALADGREDRGSPGDTGERPAGPARGPGLEPARGTLQPRPRPPRKRWLLSPGAGAQQLEVVHLPGSTL

SEQ ID NO: 919169 - protein, 147 aa, Homo sapiens
HILICMFYKGMSDGFAVIHAICTFSIKMENGYCLFTSLSLSSLTWQFFLPPWKPELSQKHLTVNTLCDPFIQVAFTYLPFRLLLTSLSSILSSTELKSPPLSFGVCLEVEHSSPPALGHQNTRFFGLWTLGLAPVAFWGLLGLWPQS

SEQ ID NO: 919170 - protein, 445 aa, Homo sapiens
GGAEQGGGLRAPPQLWTNGYWGRLLQAGPGGGLGLVSGEPGGPGEPPGGGDPGGGSGGFPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAMMMLRSRFLDARRKRRNFSRQATEVLNEYFYSHLSNPYPSEEAKEELAKKCGITVSQVSNRFGNKKIRYKKNIGKFQEEANIYAVKTAVSVTQGGHSSTSSPTPPSSAGSGGSFNISGSGDMFLGMPGLNGDSYSASQVASLRRSMGPGGYGDNLGGGQMYSPREMRANGRRQEAVTPSSVTSPTEGPGSVHSDTSN

SEQ ID NO: 919171 - protein, 296 aa, Homo sapiens [sequence omitted]

SEQ ID NO: 919172 - protein, 277 aa, Homo sapiens
FFLSLRSASFSQGSEAPFIMRRNTAMQNLAQHSGYSVDGVSGHIHGFHSLSKPSQHNAEFRGSTHRIPWSLASHGHTRGSLTGSEADNEGVYPFKAPRSTLFQEFGGHLVNNSGVPATPLSVHQIPRTVTLDKNLYAMVVATPGPIASLPLPKASQAEACQWGSPQQRPLVSESSRWSVAAAIPRRNTLPAVDNSRCHQGLKVISGKDEPHPEVLDPGAGIQEGHCVGNTGAGPGSPGGVVVGSRDVLELPPASTPSMVEGMPAGLLSPCMRESVLS

SEQ ID NO: 919173 - protein, 160 aa, Homo sapiens
RKQQWLGSRLGGCGGEVGATSALAPKIGPLGLSPKKVGDDIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 919174 - protein, 446 aa, Homo sapiens
MASAKLNTLLQTKVIENQDEACYILGKLEHVLSQSIKEQTEIYSFLIPLVRTLVSKIYELLFMNLHLPSLPFTNGSSSFFEDFQEYCNSNEWQVYIEKYYEAHTFYDGHENMALYWKDCYEALMVNMHKRDREGGESKLKFQELFVEPFNRKARQENLRYNNMLKQLSSQQLATLRRWKAIQLYLTCERGPWAKSDEKEEQDQKEKLVLMEDCELITIIDVIPGRLEITTQHIYFYDGSIEKEDGVGFDFKWPHSQIREIHLRRYNLRRSALEIFHVDQSNYFLNFKKEKWVNREISNFDYLIQINTMAGRTYNDLAQYPVFPWILQDYTSEELDLNNPAVFRDLSKPIGVVNEKNAKAMREKYENFEDPMGTIDKFHYGTHYSNSAGVMHYLIRVEPFTTLHIQLQSGRSDLELNLRHHRRVKPIQCLCLCSPKNMYHEEWKEEQ

SEQ ID NO: 919175 - protein, 446 aa, Homo sapiens; identical to SEQ ID NO: 919174

SEQ ID NO: 919176 - protein, 107 aa, Homo sapiens
MHTSLAHSSSSHSCSARSWNSTKRYALSNAIDRDREAGRGTTGAELIPGGEVFDSLLMRHRSLARELSGTIKEILGTAQSVGCNVDGRHPHDIIDDINSGAVECPAS

SEQ ID NO: 919177 - protein, 446 aa, Homo sapiens; identical to SEQ ID NO: 919174

SEQ ID NO: 919178 - protein, 446 aa, Homo sapiens; identical to SEQ ID NO: 919174

SEQ ID NO: 919179 - protein, 859 aa, Homo sapiens
MGPEGNGWALGCPRVLEGTGCSGFAQVQEGPATALPPPREAPPGTGVPGIGGDPRGFRSPASAMHCLLGALGEPRGRLGEMGWSPPGGGGAGPGRRREESRGGGAARSPSPPARRPAGPSRGAQSCEPLAPPPLRPGPPCRCGEWGWGPSGAWAGAWARGSPSSVATDGRRDSRDRRCPRARRAGLSFPGADGRAGAAAAAGDVRGTRPRTRGGRRGVSGRRAQLPGPAALDTAPGPWRLGPQVLPAAGSPLPSRPLRAPCVRATLLLSGLPSAGPRTAARPAPLRPSRAFPTNGADPAGGAPAAQGLAAFPVHPPTSPVPASVGGFPGTPEGWQGRIRSPPFPPRRAGPWVTPPSLHLRCPCLPPTTCPSNLGTLWGKCRSMGLSLHSPWGLDLQPDQPSGQPRRLHGLPVSPGTLLLPLGGQRHLSARLALEGHSAVPRALSPQVSTGEGGAGVLAAPGGKKTVYRSLCLALALLVAVTVFQRSLTPGQFLQEPPPPTLEPQKAQKPNGQLVNPNNFWKNPKDVAAPTPMASQGPQAWDVTTTNCSANINLTHQPWFQVLEPQFRQFLFYRHCRYFPMLLNHPEKCRGDVYLLVVVKSVITQHDRREAIRQTWGRERQSAGGGRGAVRTLFLLGTASKQEERTHYQQLLAYEDRLYGDILQWGFLDTFFNLTLKEIHFLKWLDIYCPHVPFIFKGDDDVFVNPTNLLEFLADRQPQENLFVGDVLQHARPIRRKDNKYYIPGALYGKASYPPYAGGGGFLMAGSLARRLHHACDTLELYPIDDVFLGMCLEVLGVQPTAHEGFKTFGISRNRNSRMNKEPCFFRAMLVVHKLLPPELLAMWGLVHSNLTCSRKLQVL

SEQ ID NO: 919180 - protein, 256 aa, Homo sapiens
MEGNNCSSLPFRSGGRGLTDQVLPWLPPLASRSHQRTVASGQGRGRHLVGLMLQLLVFSSGERTGPYTQVLRAVGGSQTPKARGNELSGPKPSLKHWVHSAPETPFHGKRDVGKELRSSRGDGLDISVDPAAIKAGEDVEARNSAFLFWPLKEADTQDSREPRREKPRRKKRPAKQPLQQAAPSDSDGSSHGISSHGSCQGTHPEPRTAHLHFPAAGRLGLSSHAIIATPPPRAALPCTLQATHSSKGLRSVPETL

SEQ ID NO: 919181 - protein, 256 aa, Homo sapiens; identical to SEQ ID NO: 919180

SEQ ID NO: 919182 - protein, 155 aa, Homo sapiens
MSTIGSFEGFQAVSLKQEGDDQPSETDHLSMEEEDPMPRQISRQSSVTESTLYPNPYHQPYISRKYFATRPGAIETAMEDLKGHVAETSGETIQGFWLLTNTPRQGKAKTTTMRTQKQKSQLPQQQPQNKKTKENKQTCRPRKNGSIKPAPRRTS

SEQ ID NO: 919183 - protein, 155 aa, Homo sapiens; identical to SEQ ID NO: 919182

SEQ ID NO: 919184 - protein, 114 aa, Homo sapiens
NPFMGVEDRNLSVCGGAESSMMKRLESYPPQTGGTELLVPKGFVNLALGERERLHSACSARCGTADAREAGDWSCFMEAVSLSPELTGLRHLAKVPPAEECQQLGVLKDSRLCL

SEQ ID NO: 919185 - protein, 157 aa, Homo sapiens
MSTIGSFEGFQAVSLKQEGDDQPSETDHLSMEEEDPMPRQISRQSSVTESTLYPNPYHQPYISRKYFATRPGAIETAMEDLKGHVAETSGETIQGFWLLTKTDPLSQHQGEHLDTLWNFKKYDMMAIKWLFSRMYLRCLCLQWLKRQEETASSLHTR

SEQ ID NO: 919186 - protein, 138 aa, Homo sapiens
MMVFTPGLRPLLSTISKAERELPTPSDLLPTNMETVASVVVADESTEPGLAAGKLVKEVLENMEKGGCQRMGKDRRELGTQNLNSVSLGYVLWKTPMSYPSKIKWTGDKMDLYLGRKNGARDRNLKVINFCTGYHGIR

SEQ ID NO: 919187 - protein, 181 aa, Homo sapiens [sequence omitted]

SEQ ID NO: 919188 - protein, 303 aa, Homo sapiens
MSVHQIRKHAVLPPIICRSDKEFLESVQRYIITETERLGCSEEGPADEYYIIYRNVFDKVIEHITAYKSILTSIKKEYDAFIETIKKDRRTTFCLHGKLKGLAAEPTALVYYRKRTIQLEAKMRIIESNSSKIQSQIDHIKQCRAEYDTKEVKYCTFSKDPSKPIPGMTLQESMNLDALTKYMKHLEDKYAEIKQAMLIKYVPAQRKADLDEEMIVLLKRRDVAENLNKKLQFCHQRLQIISQALSSWVKSDMSSPFQDFVEQIQKTKYLQGDQGIVEELMEDDPRRAKEAEIMLHYIERQIF

SEQ ID NO: 919189 - protein, 390 aa, Homo sapiens
LLDTVPGAAPTRPRPLSPSFRETLGPPLEVAGRRDRRRDRRSEARGAAMEPVSTGAEAGMEGAGGDPYRRPARRTQWLLSALAHHYGLDRGVENEIVVLATGLDQYLQEVFHHLDCRGAGRLPRADFRALCAVLGLRAEGATTAGQAAGDGNSRDVTPGDAAAELATDGDSDTDEEARLALRAEPPELTFRQFHARLCGYFGTRAGPRLPRGALSEHIETQIRLRRPRRRRRPPCAPGPDSGPDCERVARLEEENSSLRELVEDLRAALQSSDARCLALQVGLWKSQASTHEMGHGGPEAAVRELRQAQGALAAAEARAGRLRRGQAEVRRRAEEARQVVLRSLHRVRELEALAQQVPGLQRWVRRLEAELQRYSVAQRLSGKGRTHSPA

SEQ ID NO: 919190 - protein, 138 aa, Homo sapiens
MRTESCALKVESAYTCCFYVTKRLIPGGRLWKMKRLDLEPRAPAKGPEFHNKLYSRVAGVGEIFVVIWSNAETMTTRGQTFYITPLERRNPSLGFFNWGKTREVVYPVNGWARIKIGFYITPKSTLFSLRTLLAVSYL

SEQ ID NO: 919191 - protein, 138 aa, Homo sapiens; identical to SEQ ID NO: 919190

SEQ ID NO: 919192 - protein, 677 aa, Homo sapiens
MCSQALRVSSQLVSAGEPTSTSLSGGAGQVRGQGSAGIAFILSHDCQHPFVPDHVSDSTVSARISDNSLAPVADFSYPAESSSCLDNSAAKHKLQVKPRNQRSSKMRRLSSRAQSESLSDLTCTPEEEENEEKPLLEVSPEERPSSGQQDVAPDRGPEPGPPAPLPPPGGARARRARLQHSSALTASVEEGGVPGEDPSSRPATPELAEPESAPTLRVEPPSPPEGPPNPGPDGGKQDGEAPPAGPCAPATDKAEEVVCAPEDVASPFPTAIPEGDTTPPETDPAATSEAPSARDGPERSVPKEAEPTPPVLPDEEKGPPGPAPEPEREAETEPERGAGTEPERIGTEPSTAPAPSPPAPKSCLKHRPAAASEGPAASPPLAAAESPPVEPGPGSLDAEAAAPERPKAERAEAPPAGAERAAPERKAERGGAELRGAKKFSVSSCRARPRPGVSRPLERASGRLPLARSGPVWRSEAALDDLQGLPEPQHAKPGPRKLAERGPQDSGDRAASPAGPRKSPQEAAAAPGTREPCPAAQEPAPSEDRNPFPVKLRSTSLSLKYRDGASQEVKGVKRYSAEVRLERSLTVLPKEEKCPLGTAPALRGTRAPSDQGKGKARPPEPLSSKPPLPRKPLLQSFTLPHQPAPPDAGPGEREPRKEPRTAEKRPLRRGAAAQNAV

SEQ ID NO: 919193 - protein, 828 aa, Homo sapiens
MCSQALRVSSQLVSAGEPTSTSLSGGAGQVRGQGSAGIAFILSHDCQHPFVPDHVSDSTVSARISDNSLAPVADFSYPAESSSCLDNSAAKHKLQVKPRNQRSSKMRRLSSRAQSESLSDLTCTPEEEENEEKPLLEVSPEERPSSGQQDVAPDRGPEPGPPAPLPPPGGARARRARLQHSSALTASVEEGGVPGEDPSSRPATPELAEPESAPTLRVEPPSPPEGPPNPGPDGGKQDGEAPPAGPCAPATDKAEEVVCAPEDVASPFPTAIPEGDTTPPETDPAATSEAPSARDGPERSVPKEAEPTPPVLPDEEKGPPGPAPEPEREAETEPERGAGTEPERIGTEPSTAPAPSPPAPKSCLKHRPAAASEGPAASPPLAAAESPPVEPGPGSLDAEAAAPERPKAERAEAPPAGAERAAPERKAERGGAELRGAKKFSVSSCRARPRPGVSRPLERASGRLPLARSGPVWRSEAALDDLQGLPEPQHAKPGPRKLAERGPQDSGDRAASPAGPRKSPQEAAAAPGTREPCPAAQEPAPSEDRNPFPVKLRSTSLSLKYRDGASQEVKGVKRYSAEVRLERSLTVLPKEEKCPLGTAPALRGTRAPSDQGKGKARPPEPLSSKPPLPRKPLLQSFTLPHQPAPPDAGPGEREPRKEPRTAEKRPLRRGAEKSLPPAATGPGADGQPAPPWITVTRQKRRGTLDQPPNQEDKPGARTLKSEPGKQAKVPERGQEPVKQADFVRSKSFLITPVKPAVDRKQGAKLNFKEGLQRGISLSHQNLAQSAVMMEKELHQLKRASYASTDQPSWMELARKKSQAWSDMPQIIK

SEQ ID NO: 919194 - protein, 716 aa, Homo sapiens
MCSQALRVSSQLVSAGEPTSTSLSGGAGQVRGQGSAGIAFILSHDCQHPFVPDHVSDSTVSARISDNSLAPVADFSYPAESSSCLDNSAAKHKLQVKPRNQRSSKMRRLSSRAQSESLSDLTCTPEEEENEEKPLLEVSPEERPSSGQQDVAPDRGPEPGPPAPLPPPGGARARRARLQHSSALTASVEEGGVPGEDPSSRPATPELAEPESAPTLRVEPPSPPEGPPNPGPDGGKQDGEAPPAGPCAPATDKAEEVVCAPEDVASPFPTAIPEGDTTPPETDPAATSEAPSARDGPERSVPKEAEPTPPVLPDEEKGPPGPAPEPEREAETEPERGAGTEPERIGTEPSTAPAPSPPAPKSCLKHRPAAASEGPAASPPLAAAESPPVEPGPGSLDAEAAAPERPKAERAEAPPAGAERAAPERKAERGGAELRGAKKFSVSSCRARPRPGVSRPLERASGRLPLARSGPVWRSEAALDDLQGLPEPQHAKPGPRKLAERGPQDSGDRAASPAGPRKSPQEAAAAPGTREPCPAAQEPAPSEDRNPFPVKLRSTSLSLKYRDGASQEVKGVKRYSAEVRLERSLTVLPKEEKCPLGTAPALRGTRAPSDQGKGKARPPEPLSSKPPLPRKPLLQSFTLPHQPAPPDAGPGEREPRKEPRTAEKRPLRRGAGKSPPRVREGQGLGRSTSTGTSCWTLAKCSWYKLCCRGIGRSQNS

SEQ ID NO: 919195 - protein, 152 aa, Homo sapiens
NPPGGMNNSRRAALRAVTLTTKVCSFTPEPVRPRTHQKEETPNTSEHQKEQTPDMPPLRTVTLTARVCGFVLEVSKYCGLGLQMNHSIESKGNEITLLFMSGIHVSGRGFLASYSVIDKQGTQTDSSRKQLDCIPAWATEQDSEKERGRKKE

SEQ ID NO: 919196 - protein, 182 aa, Homo sapiens [sequence omitted]

SEQ ID NO: 919197 - protein, 423 aa, Homo sapiens
MDPCTGGNGCVHICQSENGTARCACHAGYQLPEDKNICEDINECAEGLSYCGHCCVNSMGSFTCACQTGFELGADRKQCYSNWQQSQPRLYLSLSDFFLLFPVHDYTLPDLDECENGEACCAQLCINYLGGYKCRCQEGFQITSNGCECDGKFLRFNNCEEGYRIGNDRKTYPSLDDDELEEEEEEGEVVRFPGLLFKSPPQQLHYVATFLPPTYKDEEDEEEEEKDIHRELTALHNFVCLDHIFGHNCSLSCKDCMNGGKCQEGKSECSCPAGCRVILCNENCLEDAYGAGCTSECQCVEENTLECSAKNGSCTCKSGYQGNRCQKDGLWGPEGWFSSAPCENGGQCNKKTGNCDCTPDYTRKSCTILRCISLTNLALSRRSSPMKYQQNVSSHREVRQRQQCSSDRPFKKLLCKFSFKIGM

SEQ ID NO: 919198 - protein, 164 aa, Homo sapiens
HPTLVDARLLRLHPVLLIQQECMFPITSHDHWLSRWLGTLAGRPAPPQAPVPLDGAPRGTLRTQRTQRLPSSKFPADPGHPLKEGARGCHKAHLITPSKDSQQTSSAWDLPTTKPGWEVGGSEGRWRGRVPEQGKDNQLFPFLVSEAKKPEGLVVVLALGLLTL

SEQ ID NO: 919199 - protein, 164 aa, Homo sapiens; identical to SEQ ID NO: 919198

SEQ ID NO: 919200 - protein, 206 aa, Homo sapiens
MKRVHGHTGMSVQLLLPRAFTSRPAWKSLLRVSFPFYGNFNRRGPKRQTVKMEFWNWIINQPPGNEDIIPRSKWSTDTTWRAVAAKVKTFTRAEVVMGYRHFWLFVTILAWVIDPAHQKKEEDPIPINVTHQEEDPIPINVTHQEEDPIPINVTHQEEDPIPINVTHQEEDPIPINVTHQEEDPIPINVTHQEEDLIPINVTHQEL

SEQ ID NO: 919201 - protein, 232 aa, Homo sapiens
MVATCLQVVGFVTSFVGWIGVIVTTSTNDWVVTCGYTIPTCRKLDELGSKGLWADCVMATGLYHCKPLVDILILPAPSAQPLSNSRPGLSGLPGLGNVTLIPARAQGHLRCPRYPRPCCGRVRLRGCGDAGSRSAPLGWIGTSGRSSEGGLHWGDTERAAEGRSPPPLQRYVQACRALMIAASVLGLPAILLLLTVLPCIRMGQEPGVAKYRRAQLAGVLLILLDASFISTF

SEQ ID NO: 919202 - protein, 232 aa, Homo sapiens; identical to SEQ ID NO: 919201

SEQ ID NO: 919203 - protein, 173 aa, Homo sapiens
MEFLRSHPVRVLLTGPSGHPYLCTHTVVHEYYMYLNYPWHGGLQFLPSEGPFNLGPQPPPRPLPQCPQAARHFNYSWHGGLKVLPGEGSPHWDLQSLLLVELIPGRIQISVSLRAPAGVAAGPSWEVPPSEEEWIGDPLKEAVWPHFGRAAVLRGGSLLPSVGLGSQKPNRLE

SEQ ID NO: 919204 - protein, 35 aa, Homo sapiens
MEVSTSCPVWVFSTQASSHPPLCEASDGYLSVEFC

SEQ ID NO: 919205 - protein, 793 aa, Homo sapiens [sequence omitted]

SEQ ID NO: 919206 - protein, 524 aa, Homo sapiens
IFDNCQNTLFLKKDIWNCLKNYLPSIIIFLKILHWKLKKQKISNIMNIYSKRLQCDFLFQFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPQNFPANDKEPWLVDFFAPWCPPCRALLPELRRASNLLYGQLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYQYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 919207 - protein, 793 aa, Homo sapiens [sequence omitted]

SEQ ID NO: 919208 - protein, 793 aa, Homo sapiens [sequence omitted]

SEQ ID NO: 919209 - protein, 793 aa, Homo sapiens [sequence omitted]

SEQ ID NO: 919210 - protein, 304 aa, Homo sapiens
HKEDLMLFVNSLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYQYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 919211 - protein, 793 aa, Homo sapiens [sequence omitted]

SEQ ID NO: 919212 - protein, 300 aa, Homo sapiens
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLVSINHFVKLYHHVKKHI

SEQ ID NO: 919213 - protein, 332 aa, Homo sapiens
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILLLH

SEQ ID NO: 919214 - protein, 793 aa, Homo sapiens [sequence omitted]

SEQ ID NO: 919215 - protein, 793 aa, Homo sapiens [sequence omitted]

SEQ ID NO: 919216 - protein, 483 aa, Homo sapiens
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPLVSTMSSFTTRVTKSIKSSLWSA

SEQ ID NO: 919217 - protein, 559 aa, Homo sapiens
IDGVFMSTGNFVNSIQTAFAAGIGWLITFCSKGGDCLTSQTRLRLSGMLDGLVNVGWMDCATQDNLCKSLDITTSTTAYFPPGATLNNKEKNSILFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPQNFPANDKEPWLVDFFAPWCPPCRALLPELRRASNLLYGQLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYQYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 919218 - protein, 322 aa, Homo sapiens
MSFWVSIVSPYTARKNSLRVSKYNPARAELKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYQYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 919219 - protein, 518 aa, Homo sapiens
MPLKHYLLLLVGCQAWGAGLAYHGCPSECTCSRASQVECTGARIVAVPTPLPWNAMSLQILNTHITELNESPFLNISALIALRIEKNELSRITPGAFRNLGSLRYLSLANNKLQVLPIGLFQGLDSLESLLLSSNQLLQIQPAHFSQCSNLKELQLHGNHLEYIPDGAFDHLVGLTKLNLGKNSLTHISPRVFQHLGNLQVLRLYENRLTDIPMGTFDGLVNLQELALQQNQIGLLSPGLFHNNHNLQRLYLSNNHISQLPPSIFMQLPQLNRLTLFGNSLKELSLGIFGPMPNLRELWLYDNHISSLPDNVFSNLRQLQVLILSRNQISFISPGAFNGLTELRELSLHTNALQDLDGNVFRMLANLQNISLQNNRLRQLPGNIFANVNGLMAIQLQNNQLENLPLGIFDHLGKLCELRLYDNPWRCDSDILPLRNWLLLNQPRLGTDTVPVCFSPANVRGQSLIIINVNVAVPSVHVPEGLTAFSVPGPEPGAGVQSCLQRHHSKTAVPRAQSGGCN

SEQ ID NO: 919220 - protein, 179 aa, Homo sapiens
WKFRLKWVPYRMSSCTACGSPGQHLNLLAAVISVRRVPLTGRMAGGSLQRFGDQHPDPLPRSEQPTTDFSVAGSVIRLSSNTSSQGKPFLAPCGGSYRHCPETTSQESRYVQVGAGLSQTLADTAYVVQPKCKHASSGHAPQGGGPVSKPRAAKRRGMPCATHGLTLLTVPVVSKCTHV

SEQ ID NO: 919221 - protein, 303 aa, Homo sapiens
TLESCYLNSSGKKKGLFLIMGSLGYVFISSMKTSKLVPVEWGVAEKIPDDFGTGDLLNGFDKNADSDMNSKIQTEVVSDGDEELVGNWSKGDSYYVLAKRLEAFCPCPRDLWNFELERDDLGYLAEEISKQKSIQEVTWVLLKAFHFKSGAVRRGPPSSRPQNGRSTDSLPCAPGKAADNQCQPIKAVKREALPCKATGAELPKTMGTPSCISVTWIWNIGIKEKARNEAEMGYVPLTNEGSSLICEVSAKLAERHPQSGNQAEEKTHMPTSPAKEPLRATAQRMSEPGHPRTGLPILQETPN

SEQ ID NO: 919222 - protein, 243 aa, Homo sapiens
MLFWESEFRALLPDPQVELKDHQGSGGSARWCLPDEPSRQVILEALAEFERSTCIRFVTYQDQRDFISIIPMYGCFSSVGRSGGMQVVSLAPTCLQKGRGIVLHELMHVLGFWHEHTRADRDRYIRVNWNEILPGEPGHTQDRLVPGRGQHGLGPSRLVPMGFEINFIKSQSSNMLTPYDYSSVMHYGRLAFSRRGLPTITPLWAPSVHIGQRWNLSASDITRVLKLYGCSPSGPRPRGRGNH

SEQ ID NO: 919223 - protein, 198 aa, Homo sapiens
MGYMTKDNLAIVTQWCEGSSLYKHLHVQETKFQMFQLIDIARQTAQGMDYLHAKNIIHRDMKSNKVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 919224 - protein, 219 aa, Homo sapiens
SLTGGGTDPRHCAWLVCMQGVVSNTLGGQISVVISKGIITTGSTMVEHNYYVSAYRILYSDDGQKWTVYREPGVEQDKDVRNNFLPPIIARFIRVNPTQWQQKIAMKMELLGCQFIPKGRPPKLTQPPPPRNSNDLKNTTAPPKIAKDVALAAVLVPVLVMVLTTLILILVCAWHWRNRNVVEITDECGFMTRSKGADTINMLWKIGRMRMIIKTAAAY

SEQ ID NO: 919225 - protein, 251 aa, Homo sapiens
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKEEVLKDFEDLAGKLPWSNPLEVWKIDASFKKKSKRKKIDQNSSEEKINTGQEVKIDQRTCSKEEFTSHAFRILISIDSSVQIQASKEDVSPFIGDWIRASCKDDNCMKAPPEEHEPHSGERTETHATRTDTNMAKPNRGCT

SEQ ID NO: 919226 - protein, 118 aa, Homo sapiens
MCDIEEATNQLLDVNLHENQKSVQVTESDLGSESELLVTIGATVPTGFEQTAADEVREKLGSSCKISRDRGKIYFVISVESLAQVHCLRSVDNLFVVVQEFQDYQFKQTKVSYPKHGG

SEQ ID NO: 919227 - protein, 151 aa, Homo sapiens
MVIWFGSAFPSKSHLESIIPTCQGRDQVEIWVTHGGNFRHAVLVIPQNGRSTDSLHCMPGKAADTQHQPMKVAGRGAVPCKATGVELPKAMGAHLLPQCNLDATPAMWNCESIKSLRLYKLPSLRYFFIAVRKWANTPILPSFNRNFDTFT

SEQ ID NO: 919228 - protein, 151 aa, Homo sapiens; identical to SEQ ID NO: 919227

SEQ ID NO: 919229 - protein, 179 aa, Homo sapiens
ASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIH

SEQ ID NO: 919230 - protein, 239 aa, Homo sapiens
GTSGTSGTKCGQYAGRDAVPYSDRQGLGRPRAQPPAPLRPGCWRLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRIGVLRTAGASRGKPVCSSPFPIANEKQALRKKPLRLNP

SEQ ID NO: 919231 - protein, 235 aa, Homo sapiens
MAHPKCGQYAGRDAVPYSDRQGLGRPRAQPPAPLRPGCWRLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRIGVLRTAGASRGKPVCSSPFPIANEKQALRKKPLRLNP

SEQ ID NO: 919232 - protein, 358 aa, Homo sapiens
LQLGLTGRAWAFGGALAVVGGQWAMLGAVEGPRWKQAEDIRDIYDFRDVLGTGAFSEVILAEDKRTQKLVAIKCIAKEALEGKEGSMENEIAVLHKIKHPNIVALDDIYESGGHLYLFMQLVSGGELFDRIVEKGFYTERDASRLIFQVLDAVKYLHDLGIVHRDLKPENLLYYSLDEDSKIMISDFGLSKMEDPGSVLSTACGTPGYPLKSWPRSPTARLWIAGPEVSSPTSSKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPPTGCCCRDCSVEPGTPFAGRLWGQPGPL

SEQ ID NO: 919233 - protein, 405 aa, Homo sapiens
LQLGLTGRAWAFGGALAVVGGQWAMLGAVEGPRWKQAEDIRDIYDFRDVLGTGAFSEVILAEDKRTQKLVAIKCIAKEALEGKEGSMENEIAVLHKIKHPNIVALDDIYESGGHLYLFMQLVSGGELFDRIVEKGFYTERDASRLIFQVLDAVKYLHDLGIVHRDLKVGLKGVCLVLPGIFGLLESFLDFLMTAMKPQWLLGIHYFSEGAWSGRRFYQPLTISDCPFSSLLPFKPENLLYYSLDEDSKIMISDFGLSKMEDPGSVLSTACGTPGYPLKSWPRSPTARLWIAGPEVSSPTSSKDFIRHLMEKDPEKRFTCEQALQHPWIAGDTALDKNIHQSVSEQIMISDFGLSKMEDPGSVLSTACGTLGGRQLAVAVETAAWSRAQNCPPHCPTSSRALDLGS

SEQ ID NO: 919234 - protein, 425 aa, Homo sapiens
LQLGLTGRAWAFGGALAVVGGQWAMLGAVEGPRWKQAEDIRDIYDFRDVLGTGAFSEVILAEDKRTQKLVAIKCIAKEALEGKEGSMENEIAVLHKIKHPNIVALDDIYESGGHLYLFMQLVSGGELFDRIVEKGFYTERDASRLIFQVLDAVKYLHDLGIVHRDLKVGLKGVCLVLPGIFGLLESFLDFLMTAMKPQWLLGIHYFSEGAWSGRRFYQPLTISDCPFSSLLPFKPENLLYYSLDEDSKIMISDFGLSKMEDPGSVLSTACGTPGYPLKSWPRSPTARLWIAGPEVSSPTSSKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPPTGCCCRDCSVEPGTPFAGRLWGQPGPL

SEQ ID NO: 919235 - protein, 617 aa, Homo sapiens
SCQDWVLPCKAASSFLAQGQPLLLPYKPSGSTKMYYVPQLRQIPPSPDSKSDTTVESSHSGSNDAIAPDFPAQVLGTRDDDLSATVNIKHKEGIYSKRVVTKASLPVGEKPLQNENADASVQVLITGDENLSDKKQQEIHSTRAVTEAAQAKEKESLQKDTADSSAAAAAEHSAQVGDPEMKNLPDTKAITQKEEIHRKKTVPEEAWPNNKESLQINIEESECHSEFENTTRSVFRSAKFYIHHPVHLPSDQDICHESLGKSVFMRHSWKDFFQHHPDKHREHMCLPLPYQNMDKTKTDYTRIKSLSINVNLGNKEVMDTTKSQVRDYPKHNGQISDPQRDQKVTPEQTTQHTVSLNELWNKYRERQRQQRQPELGDRKELSLVDRLDRLAKILQNPITHSLQVSESTHDDSRGERSVKEWSGRQQQRNKLQKKKRFKSLEKSHKNTGELKKSKVLSHHRAGRSNQIKIEQIKFDKYILSKQPGFNYISNTSSDCRPSEESELLTDTTTNILSGTTSTVESDILTQTDREVALHERSSSVSTIDTARLIQAFGHERVCLSPRRIKLYSSITNQQRRYLEKRSKHSKKVLNTGHPLVTSEHTRRRHIQVHGYRFHLAM

SEQ ID NO: 919236 - protein, 192 aa, Homo sapiens
MTLMVPDTLQVLGKLLWGLNMKMHAKQLSWGLGSVNIATTLIQVTLPSCSGESGPLGNRVSSEDALSKACNIRAASSTGTCHLADTSCPSDWFLCCKAEIKNQNKFCNELKLVRVGAETRIQDFLALEHKFEAAFFTCRSQACISHLFIRPASLITSCNQQTDHNTDSTKEVQRNSVNWGYHRGLQTPNLQQ

SEQ ID NO: 919237 - protein, 153 aa, Homo sapiens [sequence omitted]

SEQ ID NO: 919238 - protein, 151 aa, Homo sapiens
ISQYSLLCQISCYDMNKKYNYLPFSESIMYLSFHILYLNNTHSLMRKQQGTLSVGPYLLGPHRLPSHQALSRLAERVELGASEAASTFATRGCCRTVPGAASAPRGTGAFSTGRVSGAVTQNPQTQSSQTEELMLKRLNKNIQSMKFLLQK

SEQ ID NO: 919239 - protein, 273 aa, Homo sapiens
AGSCFLLVLSMRIFRPWRLRCPALHLPSLSVFSLRWKLPSLTTDETMCKSVTTDEWKKVFYEKMEEAKPADSWDLIIDPNLKHNVLSPGWKQYLELHASGRFHCSWCWHTWQSPYVVILFHMFLDRAQRAGSVRMRVFKQLCYECGTARLDESSMLEENIEGLVDNLITSLREQCYGERGGQYRIHVASRQDNRRHRGEFCEACQEGIVHWKPSEKLLEEEATTYTFSRAPSPTKSQDQTGSGWNFCSIPWCLFWATVLLLIIYLQFSFRSSV

SEQ ID NO: 919240 - protein, 268 aa, Homo sapiens
ATSSDFLLGNMPSKSTDSVGKIRGKPLPLLLFFEALFITSHAFPCPVDAALTLEGIKCGLSEKRLDLVTNWVTQERLTFSEEAGDVICDYGEQDTYNKAKCLALAQIIYSECGLHKKAILCLCKQGQTHRVMEYIQQLKDFTTDDLLQLLMSCPQVELIQCLTKELNEKQPSLSFGLAILHLFSADMKKVGIKLLQEINKGGIDAVESLMINDSFCSIEKWQEVANICSQNGFDKLSNDITSILRSQAAVTEISEEDDAVNLMEHVFW

SEQ ID NO: 919241 - protein, 202 aa, Homo sapiens
PASRFYHQERLTFSEEAGDVICDYGEQDTYNKAKCLALAQIIYSECGLHKKAILCLCKQGQTHRVMEYIQQLKDFTTDDLLQLLMSCPQVELIQCLTKELNEKQPSLSFGLAILHLFSADMKKVGIKLLQEINKGGIDAVESLMINDSFCSIEKWQEVANICSQNGFDKLSNDITSILRSQAAVTEISEEDDAVNLMEHVFW

SEQ ID NO: 919242 - protein, 268 aa, Homo sapiens; identical to SEQ ID NO: 919240

SEQ ID NO: 919243 - protein, 234 aa, Homo sapiens
MPPHPGEEPAQGPPAPAPGLPTTGSGGWRPCAGQGSEGRECPPVAKARNYRAPILDQSKNRLENILAFTGTVRRKASSRQGRGIRLHLAGLSEAGLGMSQASSGLVLAPGAPSAGYRRLVNRGLWHSIWVSDSITSGEESKGGEKTLEPASPGGGVGWGTSFLASAPTRRLGWVGWRLQERAVAKEWCLLPQSVHFRGWRGKKIKKEGGGREQLFLAEKGEISEGGSYHVLEAS

SEQ ID NO: 919244 - protein, 194 aa, Homo sapiens
MLLACDHLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 919245 - protein, 493 aa, Homo sapiens
TVNQLAHALHMDKDLKAGCLVRVFCPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVPNKVSCAMTDEICRLSVLVDEFCSEFHPNPDVLKIYKSLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 919246 - protein, 184 aa, Homo sapiens
MTQQEEFWPLHRKLRARGATKGVFSAPSQPDPSVFQGRAALVGCPTATCYSHPHWQLQPPGIPHPPQQTDSKGTNCPQEPDWPSLPSLSLPLRVNPFLNPTPKLCVPAPQVQQCLTGQTPKNTVQPGGHIFISLDRQVGQAHPELRPEGAGGRRKLPWGGAEAAPQSNTAQAPAQGGRRHQPCA

SEQ ID NO: 919247 - protein, 154 aa, Homo sapiens
RRLHATCERKRPVVKVLGGWGQNFPGANAALNRRRLPMHFFSHLQPRILRAVPRQPFEAVLEQKAAIVLISQQGKVQTLPLQFERFFFYGGGGRDCNLILKVNFEDLEWSPSLSCRSNHRCPNACISNFGWLLVKKRLQKAVNAGSGSECDGQG

SEQ ID NO: 919248 - protein, 161 aa, Homo sapiens
MKPQSLQRAHEPRENSVGITRGWTREAQDWEMRQAPSEGADLARLGKRGPARQVAQDVRGGRYEGVTASVAFSVEPKNKTSVIIFQSVPTWCQETRFTNGVNTALAVMGLHGRGQIKGTQKEEEKEEEFNNSHHQKTEREEDRMSALRKSWYLISGMLLMI

SEQ ID NO: 919249 - protein, 147 aa, Homo sapiens
SKVLGMLANTDLWVMVLDFSRLFQWLLDKTGFRLHLAVPAARSAENLRAAQGWALMKESDAAHRKQASAEQREPQEKQTGLPAFELVSSNQMEPGTVTKERVKVKATHGAEGPGGRLMRSKAGSFGTGQKGEPRVRGEGRAARISDG

SEQ ID NO: 919250 - protein, 639 aa, Homo sapiens
RLGVGFMWEERKKLGEMLSGLIEEKCKLLEKFSLIPKEYEGYEVQSSLEDASFEKAAAEARSLEATCEKLNRSNSELEDEILCLEIELKEEKSKHSPQDELMADISKRIQSLEDESKSLKSQIAEAKIICKILPMTEERRAIAIKDALSENSQLQESQKQLLREAEVWKEQVTELNKQKITFEDSKAAVLEEDTTDDDNLELEVNSQSENGAYLDDPPKGALKKLIHAANLNVSLKALEGERNHIIIQLSEVDKTKEELTEHIKNLQTQQASLQSENIYFEMEEKISHVTEELETYRKLAKDLEEELERTVHFYQKQVISYEKKGHNNWLAARTAERNLNDLRKENAHNKQKLTETEFKSELLEKDPNALDVSNTTFGRERSPYGPSPLGQPSSETRAFLSPQTLLEDPLRLSPVLPGGGGSPSSPGNPLDHQITNKRGEPSCDRSTDAHRAPSDTGSLSSPWEQDRRMMFPPPGQSYPDSALPPQREDRFYSNSDRLSGPAELRSFNMPCLDKMDGSMPSEMESTRNDAKDDPGHLNVPDSSLPAENEATGPGFIPPPLAAISGPLFPVDTRGLFTRRGPPFPQPPPGTMFGASRGYFLSRDFPGPPHAPFAMRNIYPQRGLPPYFHPRPGFYPNPTF

SEQ ID NO: 919251 - protein, 139 aa, Homo sapiens
MLNRHMKMCSTSLIIKEMQLQTTMRYHQLCNSEFEKIQITMEILAKHSPVGAEWGRAETTQDFSDGCLWPLTTYWGLFIQGSRGEKEHVSDHLVSWSSYRPFSGSLTLLTQSGPSLCSFLNKYERCCCQPKCYNHFTGN

SEQ ID NO: 919252 - protein, 642 aa, Homo sapiens
MRQKQVPPEPAGMRHPVAGSAVLMLAGTFRVKDALSEAQNQGGEVLGGPPLGEPAQELTSQRRRRLVEEFMLLANMAVAHKIHRAFPEQALLRRHPPPQTRMLSDLVEFCDQMGLPVDFSSAGALNKSLTQTFGDDKYSLARKEVLTNMCSRPMQAVALALTPSPESSGTAGQTASGAVAPAGTGYALVPRDSRWEDGRCLLEQRPTGSLASACVSSRQRLQPLVQQNRRRPPPLPPPHCPPRPPPPPPSTTSSFSSSAVASSSSSSSSSSSSSSAVASSSSSSSSSAVCPHIAADGEAVGGASLPGLAGQLWACQALTHPVPQMALYFCSGLLQDPAQFRHYALNVPLYTHFTSPIRRFADVLVHRLLAAALEAAWSPQPALDTAGRRALTSKGRFLLPWELGAWGYRERLDMAPDTLQKQADHCNDRRMASKRVQELSTSLFFAVLVKEPRAVPGGAMAAALSLQESGPLESEAMVMGILKQAFDVLVLRYGVQKRIYCNALALRSHHFQKVGKKPELTLVWEPEDMEQEPAQQGILPGGGPHYRQASRGFQRPKEGPGVLLQGWRQSCASTSGPAILVPSRLGSAQVITIFSLVEVVLQAESTALKYSAILKRPGTQGHLGPEKEEEESDGEPEDSSTS

SEQ ID NO: 919253 - protein, 258 aa, Homo sapiens
SFHEVFLPTALACTAAESLSSTSAMGHLHHSPVLEIGGQVISHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLMINEVMWWDHGVYYCTKRAPGDTSGDPDKEVKLIVLRKCYWSFLFSHPHCRNTFTHRKKKKKPEISKPKLADSDLHHPGSPPPPAADWSVLVPVLSSVLLLLYPLSLLSCPLLLS

SEQ ID NO: 919254 - protein, 143 aa, Homo sapiens
MALQGILCTQGSFTSAVIRIIYDLHSHAIPPPSATPILKWVPQNQIWRLQFTCQLYINKVLPGENGKGMRGTEQKWGKSQAQSTENRFSYTPHRNKALFPGHIPWAAFREALHTQGCSQGTEGLDLPAVVAGTRANPWPLVNT

SEQ ID NO: 919255 - protein, 184 aa, Homo sapiens
MCRPLYKLSGHHMLSQRLPVACFLGAPDQMPWTVPEAFGFSECEWVEPSSGAPSLLLLLLSLALPNTHTRANAHMHRPPRGCCSPLQCQEHTGPWTEQTAFPGPLSWQLRGPQSLTGVSGLTIRLLKKDNSQQAHTEKAFHAAQSPAQQPGVRSKCAEWVVELTGPAGLLWLAEPLWLSPWVAG

SEQ ID NO: 919256 - protein, 159 aa, Homo sapiens
MLHVLASLPLLLLLVTSASTHAWSRPLWYQVGLDLQPWGCQPKSVEGCRGGLSCPGYWLGPGASRIYPVAAVMITTTMLMICRKILQGRRRSQATKGEHPQVTTEPCGPWKRRAPISDHTLLRGVLHMLDALLVHIEGHLRHLATQRQIQIKGTSTQSG

SEQ ID NO: 919257 - protein, 211 aa, Homo sapiens
CHISTRLILTTWLMKQESLIQEGKQEFTRIVKDTPDPEENAGKQPPQLGERVGDAVKDRHREKLQTFSQTWDGEQDTIFNPGTYEASHSLVTQQHGSVGISVLGQRLEHLLWSGVGASIARIVESTSAVGLELCFPPLQAWGRRRAAKLHFLLGSNTCSQGQLGDLELIHLCHCWVPHSALLILWYDRAASAPLPGRNPDIWSTCLPGPAD

SEQ ID NO: 919258 - protein, 483 aa, Homo sapiens
PTVPGNLDQSGTRQEMEEPPQEALAEPLKHESPAAPSSAGHTKGQEEDDQKNQAERKADNHTAHRIADQTALRVPSQAESSIFSQATNGVAEQNGHSTPGQAGRRASNPADVSDLRADDQVNQTPSEQTKGKASSQANNVQHEQSDGQVSGLTEERTAEQTERRLPTQAERRTSGQIDGRLAMPSDQRGSRQTDHRMAGQSERRASEQMDRRMSGEAERRTSEQITHRLSKLSERRPSVQIDSGSSVPSDQSPSVQIDSGSSVPSDQRPSVQIDRRMSGKVRRRSSEKTDYRLAGLADPGTSEQTDLRLYGLVDHKTSVKTHHQVYGQATELAEHQAIDQAHSNADQPPVDNAHYTESDQTDHLADRQANHKDQLSYYETRGQSEDRIFPQLGNSKEDKEADYRVQPCKFEDSQVDLNSKPSVEMETQNATTIPPYNPVDARFTSNFQAKDQALFPRLPSISSKLNYTSSQEKTQAIVTKSVY

SEQ ID NO: 919259 - protein, 164 aa, Homo sapiens
KEELSRMEKRGVKEENWGSEVPLLLSDTEGKVQKAEEIRKMIFPCSSQQNNREDYLLRVEGLRALKKLIKFERVIEGNERRADQSQVQELTDKATRRARLRFGAMSLLLHESAGCVPKTPKVQSRSCCSPHRKPITETRVFPEKKALIRYCSWEDGTSVSNPSP

SEQ ID NO: 919260 - protein, 403 aa, Homo sapiens
MGNLSCCIQGDSKKPSQRRVKRQPYSTTKVTSGSTFNENTRRYAVHTNQCRRPHGSRVKKKRYPQEAPHEDTVHDITNEDATHDIANEDTVHDIANEAADKGIANEDAAHGIASEDAAHGIASEDAAHGIASEDAAQGIASEDAAQGIAREDAAQGIAKEDAAQGIAKEGAAQGIAKEDAAHGIANEDSAHGIASEDAAHGIASEDAVQGIAKEDAAQGIANEDAAQGIAKEDAAQGIAKEDAAQGIANEGAAQGIAKEDAAQGIANEDAAQGIANEDAAHGIASEDAAHGIASEDAVQGIAKEDAAQGIANEDAAQGIANEDAAQGIAKEDAAHGIANELYTTSLTRTPYKPSLTSTLYTTSLMRALYKTSPMRALYTTLLMAPTRHANVDAVHDIANEDSV

SEQ ID NO: 919261 - protein, 182 aa, Homo sapiens
MSQMLRKRFWEEPKDLPLAAMLRLTISPPFLLVVGHLKLDLPNHHGTCQECRLFSCVNSSLYNTDHSILAVRTQEGVWIPVKLSGPWEASPSVHIITEILQKILRCSQCFIATLILIIMGLIAVTATAAAAGVALHFTVQTADYVNNWQKNSTLLWNSQTNMDQKLANQINYLQQTVMWLGD

SEQ ID NO: 919262 - protein, 232 aa, Homo sapiens
MKESSPLSSRKICDKSHFQAIHSESSDTFSDQSPTLVGGALLDQNKPQTEMQFVNEEDLETLGAAAPLLPMIEELKPPSASVVQTANKTDSPSRKRGHTMVDDGPGLWTLVVYGHVVLPTIFQWEKRRLWPPARGLGTYKCDLNPLFLQQHHGISPSKPPHPQRGDPSGLAKHASDNGARSANQSPQSVGSSGVDSGVESTSDGLRDLPSIAISLCGGLSDHREITKENTCE

SEQ ID NO: 919263 - protein, 937 aa, Homo sapiens
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNAEMQPSAALRVAACQSITGWRCRTLNWDSPQPVSAAFPPSSGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 919264 - protein, 948 aa, Homo sapiens
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNKAFNVSFLVVVALINICAEMQPSAALRVAACQSITGWRCRTLNWDSPQPVSAAFPPSSGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 919265 - protein, 890 aa, Homo sapiens
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 919266 - protein, 896 aa, Homo sapiens
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 919267 - protein, 512 aa, Homo sapiens [sequence omitted]

SEQ ID NO: 919268 - protein, 896 aa, Homo sapiens; identical to SEQ ID NO: 919266

SEQ ID NO: 919269 - protein, 246 aa, Homo sapiens
PEDADSLNLEYPPRTSAGNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQEVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 919270 - protein, 423 aa, Homo sapiens
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKK

SEQ ID NO: 919271 - protein, 423 aa, Homo sapiens; identical to SEQ ID NO: 919270

SEQ ID NO: 919272 - protein, 618 aa, Homo sapiens
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATSAYNLQQASMQLAARTPEAGVPGFNS

SEQ ID NO: 919273 - protein, 910 aa, Homo sapiens
RRAGCLQYKGGHARRRSVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 919274 - protein, 896 aa, Homo sapiens; identical to SEQ ID NO: 919266

SEQ ID NO: 919275 - protein, 890 aa, Homo sapiens; identical to SEQ ID NO: 919265

SEQ ID NO: 919276 - protein, 878 aa, Homo sapiens
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 919277 - protein, 735 aa, Homo sapiens
MAEIISSSAFLLCRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 919278 - protein, 896 aa, Homo sapiens; identical to SEQ ID NO: 919266

SEQ ID NO: 919279 - protein, 896 aa, Homo sapiens; identical to SEQ ID NO: 919266

SEQ ID NO: 919280 - protein, 803 aa, Homo sapiens
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSHAEHEIRNISCAAQDPEDLSTFAYITKDLKSNHHYCHVFTAFDVILAYEIILILAQAFEVAYQLALQARIRGTLLHSFQKALKTTASNPI

SEQ ID NO: 919281 - protein, 136 aa, Homo sapiens
PASAHTLHMNSEGSMAKLTISTCVPAAMPHHLTSAHPPPDLRWWYKNQIAQHFAPKELKERGFHCVYVFSFTSHFCSLPSGNAVDICHQQLFGDFNVPSSQDPKGDFRHGESKTPGAQKNGVSRHQANTEEIRAKF

SEQ ID NO: 919282 - protein, 627 aa, Homo sapiens
RRAAPRASISESAGSGQPRAEGLGAGAAGPLRAMAAPVKGNRKQSTEGDALDPPASPKPAGKQNGIQNPISLEDSPEAGGEREEEQEREEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 919283 - protein, 627 aa, Homo sapiens; identical to SEQ ID NO: 919282

SEQ ID NO: 919284 - protein, 542 aa, Homo sapiens
MALGERIGWPLLEPQSSCQTAVLRVPARAAGAARTPPPGGARRPRPHEVPLQVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 919285 - protein, 430 aa, Homo sapiens
MAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 919286 - protein, 619 aa, Homo sapiens
MADTLTQRVVFNTAVSDSDDSARQVRAARDSRHAACQGQSSQEVSLTTASPTAAADGIRTHLAGGDSPEAGGEREEEQEREEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 919287 - protein, 541 aa, Homo sapiens
RRAAPRASISESAGSGQPRAEGLGAGAAGPLRAMAAPVKGNRKQSTEGDALDPPASPKPAGKQNGIQNPISLEDSPEAGGEREEEQEREEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGANLQGPAWSPAFWAQPWGLCPQRPTGAPCCTAR

SEQ ID NO: 919288 - protein, 200 aa, Homo sapiens
MDIPEPAAPVKGNRKQSTEGDALDPPASPKPAGKQNGIQNPISLEDSPEAGGEREEEQEREEEQAFLVSLYKFMKERHTPIERVPHLGFKQINLWKIYKAVEKLGAYELVRKAPPSPCQTAYPWGEPAALSLPLDRGRARIPSPTPASLICLARTTSHNLCSAPLLPPQHQAVGQPMVLCTLWSRQGPTTGRYCCQGALN

SEQ ID NO: 919289 - protein, 88 aa, Homo sapiens
MMPGKTKADAADPAPLPSQEPPRNSTEQQGLASGSSVSFVGASGCPEAYKRLLSSFYCKGTHGIMSPLAKKKLLAQVSKVEALQCQEE

SEQ ID NO: 919290 - protein, 430 aa, Homo sapiens; identical to SEQ ID NO: 919285

SEQ ID NO: 919291 - protein, 542 aa, Homo sapiens; identical to SEQ ID NO: 919284

SEQ ID NO: 919292 - protein, 754 aa, Homo sapiens
RRAAPRASISESAGSGQPRAEGLGAGAAGPLRAMAAPVKGNRKQSTEGDALDPPASPKPAGKQNGIQNPISLEDSPEAGGEREEEQEREEEQAFLVSLYKFMKERHTPIERVPHLGFKQINLWKIYKAVEKLGAYELVRKAPPSPCQTAYPWGEPAALSLPLDRGRARIPSPTPASLPPCLPRWYSAAQSSFSAFPICSARPVLGKLLGPAVHGPRRENRLAAAGAAEQLPNCSPSSPCEGGRSCKDPAARGRPPARPHEVPLQVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 919293 - protein, 470 aa, Homo sapiens
RRAAPRASISESAGSGQPRAEGLGAGAAGPLRAMAAPVKGNRKQSTEGDALDPPASPKPAGKQNGIQNPISLEDSPEAGGEREEEQEREEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTAPAHLPQ

SEQ ID NO: 919294 - protein, 501 aa, Homo sapiens
MGVQIQKLLQDFFNGKELNKSISPNEAVAYGAAVQAAILSGNKSENAQDLLLFRQTFTTYSDRQPDVLIQVYEGEHVMTKDSNLLGKFQLTGIPLALQGVPHIEVTFDIDANGIFSVSAVHKKLALSLECVKIDIPGEGNLGGSLSSKGMEADERSWRNENGEKSSMNMEIGHPHEGKDDLGDKRVIMGTKFPMELGIRVGLGKEDSRCGESPVVSNKCEGRMAPPETKFPLSKGLEMGLERQNISRTVMQRGSLGVDSVSASQGTKPSLLPGRMGLENESLLAGYTHERIIQPPLGRVCGSSQAAGSRRAPLASGPEGVEELVGKPAFVMEPRQEMEKESTCVLMKPNTEIKLPVEVDIGLTQAEGPDETKNTEPQMGLVIEPPQCQFAQQHEQRKEAGNIESGVEPPDRIRPIYSGKFFDRTPCWPSSVSYLFFQQRLVVAIVPEYSAKDVVNPPKSYEEVFKEGNEGHDLYVVSHNDYYAGKCPPMQNGPEDMGLSDL

SEQ ID NO: 919295 - protein, 501 aa, Homo sapiens; identical to SEQ ID NO: 919294

SEQ ID NO: 919296 - protein, 150 aa, Homo sapiens
MCGTAGGKRGAAVQQRHWHICMPEKEWVDKNCPYIWSLGNSHPEAHSFPEQKINKEDGQLRAEHGSSSTPILFHPEQLPVGICLTITTLTKPFNEQKAITLKTRPSPSVLLNDDEHTACRLNLEEQGQSHWDLESKLGQLLLFPPPSKLP

SEQ ID NO: 919297 - protein, 840 aa, Homo sapiens
MPQMGLGQELSHIFLLSAVGGGFYGGISLGALSMTSYISVERDFHNKRSLGDAVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKNSVPDIHGVEAPAREGAMSAQLGYPVVGWHIANKKPPLPKRVRRQIHATPTPVTAIGPPTTAIQEPPSRIVPTPTSPAIAPPTKTMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRQCRAAPWLSAFCL

SEQ ID NO: 919298 - protein, 149 aa, Homo sapiens
ALFPTMAVPRKPAAGSLSRGSAGCSFSGLLGWCTCPCLQNGPLCMAGICDWGRKPSSPMSVTLGQLSVSCLSSSAHLQSVSRFSLAGLAFRSSSGRHSCPRIYSWSGPDWTQSPKGSPRELREKCLIVTWSQNNISHNAIVPYTTHFMY

SEQ ID NO: 919299 - protein, 202 aa, Homo sapiens
MGSIIIHQCHTVQAGFTEASVESVPALLSSLVLNGLSTAVMQKQGCWNGDRSPSADCHWLYDSGECGGFNAGRNMELLGSEGRPVGLVSEVDMDRKQLERQGAEVTQKVDFPPQMSLTMDWDMNGSRAPFQSPQRGGTFARASLSCVLWMLGYEGGMWYFRGYNDDQELIPLFTEGLCTYISKAKQIARNTEMEKPNAAGRR

SEQ ID NO: 919300 - protein, 147 aa, Homo sapiens
MGGCMHSTQDKSLHLEGDPNPSAAPTSTCAPRKMPKRISISKQLASVKALRKCSDLEKAIATTALIFRNSSDSDGKLEKAIAKDLLQTQFRNFAEGQETKPKYREILSELDEHTENKLDFEDFMILLLSITVMSDLLQNIRNVKIMK

SEQ ID NO: 919301 - protein, 664 aa, Homo sapiens
MTALYAFHSVLGSKEILFAHLSRVLALRYSWSSCKFTTKLSGRYRDFPCIAYPYRAKISHQSGHVGHEVHDLVAVAKFIAIPRNDLDKVVVEGNASPNIEGGRVRVAVEVGGDSLVLSVAQDALEGALRCLLHHLLDVIIFGRFFQMAGQVNDRHLGSGDTEGHATNEAWKDFHGSLLRFYENGELCDVTLKVELVARACCEYMKLHFHPSNCLAVRAFAESHNRIDLMDMADQYACDHFTEVVECEDFVSVSPQHLHKLLSSSDLNIENEKQVYNAAIKWLLANPQHHSKWLDETLAQVRLPLLPVDFLMGVVAKEQIVKQNLKCRDLLDEARNYHLHLSSRAVPDFEYSIRTTPRKHTAGVLFCVGGRGGSGDPFRSIECYSINKNSWFFGPEMNSRRRHVGVISVEGKVYAVGGHDGNEHLGSMEMFDPLTNKWMMKASMNTKRRGIALASLGGPIYAIGGLDDNTCFNDVERYDIESDQWSTVAPMNTPRGGVGSVALVNHVYAVGGNDGMASLSSVERYDPHLDKWIEVKEMGQRRAGNGVSKLHGCLYVVGGFDDNSPLSSVERYDPRSNKWDYVAALTTPRGGVGIATVMGKIFAVGGHNGNAYLNTVEAFDPVLNRWELVGSVSHCRAGAGVAVCSCLTSQIRDVGHGSNNVVDCM

SEQ ID NO: 919302 - protein, 539 aa, Homo sapiens
MSSKQARNHITKGKRQQQHQQIKNRSSISDGDGEDSFIFEANEAWKDFHGSLLRFYENGELCDVTLKVELVARACCEYMKLHFHPSNCLAVRAFAESHNRIDLMDMADQYACDHFTEVVECEDFVSVSPQHLHKLLSSSDLNIENEKQVYNAAIKWLLANPQHHSKWLDETLAQVRLPLLPVDFLMGVVAKEQIVKQNLKCRDLLDEARNYHLHLSSRAVPDFEYSIRTTPRKHTAGVLFCVGGRGGSGDPFRSIECYSINKNSWFFGPEMNSRRRHVGVISVEGKVYAVGGHDGNEHLGSMEMFDPLTNKWMMKASMNTKRRGIALASLGGPIYAIGGLDDNTCFNDVERYDIESDQWSTVAPMNTPRGGVGSVALVNHVYAVGGNDGMASLSSVERYDPHLDKWIEVKEMGQRRAGNGVSKLHGCLYVVGGFDDNSPLSSVERYDPRSNKWDYVAALTTPRGGVGIATVMGKIFAVGGHNGNAYLNTVEAFDPVLNRWELVGSVSHCRAGAGVAVCSCLTSQIRDVGHGSNNVVDCM

SEQ ID NO: 919303 - protein, 539 aa, Homo sapiens; identical to SEQ ID NO: 919302

SEQ ID NO: 919304 - protein, 132 aa, Homo sapiens
MASDSMSSKQARNHITKGKRQQQHQQIKNRSSISDGDGEDSFIFEANEAWKDFHGSLLRFYENGELCDVTLKVGSKLISCHKLVLACVIPYFRAMFLSEMAEAKQTLIEIRDFDGDAIEDLVKFVYSSRLTL

SEQ ID NO: 919305 - protein, 269 aa, Homo sapiens [sequence omitted]

SEQ ID NO: 919306 - protein, 270 aa, Homo sapiens
MSQEKDFHKHEHTGNQHYQFPGLCWYCEVIFETWKYYDRVHLSKWRRQLWPGGVVASSRSCVSQSDTAEKHIRQGSFHYLTLPLFLWVPLMRGQCLLVAPQGNLSGRGFCVSIVSSSPGDSSGSQGPGHVRGTSVARQCAQRRGPGAWFVYRFGGFSIAPAFWDCFPKTLLQSTVVKNLLSEGRTDYTGLKEANTLKAECAELPCRCQGEEKAEEPQRKLHCHDVILWTESSILLLCKCCSLTWGQARKNAASPLWSDTDCMDHQQTHFM

SEQ ID NO: 919307 - protein, 122 aa, Homo sapiens
SALRNCMDELRVPMLLSFSDTFIPESLLRQSSLRRCLRMGQVAKSQHFPLITYCKDQQFAIPGHRQHAFGLQWPIITPATDYSCLLLGPPTSSSVTKPKAVLRALCKITWQYLLKLNTHIRI

SEQ ID NO: 919308 - protein, 180 aa, Homo sapiens
HLLHGHWAVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTTSSSTPWSKCRDPLERH

SEQ ID NO: 919309 - protein, 91 aa, Homo sapiens
PDLPLQLPAALFVFCTKSRRAERYWQKTLLQMEEMESQIREEIRKGFAELQTDMTDLTKELNRSQGIPFLEYKHFVTRTFFPKVSPSLSLP

SEQ ID NO: 919310 - protein, 1984 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRCTLQQDCTNSSQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919311 - protein, 1984 aa, Homo sapiens; identical to SEQ ID NO: 919310

SEQ ID NO: 919312 - protein, 1942 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919313 - protein, 1303 aa, Homo sapiens
MVEQRPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919314 - protein, 383 aa, Homo sapiens
LRLVGGRVLNGRGRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919315 - protein, 268 aa, Homo sapiens
SLHPGSLLKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919316 - protein, 199 aa, Homo sapiens
LACSGLLACSGLLLAQFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919317 - protein, 200 aa, Homo sapiens
LVTRLQPQALEGQSQLSPPQLSLDCFLPHPTLTVFVTLPHSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919318 - protein, 143 aa, Homo sapiens [sequence omitted]

SEQ ID NO: 919319 - protein, 1870 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNRWRVGGPCGLHCATGAPVAGGSESSLLASPAWGQALLCHFPAVCSRMSDLASLCFSF

SEQ ID NO: 919320 - protein, 1357 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVGKEPHPQDTLEGRLATLPQPL

SEQ ID NO: 919321 - protein, 1418 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKVSPSLSLP

SEQ ID NO: 919322 - protein, 94 aa, Homo sapiens
MGHAGPSQPTQPVLGLAQSPWGLEGGSWDSGIFFIIKALRTNLKKNGTRGGPVPQFALIVRCIYNLTGRRFYNLLDWEKPWALPQTLNGFAEKY

SEQ ID NO: 919323 - protein, 73 aa, Homo sapiens
RFWVNILKNPQFVFDIDKTDHIDACLSVIAQAFIDACSISDLQLGKVSCSQDQARPMHRARVGCRPWVASSTL

SEQ ID NO: 919324 - protein, 48 aa, Homo sapiens
MAWNGAIPEPGSRVAVGAKDRWLTTAPPLRIVCVTGPAPGPLSGVVTV

SEQ ID NO: 919325 - protein, 135 aa, Homo sapiens
DEAALRPWDPQLLGPKGAVDTCLPLTRCSLASLLTIALHGKLEYYTSIMKELLVDLIDASAAKNPKLMLRRTESVVEKMLTNWMSICMYSCLRVRLPGDRQSPGGGRGRDSAAVTPRPPRPSLAPSGQLCQEGVL

SEQ ID NO: 919326 - protein, 72 aa, Homo sapiens
VSCDIQIVSDRIIHCSVNESLGAAVGQLPITVSGWGAGAGQTWPHPWPICQASAPHPAPEFTERFHAQQLSP

SEQ ID NO: 919327 - protein, 2009 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYTSALWLDTLDDEALMGSPAFLGPLGASVFLDKCAEWLEG

SEQ ID NO: 919328 - protein, 1984 aa, Homo sapiens; identical to SEQ ID NO: 919310

SEQ ID NO: 919329 - protein, 554 aa, Homo sapiens
ILRLGQAGWYSAEEAQETYPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919330 - protein, 1973 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919331 - protein, 788 aa, Homo sapiens
MPTLEDQQLADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919332 - protein, 1984 aa, Homo sapiens; identical to SEQ ID NO: 919310

SEQ ID NO: 919333 - protein, 1973 aa, Homo sapiens; identical to SEQ ID NO: 919330

SEQ ID NO: 919334 - protein, 106 aa, Homo sapiens
SLSLEHKIKAVYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 919335 - protein, 1887 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQHWK

SEQ ID NO: 919336 - protein, 1717 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLNEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVQAGD

SEQ ID NO: 919337 - protein, 1326 aa, Homo sapiens
GLRGEAEPGPGAGAGGGWRGQEAPRGPGPPPASRPLRAPGSRPALVPCNSRAAQPAHARMALRAAGGAPFERPGAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCVWSDGCRLRGPLQPMAGTCPAPEIRAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQIQVGNFNQTIATLQLGGSETAIIVSIVICSVLLLLSVVGKEPHPQDTLEGRLATLPQPL

SEQ ID NO: 919338 - protein, 186 aa, Homo sapiens
GSLCHQLPSPSPAEGHLALPHLMAKDQIAQAGRTRNRKKKLAESFQTYINREEQLALSAYYLTSTKTTSFFILTKSLDWVTAFPLYEETEELTKEGAGSPAPSSSLVHHDDCLEVDFDRQEDVCALLEETVKGSLTLHSVMASFYELNGSLIYSNNILPDMSIVLYNSFIPFGEVLPNPSIKQLKW

SEQ ID NO: 919339 - protein, 154 aa, Homo sapiens
MKLLLLAVEGEEAATDGEGGNQAPTPAGPLPCPHRCSTIRPGMRPGCLLVPCVRVPICNTPQSHSQWVVESPLCAADCARLFHGTCKGSAHHGPPVCADCMAERIDETLKSPMKAQTRSRGGSQLQQLPCPPTHSAPTAEFLRAGCQAMCMQHM

SEQ ID NO: 919340 - protein, 158 aa, Homo sapiens
CTCTRLLMRLSIFSHFCGPFQRYCLYGLGQDPEEFPGLLDRDSCSLHLLSTKQINSLPLLQASWSWEWSDKNTSIATTLRTALGFSQNLLQPLPDYCLCLLNALRLYNHQVAKPARLISFPRAWASPEVPTGGQGLESKTLDVYLMLHCTAAELTFKP

SEQ ID NO: 919341 - protein, 158 aa, Homo sapiens; identical to SEQ ID NO: 919340

SEQ ID NO: 919342 - protein, 918 aa, Homo sapiens
MDMYKIFIDNMVDSSKSSIYYFKLCYSKFCLISSLGKTKYFKSFRCFQDLGFIIKLLNANNFYMTPCGNLEDIQDVSEGVSMPFFDQYLTELTVYCVIISLFEREPEGANSLFEGPGVSRLYSRKSHSFLSQLAFQRYFKYSYYQILSTSARNYLNFPICSLKTSCRLFFKFACGVQIFLCTTLNLFEVVETFLGDPGFSQNVTDKKAKFITGQGRFFWKVTCRKMKAKGLIRDRNCFLTYELVVKKISECFFMSITLQGHPGTCLFIIFLQSMYLEMTLMDGRKWTSSKFSIIDKYFLQNSFNNLAPPSIRHRNFYFLTFSRTLCYQILIPAKTCKRVGSNCFNVHSLITNEIEQFNNNKKKGKPYMANRKNELLMFDENSGVPTVHNNLLNISKEQKKRFETLPTQKIIKFEVMNNLNAMFDHYALYACIKISHVPYKYVQLLCINFKKIRQLKSSHYKSTAPNGHSTNTAPLLKILDDICTLNNEDRPAGIIGLSVTMQCLSYYLVLYYRLVEDKVNMLNGLGWDTTWKKGKDIDFNYDSMYLTNGIIFYNNRSGVVVIYVTPTIRHYATDFCIQLTLNNMKLGALAPHTVENPHAIFESLKLNCYYPTVDLKPSDSINSGLTYFICYIYYILYSYNKRERERERERERERERERERERFEFGERKAMVTFTIYPKKKLLKDKCENVVTCKGLNLASPMSASGSEWKVRMQTTLKEITFQECNVTAQLVHEKAWLEDILFLFVCYRILNGKLNMIREEVIPHIFCILWERITKEAEEVCSGGTMTKHQTESSHVWGDEQRHHFSKHLIILSQYLEAKIILKKNNRKRNTGYTDEKMGFPIFVEGPTSFAMNLQKFQERRLKRKVTGILRTVRYSEETLICKLVEMPVICWELKTLCIQERSLAAVHCCFINQYYI

SEQ ID NO: 919343 - protein, 922 aa, Homo sapiens
MDMYKIFIDNMVDSSKSSIYYFKLCYSKFCLISSLGKTKYFKSFRCFQDLGFIIKLLNANNFYMTPCGNLEDIQDVSEGVSMPFFDQYLTELTVYCVIISLFEREPEGANSLFEGPGVSRLYSRKSHSFLSQLAFQRYFKYSYYQILSTSARNYLNFPICSLKTSCRLFFKFACGVQIFLCTTLNLFEVVETFLGDPGFSQNVTDKKAKFITGQGRFFWKVTCRKMKAKGLIRDRNCFLTYELVVKKISECFFMSITLQGHPGTCLFIIFLQSMYLEMTLMDGRKWTSSKFSIIDKYFLQNSFNNLAPPSIRHRNFYFLTFSRTLCYQILIPAKTCKRVGSNCFNVHSLITNEIEQFNNNKKKGKPYMANRKNELLMFDENSGVPTVHNNLLNISKEQKKRFETLPTQKIIKFEVMNNLNAMFDHYALYACIKISHVPYKYVQLLCINFKKIRQLKSSHYKSTAPNGHSTNTAPLLKILDDICTLNNEDRPAGIIGLSVTMQCLSYYLVLYYRLVEDKVNMLNGLGWDTTWKKGKDIDFNYDSMYLTNGIIFYNNRSGVVVIYVTPTIRHYATDFCIQLTLNNMKLGALAPHTVENPHAIFESLKLNCYYPTVDLKPYCIAEIVDYTYFICYIYYILYSYNKRERERERERERERERERERERFEFGERKAMVTFTIYPKKKLLKDKCENVVTCKGLNLASPMSASGSEWKVRMQTTLKEITFQECNVTAQLVHEKAWLEDILFLFVCYRILNGKLNMIREEVIPHIFCILWERITKEAEEVCSGGTMTKHQTESSHVWGDEQRHHFSKHLIILSQYLEAKIILKKNNRKRNTGYTDEKMGLAELKPLHHSEAGFGITSSYSKQSPLAEPLMSHLLNGYIFFLILPPLNLSISKDLWHPGIMISREKAEKEGDWNIKNCEIF

SEQ ID NO: 919344 - protein, 938 aa, Homo sapiens
MDMYKIFIDNMVDSSKSSIYYFKLCYSKFCLISSLGKTKYFKSFRCFQDLGFIIKLLNANNFYMTPCGNLEDIQDVSEGVSMPFFDQYLTELTVYCVIISLFEREPEGANSLFEGPGVSRLYSRKSHSFLSQLAFQRYFKYSYYQILSTSARNYLNFPICSLKTSCRLFFKFACGVQIFLCTTLNLFEVVETFLGDPGFSQNVTDKKAKFITGQGRFFWKVTCRKMKAKGLIRDRNCFLTYELVVKKISECFFMSITLQGHPGTCLFIIFLQSMYLEMTLMDGRKWTSSKFSIIDKYFLQNSFNNLAPPSIRHRNFYFLTFSRTLCYQILIPAKTCKRVGSNCFNVHSLITNEIEQFNNNKKKGKPYMANRKNELLMFDENSGVPTVHNNLLNISKEQKKRFETLPTQKIIKFEVMNNLNAMFDHYALYACIKISHVPYKYVQLLCINFKKIRQLKSSHYKSTAPNGHSTNTAPLLKILDDICTLNNEDRPAGIIGLSVTMQCLSYYLVLYYRLVEDKVNMLNGLGWDTTWKKGKDIDFNYDSMYLTNGIIFYNNRSGVVVIYVTPTIRHYATDFCIQLTLNNMKLGALAPHTVENPHAIFESLKLNCYYPTVDLKPSDSINSGLTYFICYIYYILYSYNKRERERERERERERERERERERFEFGERKAMVTFTIYPKKKLLKDKCENVVTCKGLNLASPMSASGSEWKVRMQTTLKEITFQECNVTAQLVHEKAWLEDILFLFVCYRILNGKLNMIREEVIPHIFCILWERITKEAEEVCSGGTMTKHQTESSHVWGDEQRHHFSKHLIILSQYLEAKIILKKNNRKRNTGYTDEKMGLAELKPLHHSEAGFGITSSYSKQSPLAEPLMSHLLNGFQERRLKRKVTGILRTVRYSEETLICKLVEMPVICWELKTLCIQERSLAAVHCCFINQYYI

SEQ ID NO: 919345 - protein, 555 aa, Homo sapiens
MNVDAEASMAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 919346 - protein, 589 aa, Homo sapiens
PGQRKGVTQAGSGLSGYKREPLGSAGHIWCPWLTEESDAEASMAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 919347 - protein, 563 aa, Homo sapiens
MTTDSYSPTSPDAEASMAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 919348 - protein, 154 aa, Homo sapiens
MLHSLQQQPDLEQRRQESGQPLTECSQEKEMVLPGTAPPSIHRQWLEVRSTRLTTGLSPVKYKSQFSYQRELNLDLYEDQRSQLYQEAISINIHRTVCEQLAGRSQRWLQGTDKKCHITSALHGTEKYLWKNMDFDDSQLKSDSEELDFVGEKH

SEQ ID NO: 919349 - protein, 748 aa, Homo sapiens
SSARRWESRAEPGLSSGSRRPGQRRPGGARAPHRTIRLGVERSRSPTRSPGPTRHRRFLSTHGDQETLKEFGVSGAGKSRPTPRSFLGVRLPHCHSQHSPPHRDPASSPASLGVFFWELDRVPGRGRRLCGGVCSRLTCGGFSAPRTPGEARRTRLERVTPIPAPGPRLATSLMGNQLDRITHLNYSELPTGDPSGIEKDELRVGVAYFFSDDEEDLDERGQPDKFGVKAPPGCTPCPESPSRHHHHLLHQLVLNETQFSAFRGQECIFSKVSGGPQGADLSVYAVTALPALCEPGDLLELLWLQPAPEPPAPAPHWAVYVGGGQIIHLHQGEIRQDSLYEAGAANVGRVVNSWYRYRPLVAELVVQNACGHLGLKSEEICWTNSESFAAWCRFGKREFKAGGEVPAGTQPPQQQYYLKVHLGENKVHTARFHSLEDLIREKRRIDASGRLRVLQELADLVDDKESRLGAAGPSASPAPRSLPFPAPGLRSQRFSTSAPPRHARPPPVARARAAPPHPQASGRKSQELPQGRKGAAASAWLTATAVVTVLGDPACAFPLRCKPGTGKGLGEKGHGLPRESMASDCGPTRKQPSSQKGPSPPRACAHRPVGGENWSLQGTVQLLCGCVPRSQDFQEIEPVPCALGNNSPRQHFGIPGYPEAARDFSSSPAPGLLTLCSRLRAKPDSVCLRFFPPWEANATPTRLCLRVSLAGRREAGPVPGGRWRCEFGEDSRPRPRQGARSFTWCLGT

SEQ ID NO: 919350 - protein, 133 aa, Homo sapiens
CSSHIPSVLSKTSLNQNPKQVFPRSDTSMQTPHLIDATCLFMCTAIYNHLVTNTLLSSGLVISAFTVSTAIGDMALAITKTLFQDIGTGKCFVMKMPKAIATKAKIDKWDLIKELLEEPRWPNRNSSGLQLPA

SEQ ID NO: 919351 - protein, 141 aa, Homo sapiens
MGFPLDPLEEAVCPFTELKRCARSSTALFRAGRQEHLSQLKLYPQPPLPPGALSEGDGSFIYKPLTGTAAFLSEMPFPERRNLEKKGVGPSVHFLVKSSFSKGTCLHLEGGKLHDLQGRSPLAYVQVFMLSSENHLVPCFY

SEQ ID NO: 919352 - protein, 141 aa, Homo sapiens; identical to SEQ ID NO: 919351

SEQ ID NO: 919353 - protein, 97 aa, Homo sapiens
MRRLRHREVRGPVLGHTATGGPQNGTSGCTTAPQQRPPPGTQGMLEQYLNRGGQKSHGLCWLLCFVSQGQNQDVISAELWCRIHVQAHWGCWQNSAV

SEQ ID NO: 919354 - protein, 135 aa, Homo sapiens
MECRGKLVASSSGMSVPPSAGAHSTLHCGDRCPLVCMLLIASGGEDPISFVFTSANFTWCYHDSPSCSQVKDKFASPSTMIDLGCRGKFFYVPDVLSLEQLSLKWLTPPPPLLKKVFQFCNDHYLQTLELSSSDR

SEQ ID NO: 919355 - protein, 133 aa, Homo sapiens
ASDMREMPVVWCPRRTVTVRSSCLRWSKLRPVSQLQKLRVRMVEEAWMFEEGGKSVKQPPRSVAVHSLEWTGKNGEGFQGSNESPLSCRGRVGGELESSGDGVLPSWSAMARSWLTATSAFLVQVILLPQPPE

SEQ ID NO: 919356 - protein, 135 aa, Homo sapiens
MWPLSQMVSCKHGTSWVLSKHLSNRFLKDSSIRCFQADEIAWIDFAGLERTSTMGPSVTHPSREKCNCQRDRIHVSSSQHVSSLQAHSAESQVQIKMVLGLLLPGRLPDGSWICRVCPHLWASAQCRDGIQELNG

SEQ ID NO: 919357 - protein, 847 aa, Homo sapiens
MLDGNSGLSSEKISQKALEPCGVTKQQREPHCGSESKDRKLYKFLLLENVVHHFKYPCVLDLKMGTRQHGDDASAEKAARQMRKCEQSTSATLGVRVCGMQVYQLDTGHYLCRNKYYGRGLSIEGFRNALYQYLHNGLDLRRDLFEPILSKLRGLKAVLERQASYRFYSSSLLVIYDGKECRAESCLDRRSEMRLKHLDMVLPEVASSCGPSTSPSNTSPEAGPSSQPKVDVRMIDFAHSTFKGFRDDPTVHDGPDRGYVFGLENLISIMEQMRDENHPAYSGAHWLRLSQRCAPTFRRRRPCHVRGSRLARGGRVTARAGSGLSSGPAAVYPVSRSVLWRPWIRRQGDRADEVEPESVRRVVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLQRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVSLWAGLGGERGGECACLPDKAYPLLEVRMENVTVLGEDVIVNDELYLNGASVLPHKSIGESVPEPRIIMEGMQWGWPSPGFPISKGSAGLTHQKTLDLSLFVWGALGEAEAVGHLPSHVDIIWQDPCWAHPTNPTPSRRARARAVWNNNLMLTVALTESQAQAQLGPWLGSHQ

SEQ ID NO: 919358 - protein, 179 aa, Homo sapiens
RCKQGRSGGNSQGPLRLWLLCGRPENEWGRGKLMAKEEVREMLLRRTLWGIADLQMEGQPLEAESGPWLTAGKAGWKNECLPPKGGDERGGDQCAPQHLTRCKRRCTSVMGLYVTKGVQPSEEFENPSLHWKMEQKVDFKGPCPQKTPEWHENAPHRQSTQLLCFEVSHTSHSLLLPMD

SEQ ID NO: 919359 - protein, 241 aa, Homo sapiens
AVHALWRLCGAAALAGVGSWCEALMATMLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPPCQDVPQKIMESTGVQNLLSGRVPGGTGEGQVPDLVKKEVQRILGHIQAPPRPFLVRLFSWALLRFLNCLFLNVQLHKGQMKMVQKAAQAVRPALHWVGDGGSRRAEAGPSP

SEQ ID NO: 919360 - protein, 461 aa, Homo sapiens
MLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPPCQDVPQKIMESTGVQNLLSGRVPGGTGEGQVPDLVKKEVQRILGHIQAPPRPFLVRLFSWALLRFLNCLFLNVQLHKGQMKMVQKAAQAGLPLVLLSTHKTLLDGILLPFMLLSQGLGVLRVAWDSRACSPALRLCPMSHRALLRKLGGLFLPPEASLSLDSSEGLLARAVVQAVIEQLLVSGQPLLIFLEEPPGALGPRLSALGQAWVGFVVQAVQVGIVPDALLVPVAVTYDLASAPLGLWTGALAVLRSLWSRWGCSHRICSRVHLAQPFSLQLCLLPVGCVQVSWWARAGHLRAFSWAGIHRQCQKLLGRQTDPGAATAAHRAGPMVGAQERGVSGGKASSPSAPAYVSPIYTH

SEQ ID NO: 919361 - protein, 171 aa, Homo sapiens
MSPTHISQYPIRLPPLGGALRSSLAGGRRDREALQALSSIYTVCRSRAGSAGHGAWRQANAKAREEKGTGESQAPQLQLHSPRCPQGLCGSGGEKTSLVTPPASGRARTGSPRLGYSRASPRPPAGPTALALPTAPLGPALPEIFVRSRAASARPTAGLRRLALSGSWRRY

SEQ ID NO: 919362 - protein, 149 aa, Homo sapiens
MQIHVNYGKIIFLHSPCLGMFPSDICFGFIRRDRDAVFYIFALPELSTVTYGRNAIKKEISEAVFHGEQVYANLPPKAKEDERPKKEADKSNFLEKKYLTEIYEQKHVLGSHKTRWWIPALKGVTLKGLVPFFAPSAFRMDESRSSGWS

SEQ ID NO: 919363 - protein, 184 aa, Homo sapiens
PPHVGCGSMCESFAASSFSSVQKPSSLLRPETQSHSCSGLEGLRRQSEQREMPHSTYASVSDSIGKGAVTGSEDTNPSGVLSNSLISHALHNWLLLRDEPLADEAWEAQQVCSLGMWDILQWMQGGTMPLAFSGKNKGEVYLPTYLPLPVFHWSKLVPLGINSFTFPSLYHMTAPTTWDPKPQT

SEQ ID NO: 919364 - protein, 149 aa, Homo sapiens
MSFMVSQTQVLPVKGVQVLGALNKELDKTHKQSKKRKKQQKQRCIENENTLHRVGAGRASSSRAQLQNFLGFKYPLEVSIGYLVLKNTCRLTPGVLCNRCMLEIAMVKELYDVSLHYNLQTVSSAKWVSCDGDHNFSRCVLMIKGSITI

SEQ ID NO: 919365 - protein, 152 aa, Homo sapiens
MHWWQGLAAGKYMMVRAAASGKGWSKCSACVAVRARCMCMRSFGGWGWHHAHMQLQGLAVGTHAEVGAALAGKNIFLNLYWRGRETEEMGREVTGMRRKWLDQKGPIQPAMRTVSEEDHCERHCQASKGFWRVRSVSSHPGTLLVAFPIGAQ

SEQ ID NO: 919366 - protein, 152 aa, Homo sapiens; identical to SEQ ID NO: 919365

SEQ ID NO: 919367 - protein, 169 aa, Homo sapiens
MVMGNWLIHELHRGLDSLLSPIGKAKMSGTRLGRPDSRKYVAAHAADLGEKMLQLPGDLHEYGAERALLHHGLCAGSVKWLRLLIQDWPVRWKTFDGSPGLYPLDASSVFPQVMTIKKVLSNLKKKANAPGWMCSKDLERNSWRVALSSYDTSQLLVENQERKLGNHDD

SEQ ID NO: 919368 - protein, 468 aa, Homo sapiens
MTKAWWEAVGAQGSALAVPCLEGSLHPPDSAASCRSQPQGPEEDGLESPWEKLFQNHLAARGWDLNPDPGPQDDDSTASTGVPPAPHWAPPLENREQPDLSENPSSNLGGSVAPGKLLPVGPQSPPLRWASQSLPCEDGLHPGFSVTLYTAISPPHVLLLAWLSDLPLCIPSALLPRGVVTVVSLRQTVGSHSTSTGLVMVRQTPVQIQDQGLISSASIYAPIKWGQQHSCLMAFIRTGWQMFNTQKVLNPHNAQSSSALGFSLLLVAPVIGDVVIKHLLSVQGAPASQPTQAVVAWRWQPGNVGGGPRGGPAPLRLLLDRGLSVELPGSFHGPRPMTGRLRMPPIIQLTEHKGAMRGLGRPGAPSEHTGLRVPTPAHESPEHRGQGPAQSRERASFTCRNENHFLQPHGDTEMRGTTLGAGFEGQGRPSLLGPETRPGRSPPPPEEAEREHFRGQEGPLECEGWQSL

SEQ ID NO: 919369 - protein, 161 aa, Homo sapiens
MPFSRTEDGKIYQRAFGGQSLKFGKGRQAHRCCCVADRTGHSILHTSYGRSLRYDTSCFVEYFALDLLIENRECRGVIALCIEDGSIHHIRAKNTVVATGVRNFLWALAVYTSFLFTNWSFGPSAVPGIELLLGSPVRSIQPCWYTRDRRPTFSPFKGGMP

SEQ ID NO: 919370 - protein, 150 aa, Homo sapiens
MEEDNWRWHFYDTVKGSDWLGDQDAIHYVTEQAPTAMVELENYGMPFSRTEDGKIYQRAFGGQSLKFGKGRQAHRCCCVADRTGHSILHTSYGRSLRYDTSCFVEYFALDLLIENRECRGVIALCIEDGSIHHIRAKNTVVATGVKKLFF

SEQ ID NO: 919371 - protein, 150 aa, Homo sapiens; identical to SEQ ID NO: 919370

SEQ ID NO: 919372 - protein, 106 aa, Homo sapiens
MPFSRTEDGKIYQRAFGGQSLKFGKGRQAHRCCCVADRTGHSILHTSYGRSLRYDTSCFVEYFALDLLIENRECRGVIALCIEDGSIHHIRAKNTVVATGVKKLFF

SEQ ID NO: 919373 - protein, 150 aa, Homo sapiens; identical to SEQ ID NO: 919370

SEQ ID NO: 919374 - protein, 150 aa, Homo sapiens; identical to SEQ ID NO: 919370

SEQ ID NO: 919375 - protein, 209 aa, Homo sapiens
MPLGRFVNTIMWRDSWSTFSVPDTLAGGFGPGRQSWGSCLWLVRSGWCFQVGINAALGNMEEDNWRWHFYDTVKGSDWLGDQDAIHYVTEQAPTAMVELENYGMPFSRTEDGKIYQRAFGGQSLKFGKGRQAHRCCCVADRTGHSILHTSYGRSLRYDTSCFVEYFALDLLIENRECRGVIALCIEDGSIHHIRAKNTVVATGVKKLFF

SEQ ID NO: 919376 - protein, 150 aa, Homo sapiens; identical to SEQ ID NO: 919370

SEQ ID NO: 919377 - protein, 115 aa, Homo sapiens
MPLGRFVNTIMWRDSWSTFSVPDTLGNKHITGSLSLTAPVSPSWSSLCLHHTDEETEAKGWNHWVSLGGVVIWNLSGLAAPLLRSALTGSHHVSSWLSLNPPAGGFGPGRQSWGS

SEQ ID NO: 919378 - protein, 205 aa, Homo sapiens
MPLGRFVNTIMWRDSWSTFSVPDTLAGGFGPGRQSWGSCLWLVRSGWCFQVGINAALGNMEEDNWRWHFYDTVKGSDWLGDQDAIHYVTEQAPTAMVEVMGGRLWVLSWSVSSTRVLEKISHLGCDPMVCGPHSGTRLRVELHAATGQCGVPLRVSLRYDTSCFVEYFALDLLIENRECRGVIALCIEDGSIHHIRAKNTVVATG

SEQ ID NO: 919379 - protein, 150 aa, Homo sapiens; identical to SEQ ID NO: 919370

SEQ ID NO: 919380 - protein, 150 aa, Homo sapiens; identical to SEQ ID NO: 919370

SEQ ID NO: 919381 - protein, 150 aa, Homo sapiens; identical to SEQ ID NO: 919370

SEQ ID NO: 919382 - protein, 106 aa, Homo sapiens; identical to SEQ ID NO: 919372

SEQ ID NO: 919383 - protein, 150 aa, Homo sapiens; identical to SEQ ID NO: 919370

SEQ ID NO: 919384 - protein, 150 aa, Homo sapiens; identical to SEQ ID NO: 919370

SEQ ID NO: 919385 - protein, 319 aa, Homo sapiens
MDPQNQHGSGSSLVVIQQPSLDSRQRLDYEREIQPTAILSLDQIKAIRGSNEYTEGPSVVKRPAPRTAPRQEKHERTHEIIPINVNNNYEHRHTSHLGHAVLPSNARGPILSRSTSTGSAASSGSNSSASSEQGLLGRSPPTRPVPGHRSERAIRTQPKQLIVDDLKGSLKEDLTQHKFICEQCGKCKCGECTAPRTLPSCLACNRQCLCSAESMVEYGTCMCLVKGIFYHCSNDDEGDSYSDNPCSCSQSHCCSRYLCMGAMSLFLPCLLCYPPAKGCLKLCRRCYDWIHRPGCRCKNSNTVYCKLESCPSRGQGKPS

SEQ ID NO: 919386 - protein, 319 aa, Homo sapiens; identical to SEQ ID NO: 919385

SEQ ID NO: 919387 - protein, 319 aa, Homo sapiens; identical to SEQ ID NO: 919385

SEQ ID NO: 919388 - protein, 319 aa, Homo sapiens; identical to SEQ ID NO: 919385

SEQ ID NO: 919389 - protein, 319 aa, Homo sapiens; identical to SEQ ID NO: 919385

SEQ ID NO: 919390 - protein, 319 aa, Homo sapiens; identical to SEQ ID NO: 919385

SEQ ID NO: 919391 - protein, 63 aa, Homo sapiens
MRHVHAAARTRTWAGSHGLAPGHRFGLGFQMHARFPLIARTRDHYTWIPKEKDPNLTLFTPPR

SEQ ID NO: 919392 - protein, 319 aa, Homo sapiens; identical to SEQ ID NO: 919385

SEQ ID NO: 919393 - protein, 319 aa, Homo sapiens; identical to SEQ ID NO: 919385

SEQ ID NO: 919394 - protein, 641 aa, Homo sapiens
MLVVKGVCFKAHKNVLAAFSQYFRSLFQNSSSQKNDVFHLDVKNVSGIGQILDFMYTSHLDLNQDNIQVMLDTAQCLQVQNVLSLCHTFLKSATVVQPPGMPCNSTLSLQSTLTPDATCVISENYPPHLLQECSADAQQNKTLDESHPHASPSVNRHHSAGEISKQAPDTSDGSCTELPFKQPNYYYKLINFYSKQYHKHAAGPSQERVVEQPFAFSTSTDLTTVESQPCAVSHSECILESPEHLPSNFLAQPVNDSAPHPESDATCQQPVKQMRLKKAIHLKKLNFLKSQKYAEQVSEPKSDDGLTKRLESASKNTLEKASSQSAEEKESEEVVSCENFNCISETERPEDPAALEDQSQTLQSQRQYACELCGKPFKHPSNLELHKRSHTEQVTCRLTYDGILVKNHTSARSVERGKCFGGSGDLRRHVRTHTGEKPYTCEICNKCFTRSAVLRRHKKMHCKAGDESPDVLEELSQAIETSDLEKSQSSDSFSQDTSVTLMPVSVKLPVHPVENSVAEFDSHSGGSYCKLRSMIQPHGVSDQEKLSLDPGKLAKPQMQQTQPQAYAYSDVDTPAGGEPLQADGMAMIRSSLAALDNHGGDPLGSRASSTTYRNSEGQFFSSMTLWGLAMKTLQNENELDQ

SEQ ID NO: 919395 - protein, 314 aa, Homo sapiens
EFSNYILGLQPLATSSVTLLFTQEKNHTCVTSVVEEFSNFSNLKEHKKTHTADKVFTCDECGKSFNMQRKLVKHRIRHTGERPYSCSACGKCFGGSGDLRRHVRTHTGEKPYTCEICNKCFTRSAVLRRHKKMHCKAGDESPDVLEELSQAIETSDLEKSQSSDSFSQDTSVTLMPVSVKLPVHPVENSVAEFDSHSGGSYCKLRSMIQPHGVSDQEKLSLDPGKLAKPQMQQTQPQAYAYSDVDTPAGGEPLQADGMAMIRSSLAALDNHGGDPLGSRASSTTYRNSEGQFFSSMTLWGLAMKTLQNENELDQ

SEQ ID NO: 919396 - protein, 174 aa, Homo sapiens
LIPPRPIRMVSHPSCFCPAAAARTSSESASACLPLGAALFGAPSGEGDGGSSLSFVLPFPPTSAPLAAPVTFHPSLGRPSKAAPVVNNFGWQPHIKPGPEIIVPGTMAEQPNNEVAIVLSDIPRCPGKGGGAAGLAMPSPPGVEFFRSHMVVPLSEAAPRTCALQWLHFPGTAC

SEQ ID NO: 919397 - protein, 174 aa, Homo sapiens; identical to SEQ ID NO: 919396

SEQ ID NO: 919398 - protein, 152 aa, Homo sapiens
MDEAGNHHSQQTIARTENQTPHVLTHRWELTNENTWTQEGEHHTPPGPVSPVAAARGSQDWNIQNGISLETDQKLESSSGSYLQKYHLQHWGSNLSTVFEEDKHPKNGKDLKKIFHDNLSGPYLNSLKEFKCGTGGEKKSHYGLQLHLLPKR

SEQ ID NO: 919399 - protein, 152 aa, Homo sapiens
NNFLRVKPLGLRCSAMAAPQTNPDAERMYKFFVWFVSLVGLTEKNDIRTKTCGRVSYINIWGQEHSGRGKSNPQSPDLEGGQGGLIHRALEDEVRKVGTARQWQITGEKGSQWMQGRTVHQWDILKNCEEFWHYYDWGGGNVSGQATFMLKE

SEQ ID NO: 919400 - protein, 163 aa, Homo sapiens
MPKCHLLDHTPKLQHKKYFASILSSKTRDKKSASNKNLAQSLGLGICAQLNQAKLAAMTGIEFGIWLGTKIIKFQQEGKTQSKENKNHNKAIQGVKDKIASIKRNLIGLTELNNAKQEFHNAITSINSRINQADKRISELKDWLTEIRQSDKNKGSEQQSGGK

SEQ ID NO: 919401 - protein, 161 aa, Homo sapiens
GSLITMLEQASASPSFHSLSYFLKVQILGNEFRQSSLIHMPNPCLPGDPDEYEPTLEATVPPGLRDIHTHIHKPSSSVTALIAGSFSPTLTKEAKARETRPPGKDPALLQEGERTESGCTFTQKHNDHLTEDRVIRDTLRRWWVASRTAASRASASAGSSS

SEQ ID NO: 919402 - protein, 286 aa, Homo sapiens
MFVSDLRLEWNSHGGVPPGGPSHSSLPVGRRHPPVLRMVLEALQAGEQRRGTSVAAIKLYILHKYPTVDVLRFKYLLKQALATGMRRGLLARPLNSKARGATGSFKDQAAKQGEEPEGRQVSDAVCWQLRGEVSSQAQEENPAQEDGPRDGSQESGWAKGKGPKKPSEAKEDPPNVGKVKKAAKRPAKVQKPPPKPGAATEKARKQGGAAKDTRAQSGEARKVPPKPDKAMRAPSSAGGLSRKAKAKGSRSSQGSCVTCRGWCGDGGLDSHWSGGGEPALERGFLI

SEQ ID NO: 919403 - protein, 209 aa, Homo sapiens
IRKISLDQLGCRASAGALLDLCGFSSNMADSENQGPAEPSQAAAAAEAAAEEVMAEGGAQGGDCDSAAGDPDSAAGQMAEEPQTPAENAPKPKNDFIESLPNSVKCRVLALKKLQKRCDKIEAKFDKEFQALEKKYNDIYKPLLAKIQELTGEMEGCAWTLEGEEEEEEEYEDDEEEGEDEEEEEAAAEAAAGAKHDDAHAEMPDDAKK

SEQ ID NO: 919404 - protein, 180 aa, Homo sapiens
GTSDKNDSVSNTATEIKDEQKSGTVSSQKQPALKDTSDKNDSVSNTATEIKDEQKSGTVLPAVEQCLNRSLYRPDAVAQPVTEDEFALESEIISKLYIPKRKIISPRSIEDVLPPVEEAVDRCLYLLDRFAQAVTKDKFALESENISEPYFTNRRTISQQSAEKLDAACGIAKTDCTFSQ

SEQ ID NO: 919405 - protein, 745 aa, Homo sapiens
MDDKEPKRWPTLRDRLCSDGFLFPQYPIKPYHLKGIHRAVFYRDLEELKFVLLTRYDINKRDRKERTALHLACATGQPEMVHLLVSRRCELNLCDREDRTPLIKAVQLRQEACATLLLQNGADPNITDVFGRTALHYAVYNEDTSMIEKLLSYGANIEECSEDEYPPLFLAVSQRKVKMVEFLLKKKANINAVDYLGRSALIHAVTLGEKDIVILLLQHNIDVFSRDVYGKLAEDYASEAKNRVIFELIYEYERKKHEELSINSNPVSSQKQPALKATSGKEDSISNIATEIKDGQKSGTVSSQKQPALKDTSDKNDSVSNTATEIKDEQKSGTVLPAVEQCLNRSLYRPDAVAQPVTEDEFALESEIISKLYIPKRKIISPRSIEDVLPPVEEAVDRCLYLLDRFAQAVTKDKFALESENISEPYFTNRRTISQQSAEKLSSQKQPAEKATSDDKDSVSNIATEIKEGPISGTVSSQKQPAEKVIFKKKVSLLNIATRITGGGKSGTVSSQKQPPSKATSDKTDSALNIATEIKDGLQCGTVSSQKQPALKATTDEEDSVSNIATEIKDGEKSGTVSSQKQPALKATTDEEDSVLNIATEIKDGEKSETVSSQKQPALKATTDEEDSVSIIATEIKDGEKSGTVSSRKKPALKATSDEKDSFSNITREKKDGEISRTVSSQKPPALKATSDEEDSVLSIAREEKDGEKSRTVYFCHLLVPRDKVEAIKASTNTGRRTEVDANTV

SEQ ID NO: 919406 - protein, 290 aa, Homo sapiens
MDDKEPKRWPTLRDRLCSDGFLFPQYPIKPYHLKGIHRAVFYRDLEELKFVLLTRYDINKRDRKERTALHLACATGQPEMVHLLVSRRCELNLCDREDRTPLIKAVQLRQEACATLLLQNGADPNITDVFGRTALHYAVYNEDTSMIEKLLSYGANIEECSEDEYPPLFLAVSQRKVKMVEFLLKKKANINAVDYLGRSALIHAVTLGEKDIVILLLQHNIDVFSRDVYGKLAEDYASEAKNRVVFSETTSLEGYKWQGRFYLEYSHRNKGWTKIWDSVFSETTGLEGYK

SEQ ID NO: 919407 - protein, 163 aa, Homo sapiens
RAASRARVGSETAAQLRGGRGFMDRKNKVTYTKQKIPKKQALGQGFGIGLELIEGSNSTEVANLDRKVRGTIKGALTVKSVLVSAEVRNINSPELLAACPEHRQNRLHRPEKALSKELQVLEVGSVLNRHQNGNLFPCCGKDVRPVADSARFRLPIFLHQLSQ

SEQ ID NO: 919408 - protein, 162 aa, Homo sapiens
MLKTGPKAKPTNHQFIHSANICHTLTKRNGKNHCVLCKVLINGKKDFGLFTQMRMTFGAEDQGQRDCFKRPVPCPHPHSVKRSTYNLRSSDQPAQGTSHQFQIRWILALLPRLESSGAICKLRLLGSRHSPASASPAAGTTGARHHARLIFGIFSRDGVSPC

SEQ ID NO: 919409 - protein, 185 aa, Homo sapiens
EAVAVARRRELALVTSSARRLPTPLAGTWGPGAGVGTELSSEVQDSGQPGGGSQGHATCREEPESKREDAGLFTQMRMTFGAEDQGQRDCFKRPVPCPHPHSVKRSTYNLRSSDQPAQGTSHQFQIRWILALLPRLESSGAICKLRLLGSRHSPASASPAAGTTGARHHARLIFGIFSRDGVSPC

SEQ ID NO: 919410 - protein, 135 aa, Homo sapiens
MKQGVPSETQVFPTSVGDGRERIRERRVPGKQEAAGEYAAINSSAICSSPTLRLRYLLKPALCWAMCQMLGIKCWIFFIYFNQNHVSQQTEGRTDMIIKLSSVNPDVKCKTVLLFVLNALFWKISLFLLKMCYLC

SEQ ID NO: 919411 - protein, 150 aa, Homo sapiens
MDQKDSRALALGPGAAMTHCSPSHFAKLPLRPPPNNLDSAFREPRLRALCWGLKGFIPFLESQQARTTPSQSSGLHALHPILPLKGREGRMCLGTLRPTNDSALMEQPSVWGKVLEVHSFRKPLTSLYHALSEKLRIRKEQDPQETLMSG

SEQ ID NO: 919412 - protein, 150 aa, Homo sapiens; identical to SEQ ID NO: 919411

SEQ ID NO: 919413 - protein, 158 aa, Homo sapiens
TASSVQQQSSGGDLMAYDRRGRPGDRYDGMVGFSADETWDSAIDTWSPSEWQMAYEPQGGSGYDYSYAGGRGSYGDLGGPIITTQVTIPKDLAGSIIGKGGLQIKQIRHESGASIKIDEPLEGLEDWIITIRETQDQIQNAQYLLQNSVKQCADVEGV

SEQ ID NO: 919414 - protein, 404 aa, Homo sapiens
FKRSRNTDEMVELRILLQTKNAGAVIGKGGKNIKALRTDYNASVSVPDSSGPEHILSISAGIDTIGEILKKIIPTLEEGLQFPSPTATSQLPLESVAVECLSYQHYKGSDFDCELRLLIHQSLAGGIIGVEGAKIKELRENTQTTIKLFQECCPYSTDKRRAQPYDPNFYDETYDYGGFTIMFDDRCGRPVGFPMRGRGGFDRMPPGQGGRPMPPSRRDYDDMSPRQGPPPPPPGQGGEGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGLQIKQIRHESGASIKIDEPLEGLEDWIITIRETQDQIQNAQYLLQNSVKQCADVEGV

SEQ ID NO: 919415 - protein, 108 aa, Homo sapiens [sequence omitted]

SEQ ID NO: 919416 - protein, 135 aa, Homo sapiens
MVPNVEASLNVSDCGHLGSLKATKASPVVASFCYCEAPSESTLSYCSSSEARPSGMLGYEPGFLSCSHFHHPRDTSYSKPSFPAIPFPTPKHGKDNADIPPGPVGTTDFVVINTFRLTQQEHFCGDKVKSRMTIG

SEQ ID NO: 919417 - protein, 108 aa, Homo sapiens [sequence omitted]

SEQ ID NO: 919418 - protein, 362 aa, Homo sapiens
MDSPEVTFTLAYLVFAVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWLNSTEYGELCEKLRAPIRRAAHVVIHQSLGDLFLETFASLVEVNPAYSVPSSQELEACIGCMQTRASVKLVKTCQEAATGECQQCYCRPMWCLTCMGKWFASRQDPLRPDTWLASRVPCPTCRARFCILDVCTVR

SEQ ID NO: 919419 - protein, 401 aa, Homo sapiens
MDSPEVTFTLAYLVFAVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWAISPGWSWCDSCPVTPWGVASIFRSLCPAEGPSSSPPCRLNSTEYGELCEKLRAPIRRAAHVVIHQSLGDLFLETFASLVEVNPAYSVPSSQELEACIGCMQTRASVKLVKTCQEAATGECQQCYCRPMWCLTCMGKWFASRQDPLRPDTWLASRVPCPTCRARFCILDVCTVR

SEQ ID NO: 919420 - protein, 358 aa, Homo sapiens
WLGRGWVLNRPRVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWLNSTEYGELCEKLRAPIRRAAHVVIHQSLGDLFLETFASLVEVNPAYSVPSSQELEACIGCMQTRASVKLVKTCQEAATGECQQCYCRPMWCLTCMGKWFASRQDPLRPDTWLASRVPCPTCRARFCILDVCTVR

SEQ ID NO: 919421 - protein, 362 aa, Homo sapiens; identical to SEQ ID NO: 919418

SEQ ID NO: 919422 - protein, 362 aa, Homo sapiens; identical to SEQ ID NO: 919418

SEQ ID NO: 919423 - protein, 232 aa, Homo sapiens
MDSPEVTFTLAYLVFAVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWSWRPA

SEQ ID NO: 919424 - protein, 295 aa, Homo sapiens
MDSPEVTFTLAYLVFAVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWLNSTEYGELCEKLRAPIRRAAHVVIHQSLGDLFLETFASLVEVNPAYSVPSSQELEACIGCMQTRASA

SEQ ID NO: 919425 - protein, 55 aa, Homo sapiens
MQTRASVKLVKTCQEAATGECQQCYCRPMWCLTCMGKWFASRQDPLRPDTWLASR

SEQ ID NO: 919426 - protein, 328 aa, Homo sapiens
MCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWAISPGWSWCDSCPVTPWGVASIFRSLCPAEGPSSSPPCRLNSTEYGELCEKLRAPIRRAAHVVIHQSLGDLFLETFASLVEVNPAYSVPSSQELEACIGCMQTRASVKLVKTCQEAATGECQQCYCRPMWCLTCMGKWFASRQDPLRPDTWLASRVPCPTCRARFCILDVCTVR

SEQ ID NO: 919427 - protein, 232 aa, Homo sapiens; identical to SEQ ID NO: 919423

SEQ ID NO: 919428 - protein, 289 aa, Homo sapiens
MCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWLNSTEYGELCEKLRAPIRRAAHVVIHQSLGDLFLETFASLVEVNPAYSVPSSQELEACIGCMQTRASVKLVKTCQEAATGECQQCYCRPMWCLTCMGKWFASRQDPLRPDTWLASRVPCPTCRARFCILDVCTVR

SEQ ID NO: 919429 - protein, 362 aa, Homo sapiens; identical to SEQ ID NO: 919418

SEQ ID NO: 919430 - protein, 362 aa, Homo sapiens; identical to SEQ ID NO: 919418

SEQ ID NO: 919431 - protein, 143 aa, Homo sapiens [sequence omitted]

SEQ ID NO: 919432 - protein, 386 aa, Homo sapiens
EAADPAQQPAPGTGPAAELYSGTMQVTLKTLQPQTLTCKIDIDPEETVKALKEKTESEKGKVASLVAGQTLIYAGKILNDDTALKEYKIDEKNFVVVMVTEPKAVSTPALATTQQSAPASTTAVTSSTTTTVAQAPTPVPALAPPFTPAFITPVSVTVSSEPATASATKQEKPAEKPAETPVATSLTSTHSTSGDSSWSNLFEDATSALVMGQSYDNMVTEIMSMGYEREQVIAAPRASSNNPDRAVEYLLMGIPGDKVRLWLTPTKQLVLGLLSLQQWLQLQQLRQQQLQQPGFPRVACKNYLYIFTEFTLQQVLEWHLRLPIHKNCFCKTINNLHGTNFKDPFSDLIFIDHLTASSDIFNEIRPNSLKLADAKNLQMGERRLCL

SEQ ID NO: 919433 - protein, 124 aa, Homo sapiens
ALLPPLASRLPGLVWNPRHVLWRLWQGRQRASEGVLQPPHPPEAFPAHPGLHPLAGGPRTTPASSLHELVKHEENRLVFEDSEELAAQLQSQELGRAARTPPAQDARGWALPAVMTTSGWKAES

SEQ ID NO: 919434 - protein, 239 aa, Homo sapiens
MGATAGWAVTVYDKPASFFKEAPLDLQHRLFMKLGSTHSPFRARSEPEDPDTERSAFTERDSGSGLVTRLHERPALLVSSTSWTEFEQLTLDGQNLPSLVCVITGKGPLREYYSRLIHQKHFQHIQVCIPWLEGRGLPPLLGSVDLDVCLDTSSSGLDLPMKVVDMFRCCLPACAVNFKCLHELVKHEENRLVFEDSEELAAQLQSQELGRAARTPPAQDARGWALPAVMTTSGWKAES

SEQ ID NO: 919435 - protein, 564 aa, Homo sapiens
MPTTCCSGTTVFLTALQDTMQREELVKNATPPAEPARAEDLSPAPHVTPTSCCPTLAPAAPPASLGTILMTIMFASSQWSIEVGVDDHFLDLQQKTSLFKKVIEPPHSCNTHCGSCDSQASCTSCRDPNKVLLFGECQYESCAPQYYLDFSTNTCKGDNVKCQVPFSLLSSSWNSRGLHTLNGSAQQQESKAADRVLINELLGLRVDRKEDNLMQTFFLECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQVKNKQYKQIAGDGGV

SEQ ID NO: 919436 - protein, 197 aa, Homo sapiens
PKLLASRPPEKDVKMSSSCSGEFPSGFSMVPTDSPPGGDACQLQRQGTEYVIFQREIKLLGLRKLNKIQDNTEKEFRMLSDKFNQEIEIIKKEGEILELKNSTDILKNASGSFNNRIGQAKERIGELEDSLFENTQSDETKENKFSKSSRCVSLFFTYIKAKTYINMKEKTFSDKQKLRDNTRPVLQEMLKEVRKES

SEQ ID NO: 919437 - protein, 132 aa, Homo sapiens
ILSVMLDMMNWCNQIISEFDFILRIFLANVQPGPLRKLHKYNLWCSQLPCILPIGLTVILRSLTKYPALPLGLYDTNFDLRNSIIWETQDISGSGKLPQGINRFNGGRMDPRASNVLHRQGKNLPVGRSWIP

SEQ ID NO: 919438 - protein, 272 aa, Homo sapiens
AAIRRGTRRRATIMPGHLQEGFGCVVTNRFDQLFDDESDPFEVLKAAENKKKEAGRGGVGGPGAKSAAQAAAQTNSNAAGKQLRKESQKDRKNPLPRSVGVVDKKEETQPPVALKKEGIRRVGRRPDQQLQVDRPIIDRPIRGRGGLGRGRGGRGRGMGRGDGFDSRGKREFDRHSGSDRSSFSHYSGLKHEDKRGGSGSHNWGTVKDELTDLDQSNVTDETPEGEEHHPVADTENKENDVEEVKEEGPKEMTLDEWKAIQNKDRAKVEFNI

SEQ ID NO: 919439 - protein, 186 aa, Homo sapiens
MPAIYWINLVYTTSAFSKFYEQSVVADVSSNNKGGLLVHFWIVFVMPRAKGHIFCEDCVAAILKDSIQTSIINRTSVGSLQGLAVDMDSVVLNAGLRSDYSSTIGSDKGCSQYFYAEHLSLHYPLEISAASGRLMCHFKLVAIVGYLIRLSIKSIQIEADNCVTDSLTIYDSLLPIRSSILYRYDA

SEQ ID NO: 919440 - protein, 129 aa, Homo sapiens
MPAIYWINLVYTTSAFSKFYEQSVVADVSSNNKGGLLVHFWIVFVMPRAKGHIFCEDCVAAILKDSIQTSIINRTSVGSLQGLAVDMDSVVLNAGLRSDYSSTIGSGKFFHVVPPPPMLILFLAVIFIF

SEQ ID NO: 919441 - protein, 541 aa, Homo sapiens
GRCLLGGCLCFLKKKSPPDPRPARRWSERLSPDGALAPEGGRLQWPAGRWGQRAVGVGEPPAGEGAPPAPALESPVSPPCPRAALLAQPRALRAILKVTLGWGAGGARRAKPGQKMTEAALVEGQVKLRDGKKVAGAAERVARGRVSGAGGGRRGAGVATRVTEARGSNASLPKIAAAVTPPGNPRAPCGPGPPGAPGSADCLLMLVYKDKSERIKGLRERSSLTLEDICGLEPGLPYEGLVHTLAIVCLSQAIMLGFDSHEAMCAWDARIRYALGEGAGVFFLSSAEGEQISFLFDCIVRGISPTKGPFGCGRFYQTQSPPGPSTVEERVAQEALETLQLEKRLSLLSHAGRPGSGGDDRSLSSSSSEASHLDVSANNRLTAWPEQSSSSASTSQEGPRPAAAQAAGEAMVGASRHPPSRCVRGVQEVGRQSSSDSGIALAATPLTPAASRPTRAQPGRVAGQDELGSLLSLPAAGAPEPACAPACPGQSSTRCPPPCGPTMTHHAAFAWLLETTAPPHRAAPTTVRPGTQAARQQEPLP

SEQ ID NO: 919442 - protein, 885 aa, Homo sapiens
CDQFRTLPLKRCEVSWVMLMLLVWNMIFAVRLYTSPHCNWEEEIWRAVEDATSDEEDSVLNIAREKKDGEKSRTVSSRKKAALKATSDEKDSVLNIARGKKHGEKTRRVSSHKQPALKATSDKENSVPNMATETKDEQISGTVSSQKQPALKATSDKKDSVSNIPTEIKDGQQSGTVSSQKQLAWKATSVKKDSVSNIATEIKDGQIRGTVSSQRQPALKATGDEKDSVSNIAREIKDGEKSGTVSPQKQSAQKVIFKKKVSLLNIATRITGGWKSGTEYPENLPTLKATIENKNSVLNTATKMKDVQTSTPEQDLEMASEGEQKRLEEYENNQPQVKNQIHSRDDLDDIIQSSQTVSEDGDSLCCNCKNVILLIDQHEMKCKDCVHLLKIKKTFCLCKRLTELKDNHCEQLRVKIRKLKNKASVLQKRLSEKEEIKSQLKHETLELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNEETLAETIACYSGQLAALTDENTTLRSKLEKQRESGQRLETEMQSYRCRLNAALCDHDQSHSSKRDQELAFQGTVDKCCHLQENLNSHVLILSLQLSKAESKFRVLETELHYTGEALKEKALVFEHVQSELKQKQSQMKDIEKMYKSGYNTMEKCIEKQERFCQLKKQNMLLQQQLDDARNKADNQEKAILNIQARCDARVENLQAECRKHRLLLEEDNKMLVNELNHSKEKKCQYEKEKAEREVAVRQLQQKQDDVLNKRSATKALLDASSRHCIYLENGMQDSRKKLDQMRSQVCMQLCTPTTVNL

SEQ ID NO: 919443 - protein, 574 aa, Homo sapiens
MRLGPSDGLEGEQKRLEEYENNQPQVKNQIHSRDDLDDIIQSSQTVSEDGDSLCCNCKNVILLIDQHEMKCKDCVHLLKIKKTFCLCKRLTELKDNHCEQLRVKIRKLKNKASVLQKRLSEKEEIKSQLKHETLELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNEETLAETIACYSGQLAALTDENTTLRSKLEKQRESGQRLETEMQSYRCRLNAALCDHDQSHSSKRDQELAFQGTVDKCCHLQENLNSHVLILSLQLSKAESKFRVLETELHYTGEALKEKALVFEHVQSELKQKQSQMKDIEKMYKSGYNTMEKCIEKQERFCQLKKQNMLLQQQLDDARNKADNQEKAILNIQARCDARVENLQAECRKHRLLLEEDNKMLVNELNHSKEKKCQYEKEKAEREVAVRQLQQKQDDVLNKRSATKALLDASSRHCIYLENGMQDSRKKLDQMRSQVCMQLCTPTTVNL

SEQ ID NO: 919444 - protein, 353 aa, Homo sapiens
MQDEIARLRLEKDTIKNQNLEKKYLKDFEIVKRKHEDLQKALKRNEETLAETIACYSGQLAALTDENTTLRSKLEKQRESGQRLETEMQSYRCRLNAALCDHDQSHSSKRDQELAFQGTVDKCCHLQENLNSHVLILSLQLSKAESKFRVLETELHYTGEALKEKALVFEHVQSELKQKQSQMKDIEKMYKSGYNTMEKCIEKQERFCQLKKQNMLLQQQLDDARNKADNQEKAILNIQARCDARVENLQAECRKHRLLLEEDNKMLVNELNHSKEKKCQYEKEKAEREVAVRQLQQKQDDVLNKRSATKALLDASSRHCIYLENGMQDSRKKLDQMRSQVCMQLCTPTTVNL

SEQ ID NO: 919445 - protein, 157 aa, Homo sapiens
NIRPIPTPAEQDLEMASEGEQKRLEEYENNQPQVKNQIHSRDDLDDIIQSSQTVSEDGDSLCCNCKNVILLIDQHEMKCKDCVHLLKIKKTFCLCKRLTELKDNHCEQLRVKIRKLKNKASVLQKRLSEKEEIKSQLKHETLELEKELCSLRYDLVL

SEQ ID NO: 919446 - protein, 582 aa, Homo sapiens
NIRPIPTPAEQDLEMASEGEQKRLEEYENNQPQVKNQIHSRDDLDDIIQSSQTVSEDGDSLCCNCKNVILLIDQHEMKCKDCVHLLKIKKTFCLCKRLTELKDNHCEQLRVKIRKLKNKASVLQKRLSEKEEIKSQLKHETLELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNEETLAETIACYSGQLAALTDENTTLRSKLEKQRESGQRLETEMQSYRCRLNAALCDHDQSHSSKRDQELAFQGTVDKCCHLQENLNSHVLILSLQLSKAESKFRVLETELHYTGEALKEKALVFEHVQSELKQKQSQMKDIEKMYKSGYNTMEKCIEKQERFCQLKKQNMLLQQQLDDARNKADNQEKAILNIQARCDARVENLQAECRKHRLLLEEDNKMLVNELNHSKEKKCQYEKEKAEREVAVRQLQQKQDDVLNKRSATKALLDASSRHCIYLENGMQDSRKKLDQMRSQVCMQLCTPTTVNL

SEQ ID NO: 919447 - protein, 155 aa, Homo sapiens
MSKSLPNKKKMLKQKFLNEIDHQCLWVVGKDLDQKEEMSESCKNQNGVTCVKTLTNRAGEGHELEDKTRLKNSYCRLGSPRSKTSENLVSGEGPLPNSCTVSFGYNILWLKGGSPDLVFLQLNSLTMMGDSDTSSGMIFSQEACNLESSHKECAT

SEQ ID NO: 919448 - protein, 369 aa, Homo sapiens
METAMCVCCPCCTWQRCCPQLCSCLCCKFIFTSERNCTCFPCPYKDERNCQFCHCTCSESPNCHWCCCSWANDPNCKCCCTASSNLNCYYYESRCCRNTIITFHKGRLRSIHTSSKTALRTGSSDTQVDEVKSIPANSHLVNHLNCPMCSRLRLHSFMLPCNHSLCEKCLRQLQKHAEVTENFFILICPVCDRSHCMPYSNKMQLPENYLHGRLTKRYMQEHGYLKWRFDRSSGPILCQVCRNRRIAYKRCITCRLNLCNDCLKAFHSDVAMQDHVFVDTSAEEQDEKICIHHPSSRIIEYCRNDNKLLCTFCKFSFHNGHDTISLIDACSERAASLFSAIAKFKAGPPLFHSFSLTSSSGTHGEDGVG

SEQ ID NO: 919449 - protein, 345 aa, Homo sapiens
GFLKLRSILQEKEKIIMEQIENLEVSRQKEIEKYVYVTTMKVNEMDGLIAYSKEALKETGQVAFLQSAKILVDQIEDGIQTTYRPDPQLRLHSINYVPLDFVELSSAIHELFPTGPKKVRSSGDSLPSPYPVHSETMIARKVTFSTHSLGNQHIYQRSSSMLSFSNTDKKAKVGLEACGRAQSATPAKPTDGLYTYWSAGADSQSVQNSSSFHNWYSFNDGSVKTPGPIVIYQTLVYPRAAKVYWTCPAEDVDSFEMEFYEVITSPPNNVQMELCGQIRDIMQQNLELHNLTPNTEYVFKVRAINDNGPGQWSDICKVVTPDGHGKNRAKWGLLKNIQSALQKHF

SEQ ID NO: 919450 - protein, 102 aa, Homo sapiens; identical to SEQ ID NO: 812804

SEQ ID NO: 919451 - protein, 230 aa, Homo sapiens
RSNLHQASASGLPPCLWASSAHRRRLPRSPLGLALTLLLLLTPGLALGLGFLAAQFASPRLPAGRAFPSHVACLGKFHFASDAPGRDALERRPRPEAVRLATPLRWRPSHAPKGSSTPYPWPLKNCGKQERAQQVSLYFRCIVSSRFRRLTLLLCSRERRERAQGLKHGGRRRPAQSRRPALEASIEHTVDGAEEGGPALVVEGDDDACVGKCLQERLLLAVWVLKRSSK

SEQ ID NO: 919452 - protein, 193 aa, Homo sapiens
RSNLHQASASGLPPCLWASSAHRRRLPRSPLGLALTLLLLLTPGLALGLGFLAAQFASPRLPAGRAFPSHVACLGKFHFASDAPGRDALERRPRPEAVRLATPLRWRPSHAPKGSSTPYPWPLKNCGKQERAQQVSLYFRCIVSSRFRRLTLLLCSRERRERAQGLKHGGRRRPATNYQHCRGAPGSYQAQPR

SEQ ID NO: 919453 - protein, 102 aa, Homo sapiens; identical to SEQ ID NO: 812804

SEQ ID NO: 919454 - protein, 219 aa, Homo sapiens
RSNLHQASASGLPPCLWASSAHRRRLPRSPLGLALTLLLLLTPGLALGLGFLAAQFASPRLPAGRAFPSHVACLGKFHFASDAPGRDALERRPRPEAVRLATPLRWRPSHAPKGSSTPYPWPLKNCGKQERAQQVSLYFRCIVSSRFRRLTLLLCSRERRERAQGLKHGGRRRPAAQYSMVYMCHIVLIQSIIDAHLGWFQVFAIVNSAAINIHMYVSL

SEQ ID NO: 919455 - protein, 74 aa, Homo sapiens
MADDVDQQQTTNTVEEPLDLIRLSLDERIYVKMRNDRELRGRLHAYDQHLNMILGDVEETVTTIEIDGSVALGT

SEQ ID NO: 919456 - protein, 105 aa, Homo sapiens
FDNFTIRHTQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 919457 - protein, 762 aa, Homo sapiens
MTEIKLKGNSRETKENEIQDLLRAKRELESKLQRLQAQGIQVFDPGESDSDDNCTDVTAAGTQCEYWTGGALGSEPSIGSMIQLQQSFRGPEFAHSSIDVEGPFANVNRDDWDIAVASLLQVTPLFSHSLWSNTVRCYLIYTDETQPEMDLFLKDYSPKLKRMCETMGYFFHAVYFPIDVENQYLTVRKWEIEKSSLVILFIHLTLPSLLLEDCEEAFLKNPEGKPRLIFHRLEDGKVSSDSVQQLIDQVSNLNKTSKAKIIDHSGDPAEGVYKTYICVEKIIKQDILGFENTDLETKDLGSEDSIPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQCFQCQDTLSLYRLVLHSIRESMANDVDKELMKQEDIEYCLLSFDSQDRVTWRSADELPWLFQQQGSKQKLHDCLLNLFVSQNLYKRGHFAELLSYWQFVGKDKSAMATEYFDSLKQYEKNCEGEDNMSCLADLYETLGRFLKDLGLLSQAIVPLQRSLEIRETALDPDHPRVAQSLHQLASVYVQWKKFGNAEQLYKQALEISENAYGADHPYTARELEALATLYQKQNKYEQAEHFRKKSFKIHQKAIKKKGNLYGFALLRRRALQLEELTLGKDTPDNARTLNELGVLYYLQNNLE

SEQ ID NO: 919458 - protein, 990 aa, Homo sapiens
WREQQHLNMTEIKLKGNSRETKENEIQDLLRAKRELESKLQRLQAQGIQVFDPGESDSDDNCTDVTAAGTQCEYWTGGALGSEPSIGSMIQLQQSFRGPEFAHSSIDVEGPFANVNRDDWDIAVASLLQVTPLFSHSLWSNTVRCYLIYTDETQPEMDLFLKDYSPKLKRMCETMGYFFHAVYFPIDVENQYLTVRKWEIEKSSLVILFIHLTLPSLLLEDCEEAFLKNPEGKPRLIFHRLEDGKVSSDSVQQLIDQVSNLNKTSKAKIIDHSGDPAEGVYKTYICVEKIIKQDILGFENTDLETKDLGSEDSIPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQCFQCQDTLSLYRLVLHSIRESMANDVDKELMKQEDIEYCLLSFDSQDRVTWRSADELPWLFQQQGSKQKLHDCLLNLFVSQNLYKRGHFAELLSYWQFVGKDKSAMATEYFDSLKQYEKNCEGEDNMSCLADLYETLGRFLKDLGLLSQAIVPLQRSLEIRETALDPDHPRVAQSLHQLASVYVQWKKFGNAEQLYKQALEISENAYGADHPYTARELEALATLYQKQNKYEQAEHFRKKSFKIHQKAIKKKGNLYGFALLRRRALQLEELTLGKDTPDNARTLNELGVLYYLQNNLETADQFLKRSLEMRERVLGPDHPDCAQSLNNLAALCNEKKQYDKAEELYERALDIRRRALAPDHPSLAYTVKHLAILYKKMGKLDKAVPLYELAVEIRQKSFGPKHPSVATALVNLAVLYSQMKKHVEALPLYERALKIYEDSLGRMHPRVGETLKNLAVLSYEGGDFEKAAELYKRAMEIKEAETSLLGGKAPSRHSSSGDTFSLKTAHSPNVFLQQGQR

SEQ ID NO: 919459 - protein, 271 aa, Homo sapiens
MYYAVSQARVNAVPGTMLRPQRPGDLQLGASLYELVGYRQPPSSSSSSTSSTSSTSSSSTTAPLLPKAAREKPEAPAEPPGPGPGSGAHPGGSARPDAKEEQQQQLRRKINSRERKRMQDLNLAMDALREVILPYSAAHCQGAPGRKLSKIATLLLARNYILLLGSSLQELRRALGEGAGPAAPRLLLAGLPLLAAAPGSVLLAPGAVGPPDALRPAKYLSLALDEPPCGQFALPGGGAGGPGLCTCAVCKFPHLVPASLGLAAVQAQFSK

SEQ ID NO: 919460 - protein, 271 aa, Homo sapiens; identical to SEQ ID NO: 919459

SEQ ID NO: 919461 - protein, 271 aa, Homo sapiens; identical to SEQ ID NO: 919459

SEQ ID NO: 919462 - protein, 271 aa, Homo sapiens; identical to SEQ ID NO: 919459

SEQ ID NO: 919463 - protein, 213 aa, Homo sapiens [sequence omitted]

SEQ ID NO: 919464 - protein, 197 aa, Homo sapiens
MGKGDPKKPRGKMSSYAFFVQTSEFSKKCSERWKTMSAKEKGKFEDMAKADKARYEREMKTYIPPKGETKKKFKDPNAPKRLPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEEEDDDDE

SEQ ID NO: 919465 - protein, 213 aa, Homo sapiens [sequence omitted]

SEQ ID NO: 919466 - protein, 162 aa, Homo sapiens
MSAKEKGKFEDMAKADKARYEREMKTYIPPKGETKKKFKDPNAPKRLPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEEEDDDDE

SEQ ID NO: 919467 - protein, 1171 aa, Homo sapiens
KAYIVKDVQQYILHRLDQEEALRQHLTKETAEMLNQLHIKSSGCFLYLERVLDGVVENFIMLREIRDIPGTLNGLYLWLCQRLFVRKQFAKVQPILNVILAACRPLTITELYHAVWTKNMSLTLEDFQRKLDILSKLLVDGLGNTKILFHYSFAEWLLDVKHCTQKYLCNAAEGHRMLAMSYTCQAKNLTPLEAQEFALHLINSNLQLETAELALWMIWNGTPVRDSLSTLIPKEQEVLQLLVKAGAHVNSEDDRTSCIVRQALEREDSIRTLLDNGASVNQCDSNGRTLLANAAYSGSLDVVNLLVSRGADLEIEDAHGHTPLTLAARQGHTKVVNCLIGCGANINHTDQDGWTALRSAAWGGHTEVVSALLYAGVKVDCADADSRTALRAAAWGGHEDIVLNLLQHGAEVNKADNEGRTALIAAAYMGHREIVEHLLDHGAEVNHEDVDGRTALSVAALCVPASKGHASVVSLLIDRGAEVDHCDKDGMTPLLVAAYEGHVDVVDLLLEGGADVDHTDNNGRTPLLAAASMGHASVVNTLLFWGAAVDSIDSEGRTVLSIASAQGNVEVVRTLLDRGLDENHRDDAGWTPLHMAAFEGHRLICEALIEQGARTNEIDNDGRIPFILASQEGHYDCVQILLENKSNIDQRGYDGRNALRVAALEGHRDIVELLFSHGADVNCKDADGRPTLYILALENQLTMAEYFLENGANVEASDAEGRTALHVSCWQGHMEMVQVLIAYHADVNAADNEKRSALQSAAWQGHVKVVQLLIEHGAVVDHTCNQGATALCIAAQEGHIDVVQVLLEHGADPNHADQFGRTAMRVAAKNGHSQIIKLLEKYGASSLNGCSPSPVHTMEQKPLQSLSSKVQSLTIKSNSSGSTGGGDMQPSLRGLPNGPTHAFSSPSESPDSTVDRQKSSLSNNSLKSSKNSSLRTTSSTATAQTVPIDSFHNLSFTEQIQQHSLPRSRSRQSIVSPSSTTQSLGQSHNSPSSEFEWSQVKPSLKSTKASKGGKSENSAKSGSAGKKAKQSNSSQPKVLEYEMTQFDRRGPIAKSGTAAPPKQMPAESQCKIMIPSAQQEIGRSQQQFLIHQQSGEQKKRNGIMTNPNYHLQSNQVFLGRVSVPRTMQDRGHQEVLEGYPSSETELSLKQALKLQIEGSDPSFNYKKETPL

SEQ ID NO: 919468 - protein, 216 aa, Homo sapiens
KVQSEKRRESYRERTPRVMLKDVDEAGSHHSQQSYTGTENQTPHVLTRTTCLIALLSDKDLTVANVGDSRGVLCDKDGNAIPLSHDHKPYQLKERKRIKRAGGFISFNGSWRVQGILAMSRSLGDYPLKNLNVVIPDPDILTFDLDKLQPEFMILASDGLWDAFSNEEAVRFIKERLDEPHFGAKSIVLQSFYRGCPDNITVMVVKFRNSSKTEEQ

SEQ ID NO: 919469 - protein, 141 aa, Homo sapiens
LTPVAGLMCHFLKAFNMFAGLATGAKQIVLEIFKAGVQVSPVLPLALGRSASLLEPGTQQPSCPATPFLSFLSMQESTCKTNNGLGVVSPLHHQFKKNLTPVQEPGNHALPNNGYRGCKEEADSKPTEVFIEEREVNSPWS

SEQ ID NO: 919470 - protein, 141 aa, Homo sapiens; identical to SEQ ID NO: 919469

SEQ ID NO: 919471 - protein, 128 aa, Homo sapiens
MRAENCRVGAWEPWKPWPGIFHRTPGAPEATPSFSESGCRHFCPEQRPVPLTGPEVGGMGVPEGGYDPSQPPCPHLRKQGHNTCLANVVRTSGEDERAYIPKPTRLKMHTRDTASGCPDDMCQGGHTF

SEQ ID NO: 919472 - protein, 128 aa, Homo sapiens; identical to SEQ ID NO: 919471

SEQ ID NO: 919473 - protein, 128 aa, Homo sapiens; identical to SEQ ID NO: 919471

SEQ ID NO: 919474 - protein, 185 aa, Homo sapiens
MKSQKNMELTLLSQKVDFCSHFDTILRCNLHPTHAASTAPPRFFPPRPRRVPGPGERLKIAGDSTFNRIPRWWEEDAVDTGVPRVTLGLVGPPRRVPRELDGSLRAAFYAERRGLERTTPRRLGSPRPAAEVHSARPATLKPVPRTTPWRRWRLLRHHAGVGAYAIARPRVLARYWLAVKQWEES

SEQ ID NO: 919475 - protein, 185 aa, Homo sapiens; identical to SEQ ID NO: 919474

SEQ ID NO: 919476 - protein, 185 aa, Homo sapiens; identical to SEQ ID NO: 919474

SEQ ID NO: 919477 - protein, 226 aa, Homo sapiens
YQRRVAITAGEAEKKKPVFEKSFVSLQMDFKIEHTWDGFPVKHEPVFIRLNPGDRGVMMDISAPFFRDPPAPLGEPGKPFNELWDYEVVEAFFLNDITEQYLEVELCPHGQHLVLLLSGRRNVWKQELPLSFRVSRGETKWEGKAYLPWSYFPPNVTKFNSFAIHGSKDKRSYEALYPVPQHELQQGQKPDFHCLEYFKSFNFNTLLGEEWKQPESDLWLIEKCDI

SEQ ID NO: 919478 - protein, 183 aa, Homo sapiens
MDFKIEHTWDGFPVKHEPVFIRLNPGDRGVMMDISAPFFRDPPAPLGEPGKPFNELWDYEVVEAFFLNDITEQYLEVELCPHGQHLVLLLSGRRNVWKQELPLSFRVSRGETKWEGKAYLPWSYFPPNVTKFNSFAIHGSKDKRSYEALYPVPQHELQQGQKPDFAWRRVETTGIRPVANREM

SEQ ID NO: 919479 - protein, 141 aa, Homo sapiens
SWVEPKAEPSPVTSAEKKKPVFEKSFVSLQMDFKIEHTWDGFPVKHEPVFIRLNPGDRGVMMDISAPFFRDPPAPLGEPGKPFNELWDYEVVEAFFLNDITEQYLEVELCPKNFLYRSECPEERQNGKAKLISLGVIFHQM

SEQ ID NO: 919480 - protein, 229 aa, Homo sapiens
SWVEPKAEPSPVTSAEKKKPVFEKSFVSLQMDFKIEHTWDGFPVKHEPVFIRLNPGDRGVMMDISAPFFRDPPAPLGEPGKPFNELWDYEVVEAFFLNDITEQYLEVELCPHGQHLVLLLSGRRNVWKQELPLSFRVSRGETKWEGKAYLPWSYFPPNVTKFNSFAIHGSKDKRSYEALYPVPQHELQQGQKPDFHCLEYFKSFNFNTLLGEEWKQPESDLWLIEKCDI

SEQ ID NO: 919481 - protein, 199 aa, Homo sapiens
MDFKIEHTWDGFPVKHEPVFIRLNPGDRGVMMDISAPFFRDPPAPLGEPGKPFNELWDYEVVEAFFLNDITEQYLEVELCPHGQHLVLLLSGRRNVWKQELPLSFRVSRGETKWEGKAYLPWSYFPPNVTKFNSFAIHGSKDKRSYEALYPVPQHELQQGQKPDFHCLEYFKSFNFNTLLGEEWKQPESDLWLIEKCDI

SEQ ID NO: 919482 - protein, 208 aa, Homo sapiens [sequence omitted]

SEQ ID NO: 919483 - protein, 199 aa, Homo sapiens
SLQTKHLMSNTNEIVTGIPQGNGDASTHGCVHTHTQRKCVLYNLQIKRIPYWVRYSHRPPGNLQPFKHYVVIHVPIKNHLQVPQDIDFPSNSQTPILQVCWSLLEVHSRPCLPGYQQQWLQNSKDCCLLLPLEASSEGGTCQMPAGAFLYEVSVNPCWCQVTPLLMTWGRASRITAVEPLGIKDSCKIITIVANCNRQK

SEQ ID NO: 919484 - protein, 441 aa, Homo sapiens
KRQFMSSHSLSPGLKAQLCLQQVKYLGLILARGIRALSKEQTQPILAYPCPKTLKQLWGFLGITGFCRLWIPGYSEIARPFYTLIKETQRANTHLVQWEPGAETAFKILKQALVQAPALSLPTGQNFSLYVTERAGIALGVLTQTCGTTSQPVAYLRTSAQLAELVALTRALELGKGKSINVYTDSKYAYLILYAHAAIWKEGEFLTFGGNSIKYHKEIMELLHTVQKLEEVAVLHCQSHQKGEREKAEGNRWADAEAKIAARWNLPLEITMEGPLVWSNPNQEVKPQYSLTKREWGLSWGPSFLPSGWLMTEEGKVLIPEASQWKMLKTLHQTFHMDIENTHQMAKSLFTGPNLLRTIRQGVKACEVCQRNNPLVHRGEAGAASFFPWQRPWCNSPRAPLTIPINVGASICHWSIEGQAWWSSSAHLCPLKPGLNRKLMA

SEQ ID NO: 919485 - protein, 519 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLVIFISTVIDLTVSLTSIYRAALEMDSRICGNIGYSCSLATAAIFLFSPAILLLPISLLIGLFGYLEGLQELMLI

SEQ ID NO: 919486 - protein, 130 aa, Homo sapiens
ESEGKLNVSKVKKADQARPLTRYLPVRKEDFDLRSHVETAGHNIDTCYHVSITEKTCRGFLIKMGGKIKTWKKRWFVFDRNKRTFSYYADNHRYWGGSGATMLSQPLNKWFFDHLTTPNKNSNSYLLFSL

SEQ ID NO: 919487 - protein, 1251 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKEKVKLDAEREKLERLQELYSEQKTQLDNCPESMREQLQQQLKRDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSTLEVWKKGKNSIKKAIYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 919488 - protein, 882 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEVCRHDVSFIHCFSSCQKLTHGQLKMRSTRTCMTNVYLFGQRGRVRLSL

SEQ ID NO: 919489 - protein, 1199 aa, Homo sapiens
TTTTKFAAASTHSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSTLEVWKKGKNSIKKAIYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 919490 - protein, 678 aa, Homo sapiens
PTRPPHASQRSQELAAMEETRIVILNNLEELKQKIKDINDQMDESFRELDMECALLDGEQKSETTELMKEKEILDHLNRKIAELEKNIVGEKTKEKVKLDAEREKLERLQELYSEQKTQLDNCPESMREQLQQQLKRDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSTLEVWKKGKNSIKKAIYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 919491 - protein, 1208 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSTLEVWKKGKNSIKKAIYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 919492 - protein, 849 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSTLEVWKKGKNSIKKASI

SEQ ID NO: 919493 - protein, 626 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRENCIVL

SEQ ID NO: 919494 - protein, 947 aa, Homo sapiens
MLLLNPDSSKIMEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKLDMECALLDGEQKSETTELMKEKEILDHLNRKIAELEKNIVGEKTKDADLLDVESKHFEDLEFQQLEHESRLDEEKENLTQQLLREVAEYQRNIVSRKGYISVNEINEPCGNSTNLSPSTQFPADADAVATEPATAVLASQPQTPWPEFMATSVDPLPLNDTPPPLPAKKHRRQQQQQEQQNCPEGEKVLTCFVHWLFCHPHGDHHNNFWYVVEWNVNLCDLMPAQALPQVLPTCLRGSLWQEKRQAHLPLGQSNSCGSVLPPSLAAMAKDSESRRMLRAIREQAIAVTQGKASNLKCQVTEHQGKEKTSWPGTVAHACNPSTLGGRGRQITRSRDQDNPGQHGETPSLLKIQKLAEYGGALL

SEQ ID NO: 919495 - protein, 1208 aa, Homo sapiens; identical to SEQ ID NO: 919491

SEQ ID NO: 919496 - protein, 1235 aa, Homo sapiens
MEEEDTKREVPKEDGVGDVQHFDSSKIMEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSTLEVWKKGKNSIKKAIYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 919497 - protein, 1175 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSTLEVWKKGKNSIKKAIYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKVNISFLNSYNLNA

SEQ ID NO: 919498 - protein, 426 aa, Homo sapiens
MATSVDPLPLNDTPPPLPAKKHRRQQQQQEQQNCPEGEKVLTCFVHWLFCHPHGDHHNNFWYVVEWNVNLCDLMPAQALPQVLPTCLRGSLWQEKRQAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 919499 - protein, 798 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEVSYDFTCRFMLP

SEQ ID NO: 919500 - protein, 482 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKD

SEQ ID NO: 919501 - protein, 138 aa, Homo sapiens
CTRSSRPALPDPGNEGLSTRASGCGGCTGSPSSASPPALRSISRRASAAFPWGRARDLQPAMPEPPTPSVGSCAARASSRSAIPCSTAPSPINHPRAEECGRTARDWQAAPSAAPLRDPLGEANWAPESGGDVENLYV

SEQ ID NO: 919502 - protein, 169 aa, Homo sapiens
KNHMEVITHTLKEQFHISHHSTLHNVTSKGHTFYLIIRSTENLCLTGPANLCHAGSLPYLFNAALPSSPPDPNPLYPQEIGTVVLTNGIAESTESSLIPFLPSPPHGTTAGQTNGDYRPCVRHTPAAAQASELTLPPDVPVTLDFFLQLRHIWLSSPGHLFPWSGALFP

SEQ ID NO: 919503 - protein, 169 aa, Homo sapiens; identical to SEQ ID NO: 919502

SEQ ID NO: 919504 - protein, 157 aa, Homo sapiens
SPHLLICFWSLGFRVYMGTGWRGMASQKATFGAHNACSHLRPRVSRLEGWDFAGEPPSSTQYFPVFCPYQNYLLSSTTEIRVFPSSFPDLSLWQVFLSPEVLFSLPSQMAKGTSPHQLTFEESSQLMDTNPSAANSHTNVHHMHIQDYEALYDMELY

SEQ ID NO: 919505 - protein, 600 aa, Homo sapiens
MRALDDMDHEGRDTLAREELRQGLSELPAIHDLHQGILEELEERLSNWESQQKVADVFLAREQGFDHHATHILQFDRYLGLLSENCLHSPRLAAAVREFEQSVQGGSQTAKHRLLRVVQRLFQYQVLLTDYLNNLCPDSAEYDNTQGALSLISKVTDRANDSMEQGENLQKLVHIEHSVRGQGDLLQPGREFLKEGTLMKVTGKNRRPRHLFLMNDVLLYTYPQKDGKYRLKNTLAVANMKVSRPVMEKVPYALKIETSESCLMLSARLQVRKSKVKALTDSVSAHARSSCAERDEWYGCLSRALPEDYKAQALAAFHHSVEIRERLGVSLGERPPTLVPVTHVMMCMNCGCDFSLTLRRHHCHACGKIVCRNCSRNKYPLKYLKDRMAKVCDGCFGELKKRGRAVPGLMRVTERPVSMSFPLSSPRFSGSAFSSVFQSINPSTFKKQKKVPSALTEYPSRLHRSRGLFILKEPNSCVGPSMSSPHPRGPNPAQVAASGEGSAISGYLSRCKRGKRHWKKLWFVIKGKVLYTYMASEDKVALESMPLLGFTIAPEKEEGSSEVGPIFHLYHKKTLFYSFKAEDTNSAQRWIEAMEDASVL

SEQ ID NO: 919506 - protein, 100 aa, Homo sapiens
ELTPEGKTSLRKTGKRHWKKLWFVIKGKVLYTYMASEDKVALESMPLLGFTIAPEKEEGSSEVGPIFHLYHKKTLFYSFKAEDTNSAQRWIEAMEDASVL

SEQ ID NO: 919507 - protein, 100 aa, Homo sapiens; identical to SEQ ID NO: 919506

SEQ ID NO: 919508 - protein, 563 aa, Homo sapiens
MRALDDMDHEGRDTLAREELRQGLSELPAIHDLHQGILEELEERLSNWESQQKVADVFLAREQGFDHHATHILQFDRYLGLLSENCLHSPRLAAAVREFEQSVQGGSQTAKHRLLRVVQRLFQYQVLLTDYLNNLCPDSAEYDNTQGALSLISKVTDRANDSMEQGENLQKLVHIEHSVRGQGDLLQPGREFLKEGTLMKVTGKNRRPRHLFLMNDVLLYTYPQKDGKYRLKNTLAVANMKVSRPVMEKVPYALKIETSESCLMLSARLQVRKSKVKALTDSVSAHARSSCAERDEWYGCLSRALPEDYKAQALAAFHHSVEIRERLGVSLGERPPTLVPVTHVMMCMNCGCDFSLTLRRHHCHACGKIVCRNCSRNKYPLKYLKDRMAKVCDGCFGELKKRGRAVPGLMRVTERPVSMSFPLSSPRFSGSAFSSVFQSINPSTFKKQKKVPSALTEVAASGEGSAISGYLSRCKRGKRHWKKLWFVIKGKVLYTYMASEDKVALESMPLLGFTIAPEKEEGSSEVGPIFHLYHKKTLFYSFKAEDTNSAQRWIEAMEDASVL

SEQ ID NO: 919509 - protein, 100 aa, Homo sapiens; identical to SEQ ID NO: 919506

SEQ ID NO: 919510 - protein, 326 aa, Homo sapiens
LFSRMLVYWYQFNVVVHFHSVDKDIPETGKKKRFNWTYSSTWLGRPCGESWQMAKDTSYMVAARENEEDAKAEIPDKTIRSHETCPLPQEYLEGSEEDRKMWESLELPRDLLNGFDTNADSGMNNKFQVEVVSDEDEELFGKWNKDDSCYALAIRLGAFCPCPRDLWNFELERDNSGYLTEEISKQQRVQEEAEHKHLENSQPDNVVEKKNPFSGEKFKSAAEICGSMEEKCEAGAPTQSPHWALPSGAVRRRPPSSRPENGRSTDNLHHVPGKATDTQHQPVKATKTGTVLCKTIGVELQKAVEAYLLHQRDLDIHQLPKLFASA

SEQ ID NO: 919511 - protein, 137 aa, Homo sapiens
THMHKKHTERKHTDRKHTQRKYTENTVTHTHRKHTKTRTHVAGDEHNIVLCFTKDGPCQQLWATFRGQVKWTVLHAPTPSAGMLCKRRHSAKRSAARLMLKSMCTYFSRPLIRSSQATQRNVGLLKIEVQRLSPVTE

SEQ ID NO: 919512 - protein, 150 aa, Homo sapiens
MCRLVTYVYMCHAGALHPLTRHLALVLLNENELKAYLGDIVGLVLNHLSKVNITIRNVANGIKGPIMLLGSFLFAANLSKSSPILALTCFYHFVHCEVWGKTNENNDQNVYACLCVCVCLYVCVYICIPLCVCVCVCVYTSVCACTIGSE

SEQ ID NO: 919513 - protein, 372 aa, Homo sapiens
TATPLSPARAPEAHSMQFPDANARGRLSAVSDETSKRSPQEFVAIGSGSWITNSWLWPKRRKQENLQNRSSPLLPGQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGFGLRMATRRRTEEGPTVVGDARLSLKGSFLHEEMI

SEQ ID NO: 919514 - protein, 330 aa, Homo sapiens
LDPCLQIMSPVYFHVNISDPNQPVPQDTKFIHTKPNRFEEVAWSKYNPKDQLYLHIGLKPRVRDHYRATKVSFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNICGYSVRKTQFSLQKNNNSRSDDGDDDDGGDDEDEDEDEDIDQ

SEQ ID NO: 919515 - protein, 190 aa, Homo sapiens
MEASYYLPYFFPEKIKSQISASGSRPKVIEGQQSHQSGKKYKSEIGDGKEQLESVKKKKPMRETGTHICTASNISNAVGHEKKMMSFATRLNANLVQDLEKMKEEIHVGDKLEYAENKSKEKIWEPAATVYKNHSISEIANRNPVKRVGKEEPSVEKSGFGENSSQWWLLSRAWRLPWFTSMSRALTATH

SEQ ID NO: 919516 - protein, 945 aa, Homo sapiens
RQECMAPPGDVLPCFGSPSVGCTHCPTSPNEMNQCVCRSCGASSDPLPFTEFVRYISTTALCNEVERMLERHERFKPEMFAELLQAANTTDDYRKCPSNCGQKIKIRRVLMNCPEIVTIGLVWDSEHSDLTEAVVRNLATHLYLPGLFYRVTDENAKNSELNLVGMICYTSQHYCAFAFHTKSSKWVFFDDANVKEIGTRWKDVVSKCIRCHFQPLLLFYANPDGTAVSTEDALRQVISWSHYKSVAENMGCEKPVIHKSDNLKENGFGDQAKQRENQKFPTDNISSSNRSHSHTGVGKGPAKLSHIDQREKIKDISRECALKAIEQKNLLSSQRKDLEKGQRKDLGRHRDLVDEDLSHFQSGSPPAPNGFKQHGNPHLYHSQGKGSYKHDRVVPQSRASAQIISSSKSQILAPGEKITGKVKSDNGTGYDTDSSQDSRDRGNSCDSSSKSRNRGWKPMRETLNVDSIFSESEKRQHSPRHKPNISNKPKSSKDPSFSNWPKENPKQKGLMTIYEDEMKQEIGSRSSLESNGKGAEKNKGLVEGKVHGDNWQMQRTESGYESSDHISNGSTNLDSPVIDGNGTVMDISGVKETVCFSDQITTSNLNKERGDCTSLQSQHHLEGFRKELRNLEAGYKSHEFHPESHLQIKNHLIKRSHVHEDNGKLFPSSSLQIPKDHNAREHIHQSDEQKLEKPNECKFSEWLNIENSERTGLPFHVDNSASGKRVNSNEPSSLWSSHLRTVGLKPETAPLIQQQNIMDQCYFENSLSTECIIRSASRSDGCQMPKLFCQNLPPPLPPKKYAITSVPQSEKSESTPDVKLTEVFKATSHLPKHSLSTASEPSLEVSTHMNDERHKETFQVRECFGNTPNCPSSSSTNDFQANSGAIDAFCQPELDSISTCPNETVSLTTYFSVDSCMTDTYRLKYHQRPKLSFPESSGFCNNSLS

SEQ ID NO: 919517 - protein, 207 aa, Homo sapiens
VAHLSDEPETAPLIQQQNIMDQCYFENSLSTECIIRSASRSDGCQMPKLFCQNLPPPLPPKKYAITSVPQSEKSESTPDVKLTEVFKATSHLPKHSLSTASEPSLEVSTHMNDERHKETFQVRECFGNTPNCPSSSSTNDFQANSGAIDAFCQPELDSISTCPNETVSLTTYFSVDSCMTDTYRLKYHQRPKLSFPESSGFCNNSLS

SEQ ID NO: 919518 - protein, 597 aa, Homo sapiens
RQECMAPPGDVLPCFGSPSVGCTHCPTSPNEMNQCVCRSCGASSDPLPFTEFVRYISTTALCNEVERMLERHERFKPEMFAELLQAANTTDDYRKCPSNCGQKIKIRRVLMNCPEIVTIGLVWDSEHSDLTEAVVRNLATHLYLPGLFYRVTDENAKNSELNLVGMICYTSQHYCAFAFHTKSSKWVFFDDANVKEIGTRWKDVVSKCIRCHFQPLLLFYANPDGTAVSTEDALRQVISWSHYKSVAENMGCEKPVIHKSDNLKENGFGDQAKQRENQKFPTDNISSSNRSHSHTGVGKGPAKLSHIDQREKIKDISRECALKAIEQKNLLSSQRKDLEKGQRKDLGRHRDLVDEDLSHFQSGSPPAPNGFKQHGNPHLYHSQGKGSYKHDRVVPQSRASAQIISSSKSQILAPGEKITGKVKSDNGTGYDTDSSQDSRDRGNSCDSSSKSRNRGWKPMRETLNVDSIFSESEKRQHSPRHKPNISNKPKSSKDPSFSNWPKENPKQKGLMTIYEDEMKQEIGSRSSLESNGKGAEKNKGLVEGKVHGDNWQMQRTESGYESSDHISNGSTNLDSPVIDGNGTVMDISGVKETVCFR

SEQ ID NO: 919519 - protein, 945 aa, Homo sapiens; identical to SEQ ID NO: 919516

SEQ ID NO: 919520 - protein, 945 aa, Homo sapiens; identical to SEQ ID NO: 919516

SEQ ID NO: 919521 - protein, 531 aa, Homo sapiens
PNLAGGKVKSDNGTGYDTDSSQDSRDRGNSCDSSSKSRNRGWKPMRETLNVDSIFSESEKRQHSPRHKPNISNKPKSSKDPSFSNWPKENPKQKGLMTIYEDEMKQEIGSRSSLESNGKGAEKNKGLVEGKVHGDNWQMQRTESGYESSDHISNGSTNLDSPVIDGNGTVMDISGVKETVCFSDQITTSNLNKERGDCTSLQSQHHLEGFRKELRNLEAGYKSHEFHPESHLQIKNHLIKRSHVHEDNGKLFPSSSLQIPKDHNAREHIHQSDEQKLEKPNECKFSEWLNIENSERTGLPFHVDNSASGKRVNSNEPSSLWSSHLRTVGLKPETAPLIQQQNIMDQCYFENSLSTECIIRSASRSDGCQMPKLFCQNLPPPLPPKKYAITSVPQSEKSESTPDVKLTEVFKATSHLPKHSLSTASEPSLEVSTHMNDERHKETFQVRECFGNTPNCPSSSSTNDFQANSGAIDAFCQPELDSISTCPNETVSLTTYFSVDSCMTDTYRLKYHQRPKLSFPESSGFCNNSLS

SEQ ID NO: 919522 - protein, 945 aa, Homo sapiens; identical to SEQ ID NO: 919516

SEQ ID NO: 919523 - protein, 481 aa, Homo sapiens
RQECMAPPGDVLPCFGSPSVGCTHCPTSPNEMNQCVCRSCGASSDPLPFTEFVRYISTTALCNEVERMLERHERFKPEMFAELLQAANTTDDYRKCPSNCGQKIKIRRVLMNCPEIVTIGLVWDSEHSDLTEAVVRNLATHLYLPGLFYRVTDENAKNSELNLVGMICYTSQHYCAFAFHTKSSKWVFFDDANVKEIGTRWKDVVSKCIRCHFQPLLLFYANPDGTAVSTEDALRQVISWSHYKSVAENMGCEKPVIHKSDNLKENGFGDQAKQRENQKFPTDNISSSNRSHSHTGVGKGPAKLSHIDQREKIKDISRECALKAIEQKNLLSSQRKDLEKGQRKDLGRHRDLVDEDLSHFQSGSPPAPNGFKQHGNPHLYHSQGKGSYKHDRVVPQSRASAQIISSSKSQILAPGEKITGKVKSDNGTGYDTDSSQDSRDRGNSCDSSSKSRNRGWKPMRETLTTLWKCKVVCYVRITGIL

SEQ ID NO: 919524 - protein, 138 aa, Homo sapiens
MSAALLSKEQNLCLEEVKVKEEKSVQNSISFLPAEAMMIFKVEIAEIPLHPVKMQQEGTTYEECALAKHYVCQQLDPGLPSLWNKEMSKETDEDVYKFKQALTGTRTTYTATNTINNTNNNQLGRGIHHIMLNEKMLK

SEQ ID NO: 919525 - protein, 138 aa, Homo sapiens; identical to SEQ ID NO: 919524

SEQ ID NO: 919526 - protein, 587 aa, Homo sapiens
MNEENIDGTNGCSKVRTGIQNEAALLALMEKTGYNMVQENGQRKFGGPPPGWEGPPPPRGCEVFVGKIPRDMYEDELVPVFERAGKIYEFRLMMEFSGENRGYAFVMYTTKEEAQLAIRILNNYEIRPGKFIGVCVSLDNCRLFIGAIPKEKKKEEILDEMKKVTEGVVDVIVYPSATDKTKNRGFAFVEYESHRAAAMARRKLIPGTFQLWGHTIQVDWADPEKEVDEETMQRVKVLYVRNLMISTTEETIKAEFNKFKPGAVERVKKLRDYAFVHFFNREDAVAAMSVMNGKCIDGASIEVTLAKPVNKENTWRQHLNGQISPNSENLIVFANKEESHPKTLGKLPTLPARLNGQHSPSPPEVERCTYPFYPGTKLTPISMYSLKSNHFNSAVMHLDYYCNKNNWAPPEYYLYSTTSQDGKVLLVYKIVIPAIANGSQSYFMPDKLCTTLEDAKELAAQFTLLHLGPISVEYAKPEVLSMDSNTEILMVLDYLCTDYGIPIMNWVLFDHEIHKVEHVQQHCYKVEYGDSLEASSCHTTITWPVISWNAPKISWLREKSLEPSILRIMEVTKNKSLYTSYTNYIEK

SEQ ID NO: 919527 - protein, 147 aa, Homo sapiens
VLKDENWMERRYSAKVEEQGSEQRETTQPKGSVISCHAQPSSIQSMQTDAYPELSQTPGGKLPFKVLMSRVSFCLPGWSAMAQSWLTAASTSWAQAILPPQPPEQLGLQSSNSLQYTYSFLGRSSCADRLQREGNCFTFIFLGHFQI

SEQ ID NO: 919528 - protein, 354 aa, Homo sapiens
MRLTSRPGSGLSRAPEQHPKPYFPGGTTAEQLLRCHTVSPGTDSRARVCTVHAQDCRMMSCMSPVLAPLLSARGFLGDPLRRVWGLNSCADKHYLLELGDPSAQGGKSGAGRSAAEAIPAVPRPWLTTRNWVAKPGGPRSLKQPRQANLDHIPGVPLGLCAGLLQTEVAGLWAPRPPLPRRIRELEGSPRFGEVAVRAHGLEAALCWHWATLPPPPSAAQELHPREGVAAAPAATDETLPYFSIRDFSPQTPEAPVLGPRDKAESRSSALAIPPLWPAGIRGQPGHGHRRTLGDSGDGPRLCSSPLLSATIALIGAHGRGPSSPCCQPSPSAGDQCSWGGERDILKDGRNQQCV

SEQ ID NO: 919529 - protein, 354 aa, Homo sapiens; identical to SEQ ID NO: 919528

SEQ ID NO: 919530 - protein, 943 aa, Homo sapiens
LYNNGESVSSFPTFSCMRLGQTLPSLRIWGMEFTKTTCRSQAKDYQSTDASDRAQIPFLSQARESSQLTAPNEWRASVYLNDSLNKCSNGRLPCVDRGLDEGPRSIPKCSESETDEDYIVVPRVPLREDEPKDEGSVGNKALVSPESSAEEEEEREEGGEACGLEGTGAVQPHRECSLEDSGPWAGEGVFQSDLLLPHIHGEDQEPPDTPGEAEEDDEEGCASTDPAGADEGSGPDRPTEDMGQDAEDTSEEPPEKEELAGVQEAETATDCPEVLEEGCEEATGVTGGEQVDLSEPPDHEKKTNQEVAAATLEDHAQDESAEESCQIVPFENDCMEDFVTSLTGSPYEFFPTESTSFCSESCSPLSESAKGLESEQAPKLGLRAEENPMVGALCGQCGSLQGGAAEGPAAPDVVVVLEEEALDDALANPYVMGVGLPGQAAPGEGGQAASDALGGYGSKEELNCEAEGGLVPADRKNTSTRVRPHSGKVAGYVPETVPEETGPEAGSSAPGIGGAAEEVGKTLLSLEGKPLEASRALPAKPRAFTLYPRSFSVEGREIPVSVYQEPEGSGLDDHRIKRKEDNLSLSCVIGSSGSFSQRNHLPSSGTSTPSSMVDIPPPFDLACITKKPITKSSPSLLIESDSPDKYKKKKSSFKRFLALTFKKKTENKLHVDVNVSSSRSSSESSYHGPSRILEVDRRSLSNSPQLKSRTGKLRASESPSSLIFYRDGKRKGVPFSRTVSRVESFEDRSRPPFLPLPLTKPRSISFPSADTSDYENIPAMNSDYENIQIPPRRPARAGAFTKLFEDQSRALSTANENDGYVDMSSFNAFESKQQSADQDAERYLTFYFLSCSAAVTVQEAAWVWGTDGLAFQPQALFLTSCVDLGAYTEPYKVCPISSAAPKEDLTSDEEQRSSEEEDSASRDPSVTHKVGHPTVSSSVKWKS

SEQ ID NO: 919531 - protein, 153 aa, Homo sapiens
ASLLLMQTPTASLNFSSENGFLFSTASSGCKFSEVLCPIHSELLESHWNSHKKNVMSEWRDSSFDTRNQIIGEYRQIYCRIYVSLACPANRTKKIYNHPVNIAPLSTYNQYATVIYIFFPMRKEVGEVVVKEESKERSQRGSHSVKIVSSKAV

SEQ ID NO: 919532 - protein, 162 aa, Homo sapiens
EQARALRTASMLSPLTPSHQLNTLRDCSPCHMEQENSSANYQPLSEFLTCKIFEQASLTSLSGNHLSLCLVCDCLRIPCTWCSLHIRSGSILIQTFLRYIPLAEDSCIHRNAAASSTDDTFTNSFPPHCVLLTSVLQRREVKNTSFMVSQNQFIIPILLTYF

SEQ ID NO: 919533 - protein, 136 aa, Homo sapiens
CLRQLWLGEPFASPTGTSVHGWTRPDLAGSGLAGGGPGGISRDRTGPTPRAPEACVPTGPGGGTMMPGETHSAAPGTAADLSRCQGCASLQQNLNEYVEALITLKQKIINTDNLLTEYQKKCDDILLLAFSVEFWN

SEQ ID NO: 919534 - protein, 516 aa, Homo sapiens
MSGARSKLALFLCGCYVVALGAHTGEESVADHHEAEYYVAAVYEHPSILSLNPLALISRQEALELMNQNLDIYEQQDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 919535 - protein, 446 aa, Homo sapiens
MTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 919536 - protein, 554 aa, Homo sapiens
SWSVFGAVKGEWRMRHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 919537 - protein, 171 aa, Homo sapiens
KVLHFGLSMLFQNPLFMTVLSISDGTKEKLCVLLLSAHSARFLLQGLQPSSCFDRDDATKWKELLDTHFLNRFFPVIPARKMMGTVLRRSNHGNSSLNEVEVSLSYISRGVESVSLGLIWCHMLLDTHSFSTLASLVSWHPAHQQQQEERRIQEERTRSWARKYFSKGMIT

SEQ ID NO: 919538 - protein, 352 aa, Homo sapiens
MAPFCFPARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKQGSPGREGKGIFMRWVAASLGTLPGILFSQRLLYFPFSPMSFSEEVIAARCPAVLPSTGSPAPPAGPERQRIKMQGPGLEEIWCWVATCPVIDGELFSPWLLQCERPGVITMQALSEEDRRLWMEAMDGREPEQVEGVCRHHSYSAEDWKS

SEQ ID NO: 919539 - protein, 396 aa, Homo sapiens
HVYITELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKQGSPGREGKGIFMRWVAASLGTLPGILFSQRLLYFPFSPMSFSEEVIAARCPAVLPSTGSPAPPAGPERQRIKMQGPGLEEIWCWVATCPVIDGELFSPWLLQCERPGVITMQALSEEDRRLWMEAMDGREPEQVEGVCRHHSYSAEDWKS

SEQ ID NO: 919540 - protein, 218 aa, Homo sapiens
QSFKYMTDVVYPLGMGVYTLVLGSRALGNVQDTIQTYLTHKEPGKCDYFLKEKAIDYVNPEMAQMLKLSDKYFTCYNQAHEVKPECKTCGSHGYVLNKGVMRCDLHSKNRRSCEEEASGGSESRREPTCGCLSNSRRTWAAGSGVGEKQVDLEVLLQVERKGEFCKMLWGPLSSAAEAQLFLWLLLEQPVDQDVAHATPYIRSPFSDALSQLFACTHL

SEQ ID NO: 919541 - protein, 186 aa, Homo sapiens
MGEGRFSSLSLLIQMLISSGSTFSDLLRSNASQLSRSAVGVDGGLRVAWKKPENGSLDLREERDEVCPGRSAGGSRSQSTGRMSAEGAGDSSVAMWGTLGPSAGNLEARKDIGWKGPLVLQSNSLEGSRRLWLRPPPEACFICGMKPVRCGETALGVRVGHAQGERCLLPLDVIDLRQHCEQNMEG

SEQ ID NO: 919542 - protein, 146 aa, Homo sapiens
MSLSFYVNYVLLHLSIKGALESPRIGSQLKEPAQVSILGLTGYNRAEGMEEKEDLSLLSVLPKVVCLTPGGKPEIIQLESDEAAGGCCHKQYLDHQGLPGYSNSISTYVEALFYQDIKCFREKELYPSQTEKFHNDSSKNYIQVKL

SEQ ID NO: 919543 - protein, 806 aa, Homo sapiens
GLYMSEHRSCVLFRFVLQSCVSHLKTSTEDEEPTEEYENVGNAASKWPKVEDPMPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTGEKPYKCEECGKAYMSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITCRTLLNHKSIHFGDKPYKCDECEKSFNYSSLLIQHKVIHTGEKPYECDECGKAFRNSSGLIVHKRIHTGEKPYKCDVCGKAFSYSSGLAVHKSIHPGKKAHECKECGKSFSYNSLLLQHRTIHTGERPYVCDVCGKTFRNNAGLKVHRRLHTGEKPYKCDVCGKAYISRSSLKNHKGIHLGEKPYKCSYCEKSFNYSSALEQHKRIHTREKPFGCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTVSDELP

SEQ ID NO: 919544 - protein, 1645 aa, Homo sapiens
FSYPQSPSVNQLYEMAYVLRRERGHGEKYGNIRIPGEVEASEFEMILDAAIEAKLETKLLEEWYCRDENSVPAAYYLRPKSEMLRSNRNAMQPSTNAENEKTWQEISDEIKKIFKAAVKLLHEKGKMKHSQAKRYLFSAIEDEFDFALGKQTPAFLKKCVCYIRKIANIERFVKIPEMGKYMDITGTEPRIIRDPEAQEKLIKLRDEFIPTIVASSNLRVYTSVTHCDMKLGYSQEIENHYIEGLGKQFYEDMIDIIQATIQQNFDTETDTLYDEILQHSSLCKTYASFYEYKCESLNIVHNYILPSKAGHINPLIIYGGPCTGKTLLLAEVAKKAYGWLHEDTGPESDPVVIVRFLGTTDMSSDLRTLLLSVCEQLAVNYRCLVQSYPKKIHDLCDLFINLLNESSLQRPLVIIFDALEQLSENDDARKLWWLPAHLPRFVRIVLSTLPNKHGILQKLRCLIHEEDNYIELIPRDRKMCSQVLKHQLLRVKRKVTSGQQIYVNNALSKCTLPMFVNLTFREVRHWRSHKDVDESSLSVTVHESIEQLFWSLEKKCGQKLVSRALGYITMAKMGLSEMELEDVLALDNSVMSELKENTRPSNPLRVPYLYIARLKEGLSGYLIERHVKNVTLLVWANRHLQLIAQKLYLQDDNDLREMHTILADYFLGVWSGGRRKAFCLEDPYLNGCLDLENRSLLEEEKHFMEQASFDRQAPDQPWVFQCNPLEPDIFFVNHRKMSELLYHLTRCGKTDDLLYGIIMNFSWLYTMIKIGQFDKVLSDIELAYNYSQEKELKFLANTLRSIKNKVTAFPGSLSAELQQRLLPVVSSLPKLRHLLLECDKDGPKYCSIVPLHSSMDVTYSPERLPLSSSHLHVTEILPTCNPSTVLTALENGSISTWDVETRQLLRQITTAQSVILGMKLTSDEKYLVVATTNNTLLIYDNVNSCLLSEVEIKGTKHGSSATYINGFTLSANHALAWLEASKDVTVIDLLYGWPLYQFHCWYEVTCVQCSLDGLYAFCGQYLNTTTIFHLGSGEKLCTVTSEFSGGFVKFLLILDTAQEMVMVDSEGSLSVWNTEDISSPQLTDDFDCRREDSEVVSIELSEDQSAVLICKALSIELLDTGLWKVAEKFRAKHNERFISAVLSKNGDCIIATMENTSAVFFWRRDTGQCMASLQEISGSIVKLVKSSHHNMLLSLSTSGVLSIWDIDIITAMSNIDKTGKPIQSLLLPARGEIIYSLDGSDCVHKWNFSSGFIEAVFKHEGIVEHCVLTSTGDIMVTSDDKSSQYVWHTSSGENLFRINGQRISQLLITHNDQFVVSLCEENASRVWRLATGHRVCNILTTLQNAFITSANTFVVGMTKSKVLAVSLWTGSITKKFCCEDGTTIVNFKLIPDCPDIIVFITSAETVNIWSLTDEVICRRVQLPNNFLKNLEDFEISPNGKLGIIARGDENINVLDLYSGKLRVVHASGIIWRQRLSRDGRYLVYICFRNGEEEDENGAIFSLIVMRLADGKNIGACSLYKTPTFLALSQRHLNIIVGFDDGSIGIYTVVDRVDAALKIKIATSNSRQIFNNATHTSRPKCNSYCFKISVDCLWRESTEVFARDSPITVSDSTESNEATPSKKHNSCYERVCSALEARGHSYAPDN

SEQ ID NO: 919545 - protein, 140 aa, Homo sapiens
MDCKSPKRANICPHLPGGGLFSTPPSQAAWRTLLTALCFPGPTCTGPMREGPRAVYNPPRAHRNSSDNCVMKHLLCAGDKNGTRRHALPSPLEGSFQPGRQIPPPQTPSTDPQTLPLSFRSLLRCHQLCAASLPPSLKLP

SEQ ID NO: 919546 - protein, 140 aa, Homo sapiens
MFGQPESDLQKGEPRAPPAQEDLAVRVKVCSCEEKALPGLLQECLLLNEVLCQPYSCLRHKKGVWGKLQGPEPIEQVILSHPSHSRTLPLVTQKLFISFSFKSPLVSREEGEMETCVRQGGENQTGPCAYLKMRKCFMKQ

SEQ ID NO: 919547 - protein, 173 aa, Homo sapiens
GFSVSATWGMEPVQKGPGSRSFHCVWKSFHLSGIGCGFCVQSGIGKQLLCSELTVFVRPGPDGRYVSHQSVSVYSTRGDPLLGHLSNELGKKACHPRSTDGAPDHVLPSTRESLASNTSSIVESNRRQNPALSPAHGGAGPAFNFRASAEPPTNEAEKLQKPSNCLQASVTSV

SEQ ID NO: 919548 - protein, 863 aa, Homo sapiens
MKKTRSTTLRRAWPSSDFSDRASDRMRSRSEKDYRLHKRFPAAFAPQASRGYMTSGDVSPISMSPISQSQFIPLGEILCLAISAMNSARKPVTQEALMEHLTTCFPGVPTPSQEILRHTLNTLVRERKIYPTPDGYFIVTPQTYFITPSLIRTNSKWYHLDERIPDRSQCTSPQPGTITPSASGCVRERTLPRNHCDSCHCCREDVHSTHAPTLQRKSAKDCKDPYCPPSLCQVPPTEKSKSTVNFSYKTETLSKPKDSEKQSKKFGLKLFRLSFKKDKTKQLANFSAQFPPEEWPLRDEDTPATIPREVEMEIIRRINPDLTVENVMRHTALMKKLEEEKAQRSKAGSSAHHSGRSKKSRTHRKSHGKSRSHSKTRVSKGDPSDGSHLDIPAEREYDFCDPLTRVPREGCFIIEHKGDNFIMHSNTNVLESHFPMTPEWDVSGELAKRRTEMPFPEPSRGSSHSKVHRSHSHTQDRRSRNERSNKAKERSRSMDNSKGPLGASSLGTPEDLAEGCSQDDQTPSQSYIDDSTLRPAQTVSLQRAHISSTSYKEVCIPEIVSGSKEPSSACSLLEPGKPPESLPSYGELNSCPTKTATDDYFQCNTSSETVLTAPSPLGKNKEDHDTLTLAEGVKKLSPSDRQVPHSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRN

SEQ ID NO: 919549 - protein, 85 aa, Homo sapiens
RPPSGFHIRCLGDVSPISMSPISQSQFIPLGEILCLAISAMNSARKPVTQEALMEHLTTCFPVLGRAWLPTHQALLKVTVVRTPL

SEQ ID NO: 919550 - protein, 926 aa, Homo sapiens
MKKTRSTTLRRAWPSSDFSDRASDRMRSRSEKDYRLHKRFPAAFAPQASRGYMTSGDVSPISMSPISQSQFIPLGEILCLAISAMNSARKPVTQEALMEHLTTCFPGVPTPSQEILRHTLNTLVRERKIYPTPDGYFIVTPQTYFITPSLIRTNSKWYHLDERIPDRSQCTSPQPGTITPSASGCVRERTLPRNHCDSCHCCREDVHSTHAPTLQRKSAKDCKDPYCPPSLCQVPPTEKSKSTVNFSYKTETLSKPKDSEKQSKKFGLKLFRLSFKKDKTKQLANFSAQFPPEEWPLRDEDTPATIPREVEMEIIRRINPDLTVENVMRHTALMKKLEEEKAQRSKAGSSAHHSGRSKKSRTHRKSHGKSRSHSKTRVSKGDPSDGSHLDIPAEREYDFCDPLTRVPREGCFIIEHKGDNFIMHSNTNVLESHFPMTPEWDVSGELAKRRTEMPFPEPSRGSSHSKVHRSHSHTQDRRSRNERSNKAKERSRSMDNSKGPLGASSLGTPEDLAEGCSQDDQTPSQSYIDDSTLRPAQTVSLQRAHISSTSYKEVCIPEIVSGSKEPSSACSLLEPGKPPESLPSYGELNSCPTKTATDDYFQCNTSSETVLTAPSPLGKNKEDHDTLTLAEGVKKLSPSDRQVPHSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRTRESLASNTSSIVESNRRQNPALSPAHGGAGPAFNFRASAEPPTNEAEKLQKPSNCLQASVTSV

SEQ ID NO: 919551 - protein, 144 aa, Homo sapiens
MTIFACTCQLNNLGACLNAIGLDGRSNQPQHSLKPKPIPEQGLTLFNSLKPERGEEAEEKKLEASRDNDPSDGSEQSKLKTFWKGLTILDVIKNIYDFWEEFNKLPQQFQSSTATTLISQQLTTLRQDPPSAKSSGLIEGSDDC

SEQ ID NO: 919552 - protein, 242 aa, Homo sapiens [sequence omitted]

SEQ ID NO: 919553 - protein, 121 aa, Homo sapiens
PLTQPLFHLPGTLVQSMVKNLEKQLEAPAKKPAGGVSLFFMPNAGPQRAATPGRKPQVGCRMLRVYSGILYRTSSEFGGPGVKVGEGPASVILCPSGTLWVTSLCPCAHGEMASLEYLYPS

SEQ ID NO: 919554 - protein, 139 aa, Homo sapiens
MLPVQALLPNRRFSWQKNWHMLGSAGCAPEPALPHWQMGILEIALPHPPQASYHPNRWAHVKEFKGEPVVEENNFIEMAVLRLRDCSRRAGLPYRLCQEQQLRHSSQLKKDTSHIGLGPHLLHCDFILTNYIYNNLISK

SEQ ID NO: 919555 - protein, 148 aa, Homo sapiens
MVHFMCQLGWAIGCRSDLVPVCVKFYWNTVMPISLHIVHCCFLATMAGLRSRGRHIWPPKYNKLTLALCRRFAIPCSAASLHTPTKAAAQVKARLDLTPATVNKWEKNKHLSMNPIAQEKGKDVVGVAPDTHILLERTFLSLPLYARL

SEQ ID NO: 919556 - protein, 108 aa, Homo sapiens
LENGACCHSLSHTDPRDVSGGWGGASELLPVPNADTAQSRVPTMFSAGCNPLYSTSLQIQSLSLRKVEGIHKVPKAVDTEEDSPEEGGTLLSFLGVQCRNRFAALLLV

SEQ ID NO: 919557 - protein, 150 aa, Homo sapiens
ESASPVSMREARAAAVVTSGLRPVLARAVNRKVSGGRDSRRVHQEEETSDRSPGRQRGIPASGVRGQCAGESPQKWRSWDVEDRSACVSVGCSLHRWLGSRREQNPAGSGAAWVWASVSLQSWQKVTGEPALHMAGSRKKSEKWGGAIHF

SEQ ID NO: 919558 - protein, 150 aa, Homo sapiens; identical to SEQ ID NO: 919557

SEQ ID NO: 919559 - protein, 150 aa, Homo sapiens; identical to SEQ ID NO: 919557

SEQ ID NO: 919560 - protein, 148 aa, Homo sapiens
MADTPPPARLPRRAISDCCASTSLLQLPFTRKGKSPDPLHFQGQSLAISHNSVREKELTETFEMKKVLLLITAILAVAVGFPVSQDQEREKRSISDSDELASGFFVFPYPYPFRPLPPIPFPRFPWFRRNFPIPIPESAPTTPLPSEK

SEQ ID NO: 919561 - protein, 103 aa, Homo sapiens
MGDRYVVRQLISPAPRFGMKKVLLLITAILAVAVGFPVSQDQEREKRSISDSDELASGFFVFPYPYPFRPLPPIPFPRFPWFRRNFPIPIPESAPTTPLPSEK

SEQ ID NO: 919562 - protein, 148 aa, Homo sapiens; identical to SEQ ID NO: 919560

SEQ ID NO: 919563 - protein, 103 aa, Homo sapiens; identical to SEQ ID NO: 919561

SEQ ID NO: 919564 - protein, 159 aa, Homo sapiens
VLMWYPHWVETMYIMSVSLLGNLIENSCQTCLEFFPSGGFVVLLASRVKLQTFPLSVTALKGSRLELFVPPGGFVVSLALRVKLQTFAGQQECRACQARTHPEFTLACEPQGPPRTQGQSVLTILPPNQTPPLLLTTTFFLPHSANQRPCEHWEAVKME

SEQ ID NO: 919565 - protein, 327 aa, Homo sapiens
MRCGKHHSEGVFQSRGGCNQPFSTACLGECAPGRVTCGRAAVCAKKYNNTEYPQQYRISTAKQNIHSKTTIQNIHSNTEYPQQYRISTAKQQYRIPTAIQNIHSKTTIQNIHNNTEYPQQYRIPTAIQNIHSKTTIQNTHSNTEYPQQYRISTAIQNIHSNTEYPQQNNNTEYPQQYRISTAIQNIHSNTEYPQQYRISTAIQNTHSNTTMQNIHSNAEYAQQNNNTEYPQQYRISTAIQNTHSNTEYPQQNNNTEYPQQYRIPTAIQNTHSNTTTQNIHSNAEYAQQNNNTEYPQQYRNKSNLAHPLRSIYLITMTTYFIILLPNT

SEQ ID NO: 919566 - protein, 131 aa, Homo sapiens
MSPVSRVEIDVLQNSLLDDLAPGSGKSEPRPRFTVLPQILGMLQEAELQGPSGFRPQTPGSLQSHHESCSVAQAGVQWCDLGSLQRLPPRFKRFSHLSLLNRWDYRHPPPRPDNICIFSRDGVSTYSPGWP

SEQ ID NO: 919567 - protein, 172 aa, Homo sapiens
QWFEALQALMPFLHNVNGLYNLSGPSAAGLLEFAGGPLQTLFAWVSPVEAAERKDCCLFLPLEASSQRGTHQIPAGALLYEAAGCQERLSLLKLHPQPPLPRGALSRGDGSFIYRPLTGAAAFLSEMPCSKAGQEPKELQTQPRSSHWKIVVTMVPIGCLIFLPMDARLQGH

SEQ ID NO: 919568 - protein, 461 aa, Homo sapiens
TCCGGFGQDRGQGQSGLCPIITQEARCGLLSVRSLLTLLWARGRGSSLHLEPPRLPAHSWPWLSSLCGAASPCCALVAVALLSIWSRLTSLRTRGRGSPLCVELLHLAVCSWPPVTYQKLHCEGAEEAVMPPPGYDAPEARGAAADGPRALGTWEVDLQVEAPQAQRPGNGARCSAENCSPWEDCAGVHQVGVKGEGRLVWECGGGHAGVAPGRNEESSRGEEGGCQHREKLSFFMCVPSSGNANRHSLTGSPLGSFLWNWAHSYHTLQHSCSLVFSKLTENFCPHQNLHTDVYSSFIHNYRNSEAAKMPLSQRGDDGASRVASEKSLGHETGALRTGTQCKDALTRDRNSNASTVSCQPPELPQTNFWGLSHQPVNNGNGKEIFGCQGFSGEAVSRPSTEGFEGGETVPSDSSHPGDAAVNKPTMLPVIEKSSTYGHEHRSTQCLMMLCSESGVSVSSCY

SEQ ID NO: 919569 - protein, 470 aa, Homo sapiens
TCCGGFGQDRGQGQSGLCPIITQEARCGLLSVRSLLTLLWARGRGSSLHLEPPRLPAHSWPWLSSLCGAASPCCALVAVALLSIWSRLTSLRTRGRGSPLCVELLHLAVCSWPPVTYQKLHCEGAEEAVMPPPGYDAPEARGAAADGPRALGTWEVDLQVEAPQAQRPGNGARCSAENCSPWEDCAGVHQVGVKGEGRLVWECGGGHAGVAPGRNEESSRGEEGGCQHREKLSFFMCVPSSGNANRHSLTGSPLGSFLWNWAHSYHTLQHSCSLVFSKLTENFCPHQNLHTDVYSSFIHNYRNSEAAKMPLSQRGDDGASRVASEKSLGHETGALRTGTQCKDALTRDRNSNASTVSCQPPELPQTNFWGLSHQPVNNGNGKEIFGCQGFSGEAVSRPSTEGFEGGETVPSDSSHPGDAAVNKPTMLPVIEKSSTYGHEHRSTQCLMMPKAGSSGGVLLGAGSSMPVVDP

SEQ ID NO: 919570 - protein, 183 aa, Homo sapiens
SRAGGPRQPPPPPAPPPGTMLPSQEASKLYHEHYMRNSRAIGVLWAIFTICFAIINVVVFIQPYWVGDSVSTPKPGYFGLFHYCVGSGLAGRELTCRGSFTDFSTIPSSAFKAAAFFVLLSMVLILGCITCFSLFFFCNTATVYKICAWMQLLAGRGGGGRNSQNKRQGRGSFLPGPLPEGVG

SEQ ID NO: 919571 - protein, 293 aa, Homo sapiens
MFISLWEFFYGHFFRFWMKWLLRQMTGKCELQRIFDTYVGAQRTHRIENSLTYSKNKVLQKATHVVQSEVDKYVDDIMKEKNINPEKDASFKICMKMCLLQITGYKQLYLDVESVRKRPYDSDNLQHEELLMKLWNLLMPTKKLNARISKQWAEIGFQGDDPKTDFRGMGILGLINLVYFSENYTSEAHQILSRSNHPKLGYSYAIVGINLTEMAYSLLKSEALKFHLYNLVPGIPTMEHFHQFYCYLVYEFDKFWFEEEPESIMYFNLYREKFHEKIKGLLLDCNVALTLKV

SEQ ID NO: 919572 - protein, 178 aa, Homo sapiens
MFISLWEFFYGHFFRFWMKWLLRQMTGKCELQRIFDTYVGAQRTHRIENSLTYSKNKVLQKATHVVQSEVDKYVDDIMKEKNINPEKDASFKICMKMCLLQITGYKQLYLDVESVRKRPYDSDNLQHEELLMKLWNLLMPTKKLNARISKQWAEIGFQGDDPKTDFRGMGILGLINLV

SEQ ID NO: 919573 - protein, 293 aa, Homo sapiens; identical to SEQ ID NO: 919571

SEQ ID NO: 919574 - protein, 112 aa, Homo sapiens
VPSFPLPAVCSGETEAAPAPPSSSAPVRWLLFLFLLPRMPRCGCTESARAREPRGVLREPGGAWAGGSLCEPCPPIRGRRARGVGAETPRALGCSGAATRASPLLGSSALLS

SEQ ID NO: 919575 - protein, 137 aa, Homo sapiens
MQQQIINTSPLYSLLTFIGSIVCDFSFNPSSNAGLALCTYKALYIPNSMESHLADGSGEKWVATGYRNEADQYELMWKDLSHTVKPTNQDVKDNVLGHIFPEADLERKGMKTVYPRKHWEERGTEDRERRRPAKVCY

SEQ ID NO: 919576 - protein, 146 aa, Homo sapiens
MKDSAMIATSGDVTASTAMTRDELGHCPAAPWEDQLLCQHSSVSSFVKHKHHHLSGSEAHGKPTLQEDPAIPKVPISLTELGVPKGTRGFRPWTPDMFQDSFTLCQTCKPCLGFFPTLSFFPTHVFTNSGLSTPYWVGATICPFYR

SEQ ID NO: 919577 - protein, 148 aa, Homo sapiens
LFIIIVYHNFKQFIMMLVSSNLGEQESTRSFLVLTSWKQDPLNTGMPTHMPPIDRHSGLSQSNISFRTDRLQSTYWHPAGITCDTLVIAAASWTCSRCASLERHLPKTVKQLYTYETGLALSPEQKSLSNVSSTDSTFGHEEQGSNKE

SEQ ID NO: 919578 - protein, 181 aa, Homo sapiens
MCLSPVMVTFAFRERPLLSAEQCEITSFLPSMKVVSCWSPPLPQMTNATLAHSAKALRSFQRARVILHPLGFSGNEATGPSVHEFSGYIPQEQILVTEARVDYQCNGPSPLMIAAFFGGAGVAKLPSLILSSFLVLPRGCWVHLSLCQTDRLRHARTEGGVGVGGRIKLGKASLVFVDYQN

SEQ ID NO: 919579 - protein, 225 aa, Homo sapiens
NHGSWSCSIRPQGHTPNYGSWSCSILPQGHTPELSLLVLLTPGPAQSLPSVTHWNCGSWSCSIPSQCHIRESWLLVLLNPSPGSHTKLWLLVLLSPSPGSHTGIMAPGPGSIPPQDHTAEFLQGPSLLGCITEYHRPDSYKEQKHISHSSGWWKSESRMPALLGAGQGEFLSSYPAIPGDALPPTAAQSAFSWGCKAAVTRKIHLDGQQQREEEAGQTRRETMRF

SEQ ID NO: 919580 - protein, 139 aa, Homo sapiens
MGHLPSPRCPDTWTMGRGTPPSPWTRPEYPFPSASCTQYGSLHQVASMSHRLTLGCACLIQQEKPTGLKGMQKPKYKASAPATHNCHIPIETFTFISWRGVSLTSFLEPLFMEHFQLPDTGDKKKKEHSTFNLTHSSWS

SEQ ID NO: 919581 - protein, 150 aa, Homo sapiens
MISYSDMVMGKGFMTKTLKAMATKAKIDKWDLIKLKSFCTAKETISKVNRQPTEWEKSFAIYSFDKGLIIRIYKELKEIYKKKTNNPIKKDKDVVGNHHSQQTNTRTENQTPLQVLTLKWELNNENTWTQGGEHHTLGPVGVGGLGEGWY

SEQ ID NO: 919582 - protein, 374 aa, Homo sapiens
MVMKAPSPPMATGRTGLLGPHAPGPAEGEYLIGVASAPTPIPHSLKCAILGKCGPPQSAPPCAGPSHGGKFCEGSTRTLKLCNSQKCPRDSVDFRAAQCAEHNSRRFRGRHYKWKPYTQVEDQDLCKLYCIAEGFDFFFSLSNKVKDGTPCSEDSRNVCIDGICERVGCDNVLGSDAVEDVCGVCNGNNSACTIHRGLYTKHHHTNQYYHMVTIPSGARSIRIYEMNVSTSYISVRNALRRYYLNGHWTVDWPGRYKFSGTTFDYRRSYNEPENLIATGPTNETLIVELLFQGRNPGVAWEYSMPRLGTEKQPPAQPSYTWAIVRSECSVSCGGEFKGLRGAVMEFMNGKKTAGKFPPPLASFQKHYFASKEDG

SEQ ID NO: 919583 - protein, 130 aa, Homo sapiens
MPLCTLALEICLSPAGRACWKCQGVKVTRNSPQLIMRKSLWINIQAPCLQTLTIMRFPSCGCCISHFLSKLGKELLKDAPVDHLGTKHISFCTQCRIATLLFYDALVTPIDLIMVRVSYKSRLYTDMFPS

SEQ ID NO: 919584 - protein, 149 aa, Homo sapiens
YVHKVFGMVQGTLPLSHFTQSLELPVSVSVIAFGIWFLNRWFPFLLLSLDGELIGDCKFFSTDYYAGNVEGISYTGFTNEKLKLRVKIRFAQVITYRKIADQKFRSGRVNYKTHVLEPLRSSYKESQLHSSMNDHKMGLPQLTVKTKLQ

SEQ ID NO: 919585 - protein, 156 aa, Homo sapiens
MCTGRWVQCVLTRGQPPSRFSPAQVSVDGLWKYVSGVLSLWVWTRQLSLLRGRVQLLEEYGGREGDSTVMESDLNHVHGAVYFGNYLLYISNSIDTRPTAQTPYGNKTPNYKQHLRPRQQLNTHRPRDSNDCSSSTCRRWLTPFHSCDYSFDWTRG

SEQ ID NO: 919586 - protein, 72 aa, Homo sapiens
PSLPVAAKLMSPRQVGFTARPGSSRVENELGASPEAPAQLQRLPASLAAAKAGRSPGDRESRPARFRPRLRL

SEQ ID NO: 919587 - protein, 371 aa, Homo sapiens
MPSFHSCISAFSADSSAEAIAQAKDLLSQEDLKAAMSAVSMGSRECGLVVSLASGVKPQTFAVSVTVLKAARLELFIPPRGLVVSLASGVKLQTFASQVVCFDRVLIDSGAQLASPSGSRTRAAGGAACQCHAVRSHSSALGWSMGLGAVEQGVVLVGEARAAQEPMEWVGGSGMAGCMSRALPHGKAAKAWREIEHSAGGPALLGDLVHPLQPLARVPSPSLPCASRAGRLLRVQARQTHAHPELQLAPKRARSPGSRSRLSLHTSLQAEGASCGLGQHRKGLPQCSGGLKGSSSAAKVGAQAEEALRASEGCEDCQHAVTSQLSLPHGVATLVSVKLFLYKNAMVFLCAVVRKNPLGRYKSSFRHLFPE

SEQ ID NO: 919588 - protein, 371 aa, Homo sapiens; identical to SEQ ID NO: 919587

SEQ ID NO: 919589 - protein, 137 aa, Homo sapiens
MFPQGPANSTHNRETLNPYQKRNASRKMSYGVFDNLGLRLRYCQGRRSRARERTRNCSRLKENNETINIPGTRKNMVLGLLEKLEWDYRIGRHDHCLQGPDQSRAHRSCSPWTVLKMVIPWWESFRVPLLGCHIIDK

SEQ ID NO: 919590 - protein, 175 aa, Homo sapiens
SRLQKMGNKKICKGCVDLLKENYKSLFKEISGKQMEKHSIFINRKNQYCENAKTILSKKNKAGGIKLPDFKLYYKVTITISAWYWYQNRHIDQLNRPESSETTPHLSNNRIFDKLDKNNQWGKGLLSSKWCWGNRLAICRKLKVDPFLTPYTKNNSRWVKDLNLKPKTIKTLEEK

SEQ ID NO: 919591 - protein, 125 aa, Homo sapiens
MCISNRFSDDDDDDDDDDNAGPGPVFENHYSKYFMQKEQPIEVMGPQTDEQEASGQDSQGSLGLGNHVLTSIEANKDHVCMSALCQEGSCGSHQHIERRENVVILHPFYCKEIGADVAGQFTTCL

SEQ ID NO: 919592 - protein, 158 aa, Homo sapiens
MCPSSPVFTWPSPCACLHMAVFLQGHRLYEATYRDLAFTLCEVGAVEDTEQKRGKADTTPTTPPQGSRAHYITVIAVKGSWQCGAIIENQEVGMNLIQTVTSEGVSEEPGLEAIVYTIAIHIPLARTQCHGPSLSARLLDPGGADDLGGIKTCLCTMN

SEQ ID NO: 919593 - protein, 117 aa, Homo sapiens
CYMRVSCKDLEKYIIRQKSCPVRTKPYTRMHRKNTLELDKKEKSMGLKLTTHEYGAATPKEDLRHLFPSKCSGSAHSVAPSPAGLLASSLIPGSYPCAIGSGERFQFRLTYFRMGLC

SEQ ID NO: 919594 - protein, 163 aa, Homo sapiens
RLYLRKLLKDLQYEGNNSEAIAMKLPIMAESKGGARCPTWWEQKRERRIPQELAHYHENSSRDGANPFMRNCPHDPTPNKASPPTQGITIPHEIWWGHRSKPPYYDCFHQRILKRKVKAVTIHCLIANKIFLKLNSNYVYPLIKSFLYLSISLGAESKLRTKG

SEQ ID NO: 919595 - protein, 144 aa, Homo sapiens
MAQPHCLLVSQGWWLALGENGTERRAGEGQRETFASEAAAEIFLLGYCFLSPYRAMPYAAVVGRYKELTLMLCANGIGRNGSMHYAHLSSAQLRRGSTKDPSYTWAQHKPEEQQLAALGCDGPYLKSGLEGTNRAFSIQKEAHT

SEQ ID NO: 919596 - protein, 145 aa, Homo sapiens
RYNVDNSCEKWLKQIEGTEAALTQKMLDLEKEKDLFSRQKGYLEEELDYRKQALDQAYLVGPEKIQDLEATLYTALQQEPGRRAGEALSEGQREDLQAAVEKVRRQILRQSREFDSQILRERMELLQQAQQSTKSGLLSLTFEAL

SEQ ID NO: 919597 - protein, 254 aa, Homo sapiens
VLGAPRRGTSTYDTCLRAHPQPRPQRERGQSSHSLTCRSGARPACSPRTLRACALMSWHEPCFHAPTPPTLCVIPPPLMVAPGTLGCSNSRCWRDEGSGFGILQAGFQISILHPCDLGQWLKQIEGTEAALTQKMLDLEKEKDLFSRQKGYLEEELDYRKQALDQAYLVGPEKIQDLEATLYTALQQEPGRRAGEALSEGQREDLQAAVEKVRRQILRQSREFDSQILRERMELLQQAQQSTKSGLLSLTFEAL

SEQ ID NO: 919598 - protein, 156 aa, Homo sapiens
SPGFRVCAVIKHPLMDAPVFPRDPAQVLRVLCPILLKGFSWPWLWRTRWLLTARVIMLKRGLSSSHCFGQDLKIYRFHDDSPPALFYSTQENFLGSHPPKRHANSCFLIEDICDQTSSRNAGLDRARQQTLQFAFESYNGVLGWMGWLQDAFEGYL

SEQ ID NO: 919599 - protein, 167 aa, Homo sapiens
FVYVEPALHPRDEAYLIVMGEFFDVLLEGLTQLGETGNRTCLTKYLDCPLVEGVCFAGGKPTQLGCPYSSELPGGKDKSPGPQSLWPPIPLGDQAQRDSGSVPEPLAGVTGVLAWKPRPEVVSPSAECCPFPKKLRWLRQQAAAAVVLVAPPPGRLVGLSLFQLRGC

SEQ ID NO: 919600 - protein, 162 aa, Homo sapiens
MSFVRDMDEAGNHHSEQAITRTENQTPHVLTHRWELNNEDTWTQDGEHHTPGPVVGWGEGVGITLGDIPNIPRIRMGTCLWSHHSARYRKDVSKSLQDCQFLLVIQRNGCISKVSFPHIFPKSDQRKPRPGVFSGSVTISRVGLYCKKNAVTLPKRTLSHFF

SEQ ID NO: 919601 - protein, 325 aa, Homo sapiens
MGLESPTWALPSGSVRRGPPFCRPQNGRSTDSLHHAPGKAADTQRQPVKAARREAVPCKPTGAELPKTMGTHLLYQHDLHVRLTVGPVSPQTHPVVISPVPECIIDIDILNSWQNPHIDSLTGRVKAIMVGKAKWKPFEPLLPIKIVNQKQYRIPGGIAEISATIKDLKDAGVVILTTSQQEKALQQVQAAVQAALPLGPYDPEDPMVFMVFEVSVAGSSQYSGITQKWTAAALQSFSRTSLKDSYEGKSSQWAELRAVHLVVHCARKEKWPDMRLCTDSWASTNGLAGWSGTWRKHDWRIGDKEIWGRGMKVWVTPPGKKHTTC

SEQ ID NO: 919602 - protein, 150 aa, Homo sapiens
RPFTFKVNIDIMFFFSFPFPFPLFLGGVTVGSFGFASIDICTSFGRFYIGLWNSTYKPIDGTYRQKLSVVNVAGYIVDPCLLAEALCYLRQWVDSSVTRLGAGKPPRVQVLYTESLYRKSRQFSLLIQVIWCSECMKAIWHGMFTILFAV

SEQ ID NO: 919603 - protein, 167 aa, Homo sapiens
MQRLEGLQPEPPSSPWYTGNHAMAPMGSSPGGPYAQLRCQDLATSTPGVSTFSSEKWGGHLWTVMRINFGGAWRGKSGPKIQGVGLLLPILGRLRSGRPEDREPAAKRERAGVQPGCPELCQLPLQKTDAACCLQRWAACGFPVTLSPSWRCSALPRSHTPVPILVF

SEQ ID NO: 919604 - protein, 304 aa, Homo sapiens
MSRSFYVDSLIINGTSRPAPSLPEPHPGPDFFIPLGMPPPLVMSVSGPGCPSRKSGAFCVCPLCVTSHLHSSRGSVGAGSGGAGAGVTGAGGSGVAGAAGALPLLKSQFSSAPGDAQFCPRVNHAHHHHHPPQHHHHHHQPQQPGSAAAAAAAAAAAAAAAALGHPQHHAPVCTATTYNVADPRRFHCLTMGGSDASQVPNGKRMRTAFTSTQLLELEREFSSNMYLSRLRRIEIATYLNLSEKQVKIWFQNRRVKHKKEGKGTQRNSHAGCKCVGSQVHYARSEDEDSLSPASANDDKEISPL

SEQ ID NO: 919605 - protein, 224 aa, Homo sapiens
MSRSFYVDSLIINGTSRPAPSLPEPHPGPDFFIPLGMPPPLVMSVSGPGCPSRKSGAFCVCPLCVTSHLHSSRGSVGAGSGGAGAGVTGAGGSGVAGAAGALPLLKSQFSSAPGDAQFCPRVNHAHHHHHPPQHHHHHHQPQQPGSAAAAAAAAAAAAAAAALGHPQHHAPVCTATTYNVADPRRFHCLTMGRAGSWGTCAPRLSRSWSKLSTSSGGSGSPGTG

SEQ ID NO: 919606 - protein, 174 aa, Homo sapiens
LGPRSRCMHISYLVKACLSFTDGCLLFVPSNGELLKLNSLRGSDINQDVNYMRENKTKQKTWQTGVCYSSGCGSPEVWAQRRVTALHYCSLVNGDVWLQAAFSLLLLIFVVIVNEQRTVPMLNQLHILILCFFNHILQGSWTSWWLQPEEGLFQNEPLQSKAGLKAGESKGKAF

SEQ ID NO: 919607 - protein, 114 aa, Homo sapiens
MVWNTDLVETLELQNLMLCALQTIYGAEARKESRGTHAREGYKVQIDEYDYSKPIQGQQKKPFEEHWRKHTLSYVDVGTGKTLLFMVTLGYRPVIDKTLNEADCATVPPAIRSY

SEQ ID NO: 919608 - protein, 139 aa, Homo sapiens
MCSLPSVHYTIKKLVTKMQTKNKGETRIRFLTCVIGKRADVPSCFVYEAVGYKDSHTSLWNAEYCSLMEEDLAASNKTTWHLPFDSAILESASKKLQQRNERTLGTEFFSQPACVCNKVLHCGVCKCGEKRDQAGTVSV

SEQ ID NO: 919609 - protein, 123 aa, Homo sapiens
MELFVSPGMVWNTDLVETLELQNLMLCALQTIYGAEARKESRGTHAREGYKVQIDEYDYSKPIQGQQKKPFEEHWRKHTLSYVDVGTGKQCGARSHHSPAPTRPRPGLRAGLADGEQGGAGQI

SEQ ID NO: 919610 - protein, 114 aa, Homo sapiens
NAFVSSVGGMVWNTDLVETLELQNLMLCALQTIYGAEARKESRGTHAREGYKVQIDEYDYSKPIQGQQKKPFEEHWRKHTLSYVDVGTGKYRPVIDKTLNEADCATVPPAIRSY

SEQ ID NO: 919611 - protein, 162 aa, Homo sapiens
MLRKRFREDPEDPPSCSHVKTDAEEDPNCHEQHPSNTAIHLRSDQEAVTDGRRKPGGMVWNTDLVETLELQNLMLCALQTIYGAEARKESRGTHAREGYKVQIDEYDYSKPIQGQQKKPFEEHWRKHTLSYVDVGTGKYRPVIDKTLNEADCATVPPAIRSY

SEQ ID NO: 919612 - protein, 162 aa, Homo sapiens; identical to SEQ ID NO: 919611

SEQ ID NO: 919613 - protein, 162 aa, Homo sapiens; identical to SEQ ID NO: 919611

SEQ ID NO: 919614 - protein, 171 aa, Homo sapiens
MLRKRFREDPEDPPSCSHVKTDAEEDPNCHEQHPSNTAIHLRSDQEAVTDGRRKPGGMVWNTDLVETLELQNLMLCALQTIYGAEARKESRGTHAREGYKVQIDEYDYSKPIQGQQKKPFEEHWRKHTLSYVDVGTGKTLLFMVTLGYRPVIDKTLNEADCATVPPAIRSY

SEQ ID NO: 919615 - protein, 139 aa, Homo sapiens; identical to SEQ ID NO: 919608

SEQ ID NO: 919616 - protein, 114 aa, Homo sapiens; identical to SEQ ID NO: 919610

SEQ ID NO: 919617 - protein, 185 aa, Homo sapiens
MLRKRFREDPEDPPSCSHVKTDAEEDPNCHEQHPSNTAIHLRSDQEAVTDGRRKPGGMVWNTDLVETLELQNLMLCALQTIYGAEARKESRGTHAREGYKVQIDEYDYSKPIQGQQKKPFEEHWRKHTLSYVDVGTGKFWQCTAREQHITHRKQLCSCDGGLSTRKEWTIGTRSSLNKSESHYAV

SEQ ID NO: 919618 - protein, 162 aa, Homo sapiens; identical to SEQ ID NO: 919611

SEQ ID NO: 919619 - protein, 186 aa, Homo sapiens
MLRKRFREDPEDPPSCSHVKTDAEEDPNCHEQHPSNTAIHLRSDQEAVTDGRRKPGGMVWNTDLVETLELQNLMLCALQTIYGAEARKESRGTHAREGYKSLPVVTCSSDELIFVQSTRVGFCLVQIDEYDYSKPIQGQQKKPFEEHWRKHTLSYVDVGTGKYRPVIDKTLNEADCATVPPAIRSY

SEQ ID NO: 919620 - protein, 119 aa, Homo sapiens
MAKMAPKTPKLTFSQVGNPGKEGKVSPRSSSKSFGMVSWPLLGPLAIPEPIAGARGKDGKSVSQPSGPVTELLGNAAKVLWLSKNIPITQPTSPPAFCPCGGDLWFCNCLGESKSVMES

SEQ ID NO: 919621 - protein, 142 aa, Homo sapiens
YIPPMVMSLAAPPCGRRYFSHPLTDSMRGHMGLLLQTVPQNEKICGGELKPKCNMNNKQSFVIMYYSIFTLLIKTYLRLGNLQKKEDYWTYSSTWLGRLHNQGGRQGGASHILHGWQLAIKELVQGNSTFKTSRSHKTHSLS

SEQ ID NO: 919622 - protein, 156 aa, Homo sapiens
IHHGILCSHKKGEFMSFAVTWMKLETIILSKLLQGQKTKHHMFSLIGGKRTMRTLGHRKGNTESQVPPWNRRGQAPPPPPPHTTPASQGYIPVHTPPCMQAGQRFAVDLFILGCLISPSKEGFDLKLGVEFGTKMCREGGCMDSLSYAKSKMKLWN

SEQ ID NO: 919623 - protein, 286 aa, Homo sapiens
PYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 919624 - protein, 134 aa, Homo sapiens
MKPAAEGPTCRPGLSLHCPGPQGSTTQAGLGHTPQKGPAKALPPQTQKGPAATPGPSPGLPAHAPSPPPMPSPAPGGSEISWRLQGAEAMPAGDERVLRSRWAGALQTLHLGSYFHDPKELVKYEIYRAYRICK

SEQ ID NO: 919625 - protein, 123 aa, Homo sapiens
MKPAAEGPTCRPGLSLHCPGPQGSTTQAGLGHTPQKGPAKALPPQTQKGPAATPGPSPGLPAHAPSPPPMPSPAPGGSEISWRLQGAEAMPAGDERVLRSRWAGALQTLHFFLPLSPLAIFMG

SEQ ID NO: 919626 - protein, 204 aa, Homo sapiens
GPASAGAVSKRGTVSIARSICGAFCNFSPTLPPCAEALWHFQRPAAAEMSCSKRTSLLGTLLRPRYPKLHWCTGREPHVGVGLGTCWINTITVPWSSWKLPSAQPGLLVGGAHASYMCQGSHSLASEQCNSGNVQALSVLSSLANHGHPWVPWGHYVTPAFYLSGQELLKPHLVTLRRTAHCTLTSFAVKCEIVPIECKRKERR

SEQ ID NO: 919627 - protein, 231 aa, Homo sapiens
GPASAGAVSKRGTVSIARSICGAFCNFSPTLPPCAEALWHFQRPAAAEMSCSKRTSLLGTLLRPRYPKLHWCTGREPHVGVGLGTCWINTITVPWSSWKLPSAQPGLLVGGAHASYMCQGSHSLASEQCNSGNVQALSVLSSLANHGHPWVPWGHYVTPAFYLSGQELLKPHLVTLRSAMKIPSRPAALPADAEKETRLGDAAHPYPQRAALFPLALAFGSGHSKHPWAPG

SEQ ID NO: 919628 - protein, 258 aa, Homo sapiens
MNLPGRECLVKGRITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEARE

SEQ ID NO: 919629 - protein, 407 aa, Homo sapiens
MNLPGRECLVKGRITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEENPPNHQPVSLPEVFLPQILKFSGPPHWRRIEDEYKVMRLNIGDMKTKK

SEQ ID NO: 919630 - protein, 134 aa, Homo sapiens
MCYTAQFQRKGDIKSADGINVTHQLSLKQDYPGVPGNWEDFGLEERRQYDNRSQIFAGLNRELDPSITRESLLRNTLLPMKKEVALSLQKQTNKIKPCRVVCAYIREPLRIKNASCPQYASSVLKDLSYEHGKD

SEQ ID NO: 919631 - protein, 164 aa, Homo sapiens
TLKQPDLTKIHSSIIKTIPRRMVLSHSLETAPMIQSPLTQPHVQHWGLHFSMRRGLVANVNPQGAPAPSTEKGQGSRLSPALAISMECAAPGAPPHGLRREFQVLAGPLSAHSSMPDHTALPSVGDLASPIVVAPRVAGSRGLLGLGSRDCLPPPHILLTLSAV

SEQ ID NO: 919632 - protein, 164 aa, Homo sapiens; identical to SEQ ID NO: 919631

SEQ ID NO: 919633 - protein, 138 aa, Homo sapiens
ISLPSARRMRYVKLPQRPTRHLSSKLIHIQDLSNKEQWRNLLKISAGPLTVLCCLQTNTTSTDTDPRSHLQETGDNILTLFTMHPPLESEWTICNFRQIRRCVRQTPSRKNVLPSFEECHCQMASTCSLLQQLPQCSS

SEQ ID NO: 919634 - protein, 165 aa, Homo sapiens
MSQGVIFCDNRSIDPWEIMNTITGVNIPQKYNEYFPKVYTLCDIKSNISLEYADDITERTSSVIREVTSDKDHASNLTRCTNPGVKIDVNLGDLREGGICCHSQQTASQEKKGGHSSDKRPFTFMEFVGAGEINEVLPMMKPGPELKGKCCLSSSVTSTAFGLSE

SEQ ID NO: 919635 - protein, 162 aa, Homo sapiens
MQDMELGNSGRKHCAQGLEEQVGVSSRYLGAGMAPGGGGTRLGLSFKIRILGPGTQVNPECAAKPISERYLLIAFLGNYTKDLVCTEQVCGNQEGRGRKGGSREPRPRQGPYSSQTRQTERETLERAEPLWAWLEASGRMLRQEPQRSESKNHVQTQLKVPR

SEQ ID NO: 919636 - protein, 141 aa, Homo sapiens
FLVRTPSKLPEPLQMWKFGTPTLCRHPVATVSVRLAGEVARILERQRCTGPSRASTILTTVQGPSEAAQIQQDQGQWRQDFTQGRDQDGLVLQCPGTPWATEGSTLRTGLLSERLLVTASRRKYIKPPSSQEREKSVKSVG

SEQ ID NO: 919637 - protein, 207 aa, Homo sapiens
MWLLPRDEGGLQERVLGSCTRKNSGMDWDDEYSHNSFDLHCLLNSFPGDLEFEQIFSDIDEKIEQNAARDSNLDVIAHGYQSTMLKLYSVIKEDFNTLCEILAPSSMVKFIKETYLDTVTEEMAKFLENFCELQFRENAVRVVKTSKSSSKHRGAVHALDKVEFLSQLIKSFMKLEKGVQELFDEILLSLKITRDTSGLDASDFDML

SEQ ID NO: 919638 - protein, 324 aa, Homo sapiens
SHNRRWSQMEYVSKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKGKTLGAGAFGKVVEATAYGLIKSDAAMTVAVKMLKPSAHLTEREALMSELKVLSYLGNHMNIVNLLGACTIGGSYIERDVTPAIMEDDELALDLEDLLSFSYQVAKGMAFLASKNFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 919639 - protein, 151 aa, Homo sapiens
MWSQPVLNLSFHVPQSCSQHAGPQHQSQLPMSKLLSLLSLRSSNYTDLHPAAAFPNHHLISTHSHDSLMMTVVSGPQSSLHPISPPQVTSRSSTVANLHHFQTSQGPSFSSPLCMQHSPFIIQQIVTSTYYSLKAQQHLSSHMLSCNVTMP

SEQ ID NO: 919640 - protein, 452 aa, Homo sapiens
MLMTPGHFLSDRIQDALCALEGSQALEPKGGEGSEGVEAEGPGTETETVLPVSTLNFCPEIQIDIADKEIEQGEVTTSVTALLEGLEKTCSSRPSCLEKDLTNDVTYLDPSLLPVHSAIFSFEPLSSPDGPVVIQNLHITGTITAQELSGTGLQPCTRYTVKCETSLDGENSSLQQLAYHTVNHRYWEFLNLQAIRRRNQIYESSLKIIEKMVVSAIVDNLKTAFPCSESQGPTEELSEAETESKSQTEGKKARKSRLRFSSSKISPALSVTEAQDTILYCLQEGNVESKTLSMSGMESFIEKQTKLLEVQPTEAPEKDPEQLPKGHVDSCLSDAAVPAQDPSNSDSGTETELADTALNLLLLLLTEQWKWLCIENMQKFLRQRILGKESDTLVHNQYGAHHLSSGPRGEWVWLCELATGSVFSGNSLIITDCVALASKRKGAPQPFSTRQV

SEQ ID NO: 919641 - protein, 192 aa, Homo sapiens
DSALGDDHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 919642 - protein, 450 aa, Homo sapiens
MSLKKRSLMSKPNLLNQKPKCLVPFWFVVLTHGLSLVLHCGSVAPGVPHGLPVFHQCDCTSLHLPIVQPALDTLNCMNGIAFFFFFWGKQILPFAPNMWGVCASGVRNSLGLSHVAGSPASPKVSTCSFPLAPSSLSPRCGLGTSGRRHFAPTNAPSVYILGAYIWGYKHDSGVFRPCVWAPGDSDYSCGTLSCDTLCCDTPHRGFCGPPRAGDFGCADIWAERRVKVSPRGAPGLGVLLRLFSIYPPLCVAPHFPRCDFKRGLPHTVWCGRHISHCWEETPPPLFFLFLSRGESSVARDSPPLCVVSCPPEGGGSITPGVVYIRIFSAGPPIIEPASLSRPPGGVVSTDRALFPCAERLLFAAPPPEELSSGAGLYQRASPPTNRIVCGPPTVNSLLRGAAPFIELRHTPAGGYFSPHMIFGAPAEGWCASTNGLLALDPPEGCCVLST

SEQ ID NO: 919643 - protein, 432 aa, Homo sapiens
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQECEMATSGDRQRDSEVNFKELRTAKMKPELLSGHIPPGHIPKPIVMPDYVA

SEQ ID NO: 919644 - protein, 238 aa, Homo sapiens
MCSSITTMNIKTYSKEDYGSTAVQSFLASLDGEKLELLKNDLISIKDIFAAKELENEENQEEQASSGLHRYSLIQAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGKKSFVPTGYLDQEGFSPRHPRGFLPRFLKVFIQKPPSK

SEQ ID NO: 919645 - protein, 161 aa, Homo sapiens
MKLFGFRSHRGQTVLGTIDHLYTGSGYRIRYSELQKIHKAAVKGDAAEMERCLARRSGDLDALDKQHSSVSPRKCQSLYVDLPMEKETEYVNGKGEGPPAKHPSLKPSTEMEDPAVKGAVQRKNVQTLRAEKALPVASEEEQQRRERSEKKQPQLILEHAL

SEQ ID NO: 919646 - protein, 163 aa, Homo sapiens
VYIHYRRCLMRELIPLSKIPTALHLACASGHVKVVTLLVNRKCQIDICDKENRTPLIQEESCAVILLEDGTIPNLKGIYGNTALHYAVYSESTSLAEKLLFHGANIEALDKQLVAAIDVYSVFIVLLFSEESHSWNNTVDIFLNIKKIKAPWQLKDLLQNILP

SEQ ID NO: 919647 - protein, 168 aa, Homo sapiens
MWAFILSPSAAGLLEFAGGLLRPCLPGYHQWRLQTSKDCCLFLPLEASSQRGTHQMPAKPLLASRWECLSLPKLRPHLPLPLGALFQGNGSFIYKPLTGAAPFLSEMPCPERRNLERQSGHSDFATLQCGLHVVNSSQSLQYEKGEKSNFAVERPDKHYLSQANGWHQ

SEQ ID NO: 919648 - protein, 187 aa, Homo sapiens
KGSMDRKQTAAWTRFPSHCGPRAYFTMKWSIEQTGLPLMMPQDNIDDAFCKDYFHWCYLVPQHGMCSHKFYGKQCCKTCSKSNLRAPRAIRSDQLPGWRSGELQEAAQAPPPPPQRPSISYQEPGATAGASVISRVTGQGTAFWFGTLPMEMGKMKFLLRCFYLFQIHALKERFFILYVLSFSVICK

SEQ ID NO: 919649 - protein, 116 aa, Homo sapiens
MHLKAILPNGPGSWGIYTPLPSVTGSGLLPGRANSPAFLACYLEGQSGSRARERPQERDAGQAVVVRQMCTEGVRFSSKDHWPIWTVLDILSAACLFSRCKKLLPIHPSLFLNVDC

SEQ ID NO: 919650 - protein, 164 aa, Homo sapiens
MFSRTILTVRPPQKIVSPKQEHEDRKHDKVTDKGSESGTSCNELSTSSCDSHSEASTPQDNPSSAQQATAHQPNTLTLDRPSKKAPVQWIPPPDKRRNSELFQTLISKSRETNLSKKKVCEKLSVEEEMKKCIQDFKKIHIPDYFPERKRQWQSELLQKYGQSL

SEQ ID NO: 919651 - protein, 112 aa, Homo sapiens
RREWRLRMVLAGQHKFRVGVGSVGPALGAAGLAAAARPAAAEGAPGPPAVLARRHCARILAGPQLPPRRAELGTCSLPCLSLPTAGGCCPAEPPRQALPPALWHPVPLTPKG

SEQ ID NO: 919652 - protein, 179 aa, Homo sapiens
MQIMLSPEDQGPLDIEWLISPADNQKMDQVMILYSGNKIYDDYYPELKGRVHFKRNDLKSGDASINVTNLQLSDIGTDQCKVKKAPGVANKIQLVVLVKPSGTRCYVDGSEEIGSDFKLKCEPKEGSLPLQYEWQKLSDSQKMPTSWLAEMTSSVISVKKMLLLSTLGHTAVHQKRSGL

SEQ ID NO: 919653 - protein, 149 aa, Homo sapiens
MLTPTIIPFNSLAGCGKSPRFPLKVKATPGWQTARKQTNSHEKLNSANTRNVLGQMFCRVFMTSVEYQLWESQYLRSFKREYKSKVKDSFSWHKKKYFMGKRVQKRTIKDGRIGESLGVEIPHIWCQKCCQQEGHASSRRAPVPFKELT

SEQ ID NO: 919654 - protein, 146 aa, Homo sapiens
MSHVMLFTAHPLVTCLSLCCPMGTGAPGTGVKNVTQPTAFAAENVISAYEVFTHIEKKAAHTTVEFTSKSTSIQGTCYSAKGSQQAKDVCSHRKQNTEGKREAERQELYRRYGTQLDGRQNARINQLFLSRISGSIQWMLHQIISQ

SEQ ID NO: 919655 - protein, 146 aa, Homo sapiens; identical to SEQ ID NO: 919654

SEQ ID NO: 919656 - protein, 355 aa, Homo sapiens
MANIQTPDAGKDVEQQELSFLMGIQNDTDLMEDSLMGSYKAKHILTILSSSCGHVETIFDCKFKPDDPNLLATASFDGTIKVWDINTLTAVYTSPGNEGVIYSLSWAPDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQSKLAMAYLIRGNELELAVCVGTVLGESAAPATHYALELLARKCMMISVWNLAADLLLMIPDNELHLIKLCAFYPGCTEEINDLHDKVC

SEQ ID NO: 919657 - protein, 298 aa, Homo sapiens
MPLLRRTSRLLSPPGFLPQKRTKLVTIGLIVASLLWPLCCTLGWADALVGPLTSHCTTLLTYHSERTVTFTYVMLVMLWGTSICLGLLPVMGWNCLRDESTCSVVRPLYQEQRGHPLGVLPLHVCAHLQLYIQICKIVMSTPIREPLQHHFLATSHYVTTRKGVSTLAIILGTFAACWMPFTLYSLIADYTYPSFYTTPPSCPPPTIPSSTLSYMLSETKRSRKRSVSFAAAASRPVSPRERARPVMCSTLAPRRTLHLPSTSTAWPRFEMLPLNSLHWIPSQATGALSIRETMTSFR

SEQ ID NO: 919658 - protein, 135 aa, Homo sapiens
MGPMASKNFPGLYSYPNNFSLFLLLSFNINSLITSTSPIQPLLTALKLECSINLTQFLLQQPNSSFAPECWMCLSLSSSAYTALPTPLHDLLTGNITLIYKLQKGASFFDRAVSLVMRVQVIGSFGVCKYLLRAY

SEQ ID NO: 919659 - protein, 156 aa, Homo sapiens
SLSPIILAMIFWITCSSFSISTCCFTLHCYVMEVTSFLSSHEPTTSTSFQLFFCSFFTFLSLHKVDLGSCSGLDFDLREYCGWFDLFRPLKTFSESAIKLFCFLIICVFTRVVFLISFKNFSFAFTYLTIWCKRPSFWPIAVFNMPFSLSLIISSF

SEQ ID NO: 919660 - protein, 142 aa, Homo sapiens
MHCSQTTVSFLGQKTQRKTRIILSGRIPRNPSEESAMQKYPGGGTAHTAVPVIHPRQILHALSHFKALALAVLPDHALDSQEHLGWEPSWAVTTGWGAPVKTSRQTAKAFSQTKRLANFPTSSEFSSEANFLELNGMKPSCS

SEQ ID NO: 919661 - protein, 139 aa, Homo sapiens
MSGCFSESLLCSLLLVQLGSCHFSEKLAGGWNPIQNVCWGRGDTECKYMETVNLFTLQLRDSKKLFFIVSIASSDISHETLACWANYMNTLVDENGFTRGPKPAPSGWPNASKLSSCGCCIYGGIFGHNQPSEMTGGRT

SEQ ID NO: 919662 - protein, 164 aa, Homo sapiens
EFSWLNTMIVNQDSQVWSRLVTTESFRGGKSRRSDGRNNRTGGIRGLKDLWKLSYEDTNFGLHPSSPFIHTCGIYFGKKRLNKDKNCGITLCSQRKHNCHRSQNESPRARSREVQQQESTFTENPVGRLWHYQLINMLQNSFYTAARLRRAHHLHINIWTVATT

SEQ ID NO: 919663 - protein, 207 aa, Homo sapiens [sequence omitted]

SEQ ID NO: 919664 - protein, 215 aa, Homo sapiens [sequence omitted]

SEQ ID NO: 919665 - protein, 137 aa, Homo sapiens
LGRAKGRMIKSQALSPSAQLPEWEQSFQPRKMFKQYADDLAQIKNASNRCYVHKFSQQPFEYMNQSHLSWLPLTGTQLLGRREECTVDMDRLQEGEGLLGLLERECLCPYGSALQLSLHIGFMLLDQLPPYVWKQGH

SEQ ID NO: 919666 - protein, 137 aa, Homo sapiens; identical to SEQ ID NO: 919665

SEQ ID NO: 919667 - protein, 137 aa, Homo sapiens
MVKKNKQTNKQTYSHPWLYTGYWFQDPHRYQNPNILKSILKSYRTHVKSQSSGFASWEYFEQLKGFFSAAMAHVAASHMDRLLLPSGEDPLLISTPMSGLLWAGPPDASPPVSWPHCSSRDLREMAACQVPESLVSM

SEQ ID NO: 919668 - protein, 175 aa, Homo sapiens
MTEQRNKRLQQSFLLSFLALIPSKLYSVPGIPESSATTKASEAIRQHQSSAAKPRRSGKESIREPWARVPGAVEVAARKAPLRRSDTSGTWVNNPRGISAMIKHQEYHQPVTAVCLLTFSFGLGMFIVGILPPCQFWWLRSPRSRWQRWGKGPLKAVIGSTFLKDMLKDEKVFTQ

SEQ ID NO: 919669 - protein, 685 aa, Homo sapiens
MLASGLLLVALLACLTVMVLMSVWQQRKSRGKLPPGPTPLPFIGNYLQLNTEHICDSIMKFSECYGPVFTIHLGPRRVVVLCGHDAVREALVDQAEEFSGRGEQATFDWVFKGYGFHAILTSTSPASISCNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQENLFIGGTETVSTTLRYGFLLLMKHPEVEAKVHEEIDRVIGKNRQPKFEDRAKMPYMEAVIHEIQRFGDVIPMSLARRVKKDTKFRDFFLPKVLSAPTPQTTGTSSPSLCPQHPTHIRSFLDPVPLPQSVKKDFPNHHIRSTFHLDTPESCISPDSLCQENQTHVPKLPILRNRSPLSIRPFVIGTEISGPPNSCLEGHGPHVSQTSCFRDVNLLSPKAPPSEDPNSSMPATSPYLGHTSSPSSPCVLSPIPRPSSSHTTSSSLPGTEVFPMLGSVLRDPSFFSNPQDFNPQHFLNEKGQFKKSDAFVPFSIGKRNCFGEGLARMELFLFFTTVMQNFRLKSSQSPKDIDVSPKHVGFATDPTKLHHELPAPLSEGCAGAGLVGGARERAGPRPGLGE

SEQ ID NO: 919670 - protein, 180 aa, Homo sapiens
SSVLAPGRWTAPQLPAQGETSSSYYVQSLRFSTESPPKSHGSWVFISPLHPESHADPDKAQCSEHSWSGGPTSGSCRDWFQTHGGGDTQRKGGSDVTTEAEIDMMQPQEAELCRPHDATASGKCNCVHGESSAVTPQDPLNIGCASKIYLVYSSSFTHELHNADLSTMSADCVDKPLKNL

SEQ ID NO: 919671 - protein, 273 aa, Homo sapiens
SSVLAPGRWTAPQLPAQGETSSSYYVQSLRFSTESPPKSHGSWVFISPLHPESHADPDKAQCSEHSWSGGPTSGSCRDWFQTHGGGDTQRKGGSDVTTEAEIDMMQPQEAELCRPHDATASGKCNCVHGESSAGKDAESSAQAGSYGGGKMWADSGYILKIGPTGFTERLEMWTASKATDPWSQPGEECGQRRKTSGTEPWGTPGFRGPSQETEKEQPGREEAKQQSECISMCSHATQMPSRKAVWLSVVAYDWEKVECVCTPLACERLYASR

SEQ ID NO: 919672 - protein, 91 aa, Homo sapiens
RTKASRARVNRQRLRRQVILCLSSQVAGITALPSPTAAGSSSLHCTQNHTLTQIKLNAVNTLGLEVQHQGVAGTGFRHTEEETHREKEAVM

SEQ ID NO: 919673 - protein, 765 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQL

SEQ ID NO: 919674 - protein, 242 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECKAETPHGAEEECRHGGVW

SEQ ID NO: 919675 - protein, 826 aa, Homo sapiens [sequence omitted]

SEQ ID NO: 919676 - protein, 845 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVRGKRQGRNGFLFHPHLPQVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 919677 - protein, 602 aa, Homo sapiens
MGRGARAGGRGAARAGHAPGRPRRRGGPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 919678 - protein, 514 aa, Homo sapiens
MTVGAEQERIPHAASRGSYHLDWDKMDDPNFIPVRRSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 919679 - protein, 765 aa, Homo sapiens; identical to SEQ ID NO: 919673

SEQ ID NO: 919680 - protein, 208 aa, Homo sapiens
PRLSQAFTAQPEGPDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 919681 - protein, 384 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRGRSRCASSRWRRQWSRRLKRTRS

SEQ ID NO: 919682 - protein, 97 aa, Homo sapiens
EVQKQKELSKAEIQKVLKEKDQLTTDLNSMEKSFSDLFKRFEKQKEVIEGYRKVCLRHPGVLTSEADGLMVQASGATSCCLCTLVLGQASPCHGGMG

SEQ ID NO: 919683 - protein, 143 aa, Homo sapiens
WPLRPKIRPRGKKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 919684 - protein, 796 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 919685 - protein, 826 aa, Homo sapiens [sequence omitted]

SEQ ID NO: 919686 - protein, 844 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKVGAGSPAQGAVWQHLLEGPWACCSLQAGRSPATHLPPPD

SEQ ID NO: 919687 - protein, 415 aa, Homo sapiens
MPPPPRPPPSPAPPPPPPPAPPPPPSPPPPGPPPPPFPPPPPWPAPPPPGPAPPPPPPASPLPRPPSRPLPPPPPPPPPRPPPPPPPPPPPPLPPPPPPPPPPPGACLALTAFRAPAVLGPGAEVDYLEQFGPSFPASALPSFSLPFAPLLARPGPVPVATAPRGAPPPPAVRGPPRFVAFAFLGALAPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 919688 - protein, 523 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQEIVQIKTQEKDRRKDSWARGTTTTKARRSVMAPNVWLRCYLLDTRQGDRLRSVSHLHGAAVPAPLLPSVCPV

SEQ ID NO: 919689 - protein, 183 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENLSPQEEVAAGQMASSSRSGPVKLEFDVSDGATSKRAPPPRRLGERSGLKPPLRKAAVRGRSRCASSRWRRQWSRRLKRTRS

SEQ ID NO: 919690 - protein, 148 aa, Homo sapiens
MRGEQASKNIQCRCSRKAFNKSQRSMVRYQVKTPSDDICTELVKSCIDLVVTEVYGIKGGTVPMNVDMLHKYIFNLLLFSLDILFPESSNVPKLSLIIPPNTTLSSATQQKYQQQKMHLVCALPLVVQYSYVKNYYFLCFGILLMNYR

SEQ ID NO: 919691 - protein, 322 aa, Homo sapiens
IRPSPAFCCCRSNPESVMAAAGQEKGYLTQTAAALDKSPSLSPQLAAPIRGRPKKCLVYPHAPKSSRLSRSVLRWLQGLDLSFFPRNINRDFSNGFLIAEIFCIYYPWELELSSFENGTSLKVKLDNWAQLEKFLARKKFKLPKELIHGTIHCKAGVPEILIEEVYTLLTHREIKSIQDDFVNFTDYSYQMRLPLVSRSTVSKSIKDNIRLSELLSNPNMLTNELKAEFLILLHMLQRKLGRKLNPEWFDVKPTVGEVTLNHLPAQASGRRYNLKVKRGRVVPVLPNIGSGGSSHREIHVKQAGQHSYYSAMKPIRNMDKKP

SEQ ID NO: 919692 - protein, 322 aa, Homo sapiens; identical to SEQ ID NO: 919691

SEQ ID NO: 919693 - protein, 252 aa, Homo sapiens
MRRRAPACLVPFCVGFRVWISASSPGTSTEIFCIYYPWELELSSFENGTSLKVKLDNWAQLEKFLARKKFKLPKELIHGTIHCKAGVPEILIEEVYTLLTHREIKSIQDDFVNFTDYSYQMRLPLVSRSTVSKSIKDNIRLSELLSNPNMLTNELKAEFLILLHMLQRKLGRKLNPEWFDVKPTVGEVTLNHLPAQASGRRYNLKVKRGRVVPVLPNIGSGGSSHREIHVKQAGQHSYYSAMKPIRNMDKKP

SEQ ID NO: 919694 - protein, 907 aa, Homo sapiens
MWPESPTFWLAEPRGGSTLECPSGCLHPMRGLGALGVCSWQESGPSPLTLMHPWLNPVPQPAGPIVVTRQKVEPGILPCVGSSLLPSGETESWRGSRMFLRPHQSLKNCYARYHQAFANCNQSEQELQGHESQQLAAETQALAQGTQQDSTRRVGEQLQDTHSWKSELQREVEALAAETDLLLAQKQRLEHALDATEAPFSIATDNLQCSQGHQNANLMRDHVETELLKVPAAAHPPAPSQCLNNCFSSRKPSARNKGPCQVMETLTVQEEANPGTEGCRTRALAHKKEAELIRNIQELLKRAIVQAVSQIRLQHGGSPAVPSPATHQGPAPPRPRLNREHTEICEMDWSDKVEAYNLDETCGRHHSQSTEVQAHPALHHLPREGGPSSAPTLALAVVSPPSAWGPQRRCFPQPDPEALAPEDTWATVCPWHDASTPETWTKFTQDNLCRSQREHLDSANLWVLVDCIFRDTSEDLGLQCDAVNLAFGRRCEELEDTRHKLQHHLHKIRNNVAALKEAIKDKEAPLHIAQTLLYLRLHWPNMELCGNAAQFRHDTGQVMGRVPLSARDLCPRGLTPPCATSSSREEAPSDKPQLTPPNIPKLVSEVEELNMSITALREKLLEGEQSLCNLEDIHMSLEKDVTAMTNSLFIDRQKCMAHRTCYPTILQLAGYQTPPEATAEDEKHYCRSLGEAQVVLPSPVGSPSVSGPPCPTLEGVADGELSVEDARGGGLGDIVQPPPLRPSGHWQLLLTHRPLCGVPVDLALNSYPWWRSVEPGHSCPLRVGVALSCLMSGFPHLPPVQWLLEITLTGIRCMAQGHRNPGIQEPKVSHPGSEGLAKALTPVPITPASIPEYSGGDAIGLSRAELVPMAAGTTVAELEETRILPKSLQRECISAHTLILDLWPPER

SEQ ID NO: 919695 - protein, 109 aa, Homo sapiens
SHRPPQAPPPSGRRRRYKPRVPGVKSYVLGLLKHLKSTISFLASSSWALKYLFLDEGSTLRLNSTQHYRLGCRYGLEAMVKEKESENWLPSLQAVYLVMCHLYLYCNPC

SEQ ID NO: 919696 - protein, 157 aa, Homo sapiens
PRCKTCFSPSAMIMRPPQTHATISLLNLFFFINYPVSVFARLCGKEKEEEEEKEERKERKDEGKEIEKECKTSNAKKKVQNPVKCFGWLRNESSILEQSVMAQMYFKNAAIENKSPGAHRLESLWATMHEDIQAALWSSLHGEKLRPPANSQHQLAI

SEQ ID NO: 919697 - protein, 157 aa, Homo sapiens; identical to SEQ ID NO: 919696

SEQ ID NO: 919698 - protein, 142 aa, Homo sapiens
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQDTFDRERHKDPSPRDRDMQQLDSNLNSTRSQCNQVQDDY

SEQ ID NO: 919699 - protein, 233 aa, Homo sapiens
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQDTFDRERHKDPSPRDRDMQQLDSNLNSTRSQCNQVQDDLVETEKNLEESKNRSAISLLAAEEEINQLKKQLKSLQAQEDARHRNTDQRSSENRRSEPWSLEERKRILSISLQGISLLYLTLMACVGEVFL

SEQ ID NO: 919700 - protein, 104 aa, Homo sapiens
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQA

SEQ ID NO: 919701 - protein, 136 aa, Homo sapiens
MFSQRCAFLCAEALGIISAQELKRLFSTVVLNYLWAFDQYSAGNVIIALVFVTLFLFLIKIFKTLLEGFLCVEARREKISSSKFLVEKIKISQKDLNIVFMRQNKGVLPKPLIMSGKTEIMVFLLMGITIFCNLSV

SEQ ID NO: 919702 - protein, 177 aa, Homo sapiens
MGSVDKRGGGGGALRPGSVPERGRGGAEREDCRPPRPRSLRATRLSRGGTKPRPPPRPLRPPSLAARAPPPPRARQPPPSPRRPSAAPRRRRGRGLQAPRLAPPTESAARPVRGSGPAPGSTPRPLRACVPGTRRRPPGLEGKTCGGGDLRRRGRTRRGGPGRSPSRVALLHLHSVN

SEQ ID NO: 919703 - protein, 115 aa, Homo sapiens
MIFGGETSSKLYQREMNVNSAEVCRLCYKIIVHLNYFIDNNLNIKETLSFPFEILFQVLHASKTTHVSCSAGSHEKPLTLHNPLKNCSPELSGMMNLKVCSCLLTQKPVIIKLFL

SEQ ID NO: 919704 - protein, 124 aa, Homo sapiens
MLDKELGTKRALNRLTLKPSVDGKVKRVHCNTCPLGLWESQEPTPRQYHGHLPCLLHLPVCMLPCPTEIHSCCPGWSAMAQFRLSTISASQIQAILLPLSPKELGLQMKAPLSSQKSTSQTTVS

SEQ ID NO: 919705 - protein, 218 aa, Homo sapiens
MKAAVLDLGSLLAKLFETSTAPPAGPSSRPSGGAAAAGSGGSRAGTPLGTAPTLLRALAPDSPSASRRSPAPLLSSPYSRGSAASRAAGAVGTLLSWPSSPRAGKAPPQPPTPSGGGCSPARLVVPARPPSGPGGVWAALPRNPLQPGPGERELGACVAPGAGPRTLFLTLPDIGEEGASDGDSGDGEALECSGMITVHCSLNLPGSSDLILPSQTLE

SEQ ID NO: 919706 - protein, 218 aa, Homo sapiens; identical to SEQ ID NO: 919705

SEQ ID NO: 919707 - protein, 189 aa, Homo sapiens [sequence omitted]

SEQ ID NO: 919708 - protein, 192 aa, Homo sapiens
SQTLHPPMTLQLSRYSRGWGLSSDRPRGAKAKVPSCFGTAPRVLKPLHASSPTTWSPQDVAVSGSSLERSPPGCRHPPRAASPAAPRKSQRCPAPAPTLPRPPTRGRDFRLPASGLAVSGEWDPIPWGYVGEVGGCSCRGFLLVSSRNGGGARCGWANPGSPRTLRSARQGARACQGRRAGVNVASVGLQPR

SEQ ID NO: 919709 - protein, 369 aa, Homo sapiens
MGLRKKSTKNPPVLSQEFILQNHADIVSCVGMFFLLGLVFEGTAEASIVFLTLQHSVAVPAAEEQATGSKSLYYYGVKDLATVFFYMLVAIIIHATIQEYVLDKINKRMQFTKAKQNKFNESGQFSVFYFFSCIWGTFILISENCLSDPTLIWKARPHSMMTFQMKFFYISQLAYWFHAFPELYFQKTKKQDIPRQLVYIGLHLFHITGAYLLYLNHLGLLLLVLHYFVELLSHMCGLFYFSDEKYQKGISLWAIVFILGRLVTLIVSVLTVGFHLAGSQNRNPDALTGNVNVLAAKIAVLSSSCTIQAYVTWNLITLWLQRWVEDSNIQASCMKKKRSRSSKKRTENGVGVETSNRVDCPPKRKEKSS

SEQ ID NO: 919710 - protein, 242 aa, Homo sapiens
MGGGGCGLCSSGSLCLCPAAGSQSSRQLPALQTLSPESQSPGHRRGLLLGYSLPGTHPGGAMAVSIGGGNSSESVPAHSMKQRQDLALPKLKALFWAFHCLGLFNPHTSGSERRSNWPVSHSQYVVNQLPADRQAKILERSQQGKPARPDLVHSRLTDPQGSPGWHPVLPGFVGSENVQVLEAGVLLGGPAGAQGRASRGQCRGVAPMAPHQPQPLCSPILCSYHLVVSCTEMVHCSARRYR

SEQ ID NO: 919711 - protein, 192 aa, Homo sapiens
FWTLSAIGMAPQLVTEALNTHVLAKNHINDGSITRLQEFRVIFQLFTRTDINLFLQLSKVACNVSCVAIQHRGIASAELARMVQDKHLSGETSCFHWWVVFSVTSNVARTSILDRHFLDIEAHIVPRKSFTQSFMVHFDRFYFSCNTDRSKGDQHTRFENTSLHLANRKSTNTTKGLSVGQVCGALGPLATD

SEQ ID NO: 919712 - protein, 140 aa, Homo sapiens
ELNMGTSNRSTACPRPSSQSNFPKQQLFRWNLVKRHIEGGFEGRNWRVGAGKRPHAADRLVEGGAWLAPSESLPFPVTWCKQLGFAPRTWWGQIRSLPSCLSPASLSGKVWPPAAAKHGRPLPTEVKPSILRPCPSSSSI

SEQ ID NO: 919713 - protein, 136 aa, Homo sapiens
SQYKMLSHTSLLVLHMPATNGKTLHFTIPTSCMILEYLRSPLTLKFKLGYTPLDSACTQEPAFNSSGEHRHTGAVGWWNGGCVPWIYKRIPEATESQMTRSCVKASLGESHREDEKQAARKGPRAERRLTGHSAHQ

SEQ ID NO: 919714 - protein, 244 aa, Homo sapiens
LNVSYSNQTHLLADVRALNYRAVQTKSFFYALYYRVCLVIAKILITDRNIIFTGTTCIKSLYKENKNLPLHEPVPKEQPRLIHSCDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 919715 - protein, 523 aa, Homo sapiens
ASSTSDKDDNYTHRMVLRKLRPVQDGIQGYASNFPEPLLSKNLSSISNPVLPPKKIPKEFIMKYKRGEINPVSALHQFAQMQRVQLDLKETVTTGKCNVMGPYFAFCAVVDGIQYKTGLGQNKKESRSNAAKLALDELLQLDEPEPRILETSGAQAQGDPNSVPEPLAGVIGDPPGKPRPMRKDGSGLGLKRPFGHRLPQPIVKERFNQLISNRSEYLKYSSSLAAFIIERAGQHEVVAIGTGEYNYSQDIKPDGRVLHDTHAVVTARRSLLRRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKWSIQRGLGLEPQGTLKYWIWKNKETWSYLTGKCRVRIAQRE

SEQ ID NO: 919716 - protein, 523 aa, Homo sapiens; identical to SEQ ID NO: 919715

SEQ ID NO: 919717 - protein, 537 aa, Homo sapiens
ASSTSDKDDNYTHRMVLRKLRPVQDGIQGYASNFPEPLLSKNLSSISNPVLPPKKIPKEFIMKYKRGEINPVSALHQFAQMQRVQLDLKETVTTGKCNVMGPYFAFCAVVDGIQYKTGLGQNKKESRSNAAKLALDELLQLDEPEPRILETSGAQAQGDPNSVPEPLAGVIGDPPGKPRPMRKDGSGLGLKRPFGHRLPQPIVKERFNQLISNRSEYLKYSSSLAAFIIERAGQHEVVAIGTGEYNYSQDIKPDGRVLHDTHAVVTARRSLLRRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKWSIQRGLGLEPQGTLKYWIWKNKETWSYLTAHPPTSAYTRIHTISNPAVSPVEPT

SEQ ID NO: 919718 - protein, 187 aa, Homo sapiens
ACNPCTLEGQGRTSQWNSLYRMGHSTSKEAVDRNPESKMALLSESGAWLSIGYFYPSQFLLKDGFCSQFSGPSSRQPTSRDSRQHAGSPGLVWYSGFSQPMGREATSHLPGPLASLLKALFLAPPGSPPGLIQGPSPASAHLGGAREPHGNGIGPVDTNDVSRGVPGSSLCCKSLPLTKLLPPAIPQ

SEQ ID NO: 919719 - protein, 293 aa, Homo sapiens
PDQLCITRALMGQEEKIEAKSLFKELMAGRKFPKFEKKYGCRIVLKHNYCTLKSIQKFYTNKYYNQSFKSHRQRILEAEKEKMDHDIKGNSHDINKIQEDIFLNQKYKENIIKLSRIYHDQPVKPLDRAVFWIEFVMCHKGAKHLQVAARDLTWFQYHSLDMIGFLLDYVATSCFGYADFKLRIKSRIQPFSQQLNQKEKEKHKILRNIPKQEAQRKELFSRVPGAPPLTAQGNPEGLQDGSRNGALSSEPWYHTLDPPQLAETGSPGPVDQPVGPRPSDLADHAMRPRCQWR

SEQ ID NO: 919720 - protein, 259 aa, Homo sapiens
MGKSWNSLESSEKDRKMRESLELPRDLLNCCDQNTDSDMDNEVQAQEVSDGNEELIGNWSRGHFCYALAKSLAALYPCSRDLWNLELESDDLGYLAEEIPKQQSVQDVAWLLLTTYAHMHRKRNDLKLEFIFNRETEHKKTFLTAPPITDLRPRQEEWFHGPGPGPSCSVQPLDTAPCSPFLLADFSLSKRDYLLNPYIPIVTWKFPFANIIDPSTTGVLGALTLHAVKNLHVTFDSPKSLLIIAYFGPDGCFTGNINS

SEQ ID NO: 919721 - protein, 259 aa, Homo sapiens; identical to SEQ ID NO: 919720

SEQ ID NO: 919722 - protein, 188 aa, Homo sapiens
PQLTHRSEDKKIVFMLPLFSGCLTCFSAAVATARCLGQETLAVAKATAEFWLLSWLCEEYLRAPDASAVTHCQTKCKGLGSELTETMRPFLNSEKQVIVIYSSLEFFLAVSDHGLGYRQGRVYVSQLGCFVRSGLLPPQPNLKNRTSFFRGNFPPGGISLQWTSSPLVPSAIRTPRFRSVGPKFHQIQ

SEQ ID NO: 919723 - protein, 604 aa, Homo sapiens
GRRARFIAAATAGYSGARESLGSMLCALLLLPSLLGATRASPTSGPQECAKGSTVWCQDLQTAARCGAVGYCQGAVWNKPTAKSLPCDVCQDIAAAAGNGLNPDATESDILALVMKTCEWLPSQESSAGCKWMVDAHSSAILSMLRGAPDSAPAQVCTALSLCEPLQRHLATLRPLSKEDTFEAVAPFMANGPLTFHPRQAPEGALCQDCVRQVSRLQEAVRSNLTLADLNIQEQCESLGPGLAVLCKNYLFQFFVPADQALRLLPPQELCRKGGFLVAMDGVPSLELGLPRKQSEMQMKAGVTCEVCMNVVQKLDHWLMSNSSELMINPCPGARVLGNACLYHEGVHHLGGHLTAPPVVQLVAKITPEKVCKFIRLCGNRRRARAVHDAYAIVPSPEWDAENQGSFCNGCKRLLTVSSHNLESKSTKRDILVAFKGGCSILPLPYMIQCKHFVTQYEPVLIESLKDMMDPVAVCKKVGACHGPRTPLLGTDQCALGPSFWCRSQEAAKLCNAVQHCQKHVWKEMHLHAGETRVTVAARDPEPASEAHENGDDHTCLTRMLRQFTETFWSPFPPRPAFMSLLGPENPSQGAQRGTQESLAVQAL

SEQ ID NO: 919724 - protein, 150 aa, Homo sapiens
MLIIKKYSRYFDDFFGGGKEECKDIEENKLRFSCYTLTTQNMSSVQFTILQPGLSFTSLAKPDCEVCTSTLAYSLDEMTWNTEKYEIKIDHFDYFIERNVMVLLIINEYVEGIISKNEYMIYIAVLCIDGLMQIAVITYTGWLTFLGKTF

SEQ ID NO: 919725 - protein, 194 aa, Homo sapiens
FPQHFLRCMNSYSALAGLGRGRIALAQTAGVLRSLEQEEPFDLSQKRRAKVPVFQSDGESAQGSHCHEEEEEDNCYEVEPYSPGLAPQSQQLCTPEDLSTKSEHAPEVLEEACKEEKEDASKGEWEKRSKGDLGAEGGQERDCAGRDECLSLRAFQSTRRGPSFSDYLYFKHRDESLKELLERKMEKQAVLLGI

SEQ ID NO: 919726 - protein, 112 aa, Homo sapiens
MATGAPSRTRSVPFPWQRYCLLGRTWAAEGNWGRRRLCSFREAPLWRPDRGRRCKPAPSVSQLLAMTSTGISASICHSKPRSQLTSKQMSCIPLVGVERVKRKLKLKRRRRP

SEQ ID NO: 919727 - protein, 375 aa, Homo sapiens
SGSPWADLGCGRKKMQASPIRIPTVSNDIDWDFCFHMSQQTEIPAHQQTDELYPTGGCGESEEETKAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLGVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQAHSVCVSLFTEVSPKTAEMSALLAKAYAMSGEAQHRDAVEIYFIRSINAYRATLGSEDFETLSTTEEFCKWLVQNGEKQDK

SEQ ID NO: 919728 - protein, 310 aa, Homo sapiens
MATGAPSRTRSVPFPWQRYCLLGRTWAAEGNWGRRRLCSFREAPLWRPDRGRRCKPAPSVSQLLAMTSTGISASICLPVQAKKHATSAKNTLLTWKANTTSNKEKEEILEALVKLYYTLGVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQAHSVCVSLFTEVSPKTAEMSALLAKAYAMSGEAQHRDAVEIYFIRSINAYRATLGSEDFETLSTTEEFCKWLVQNGEKQDK

SEQ ID NO: 919729 - protein, 361 aa, Homo sapiens
MQASPIRIPTVSNDIDWDFCFHMSQQTEIPAHQQTDELYPTGGCGESEEETKAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLGVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQAHSVCVSLFTEVSPKTAEMSALLAKAYAMSGEAQHRDAVEIYFIRSINAYRATLGSEDFETLSTTEEFCKWLVQNGEKQDK

SEQ ID NO: 919730 - protein, 365 aa, Homo sapiens
HLLSTPVPAKPPRHRPAALASWGAWGGWRGCVCTEALALGQPQSAMVSPSQPWSAPISHGQPQSAVVSPGQPQSAMVILSQPWSAPCPLTLLGSRGKPPAPAKETGVLRHSRRDKNMDDSGTRSKNPVSFRVALGGPAEPTTCRMDLRGIRASSHLDFLLARPLTLVAGTVLRTSALGLAQSLHLGQQHRGSLFHTCLLPEQAFTRNLGSGYKGRTWFHPLPVSRTVCSDESRNRERENPPGPGHCFSPVSPIIAQIITCVSPILAQTITCVSPSIAQTITAATGYIIVIIIIIIITNTTITITSITIITITTAINSIITTTTIIDITTITRTITTIIIITTMTTISTITTTTITASLTIITIMS

SEQ ID NO: 919731 - protein, 210 aa, Homo sapiens
MKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKKESDMAEDMKGGVM

SEQ ID NO: 919732 - protein, 391 aa, Homo sapiens
MPTYLVAFVICDYDHVNRTERGKEIRIWARKDAIANGSADFALNITGPIFSFLEDLFNISYSLPKTDIIALPSFDNHAMENWGLMIFDESGLLLEPKDQLTEKKTLISYVVSHEIGHQWFGNLVTMNWWNNIWLNEGFASYFEFEVINYFNPKLPRNEIFFSNILHNILREDHALVTRAVAMKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKKESDMAEDMKGGVM

SEQ ID NO: 919733 - protein, 145 aa, Homo sapiens
MRRRNRKTRRYGVLDTNIENMELTPLEQDDEDDDNTLFDANHPRSVEFLGFFVAQAIVQNQKNFKSQSPTSNVLLDFRDKASVEPVQKKSFQCPGLLLVQLKDWQLVFVFSLQGLVVSSFNPDTNKDHRDSGEGQNPIQEIYGIQ

SEQ ID NO: 919734 - protein, 167 aa, Homo sapiens
MTGKLATKKFGEEVCGCSSLSGQKLKLFVSHVSAHQRVTSGEEEFNNQVDRMTRSVDTTQPLSPTILSSPNGPMNKVAMVTGMDKATYALNQYPIYGTISPIARIHGYRNQGEEVEVVPLTITSSDPRAKVLLPVPMTLCSAGLEVLVPEGGMLPPGDTTMIQLNWK

SEQ ID NO: 919735 - protein, 452 aa, Homo sapiens
MEFWYVRSRGCLYNQHPRLKNLGTDSLMSRNNTSHVSSQFDGGRIMSSETPTGHFNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDIAGIPLPQNLSGYSLLPLSSETFKNEHKVKNLHPPWILSEFHGCNVNASTYMLRTNHWKYIAYSDGASILPQLFDLSSDPDELTNVAVKFPEITYSLDQKLHSIINYPKVSASVHQYNKEQFIKWKQSIGQNYSNVIANLRWHQDWQKEPRKYENAIDQWLKTHMNPRAV

SEQ ID NO: 919736 - protein, 452 aa, Homo sapiens; identical to SEQ ID NO: 919735

SEQ ID NO: 919737 - protein, 134 aa, Homo sapiens
MTHLLRSRAFRLQRLSVKAPKPLEGDANGCGGAHEHHQVVIWKLSLSEGLCSHQWSQTASGHSFPISVLDRSDAVQAPGITRSFLCVLYLTTGSPGPRRELPLSRSSLVFAEETSLPLNREGGKVVTIWLGDYV

SEQ ID NO: 919738 - protein, 150 aa, Homo sapiens
LRDAWGWMLLFIIRCIFCYSWSWALGAIMDMFQCCRDFVYGQFWGQFMARFWGALLPTCPASLICKSTKAKAALSWFSSAIYDSFLICPQVGGCVQRVLLVTGSSPRGLTPPVKDEECTIWQVGHHWTIALASFQNVDCPEFQSLKEHPA

SEQ ID NO: 919739 - protein, 150 aa, Homo sapiens; identical to SEQ ID NO: 919738

SEQ ID NO: 919740 - protein, 295 aa, Homo sapiens
ENRRLESKIREHLEKKGPQIDNARLAADDFRVKYETELAMRQSVENDIHGLRNVIDDTVTRLQLETEIEAVKEELLFMKKNHKEEAKSLQAQIASSGLMVEVDAPKSQDLAKVMADIRAQYDELAQKNGEELDKHWPQQIEESTTVVTTQSAEVGAAETTLTELRRTVQFLEDDLDSMRNLKASLENSLREVEAPYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 919741 - protein, 155 aa, Homo sapiens
MGSTVTRGVGIIAVEKDGVVTKAQVTKLPLHGGNLSFSDEKGDPAMQRSDWIRKLKLAHGQQPASYKGLPTAHEALSPAKSHVHELRRASSSRLGKRQSVCSKRKERRKHVERPKEQAKSDDEVKKSNSNHFNRFGCKSETGDEVEWRESGRDSL

SEQ ID NO: 919742 - protein, 141 aa, Homo sapiens
MVYWSVLTLPIKTYLRLELSHYHENSMKVTAPMIQLPPTGSLPRDTGIMGTTIEDSTDTLRDQRRSSGGSPSLPLPGQGSCHSRHGSRDGPGILVTRAPCPCEWEIAGDVGWASPCTLRTHCQGAGPQVGSKEPLEENIVP

SEQ ID NO: 919743 - protein, 205 aa, Homo sapiens
MAASTASHRPIKGILKNKTSTTSSMVASAEQPRRSVDEELSKKSQKWDEINILATYHPADKGYGLMKIDEPSPPYHSMMGDDEDACRDTETTEAMAPDILAKKLAAAEGLEPKYRIQEQESSGEEDSDLSPEEREKKRQFEMRRKLHYNEGLNIKLARQLISKDLHDDDEDEEMLETADGESMNTEESNQGSTPSDQQQNKLRSS

SEQ ID NO: 919744 - protein, 66 aa, Homo sapiens
EVISQAMLNNAQPDQYEAPDKDFMIVALDLLSGLAEGLGGNIEQLVARSNILTLMYQCMQDKMPER

SEQ ID NO: 919745 - protein, 898 aa, Homo sapiens
MVWDRQTKMEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 919746 - protein, 898 aa, Homo sapiens; identical to SEQ ID NO: 919745

SEQ ID NO: 919747 - protein, 890 aa, Homo sapiens
MEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 919748 - protein, 691 aa, Homo sapiens
MVWDRQTKMEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPER

SEQ ID NO: 919749 - protein, 581 aa, Homo sapiens
CCELLVTQGVREEPQYKGMSRQVVSKLCPMEPNLAHDLQAGDEEPEVRKNVCRALVMLLEVRMDRLLPHMHNIVEGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 919750 - protein, 247 aa, Homo sapiens
GTDDISACRIKCQNSVELLAFYPACTDTLVSGCYFGLPAVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 919751 - protein, 247 aa, Homo sapiens; identical to SEQ ID NO: 919750

SEQ ID NO: 919752 - protein, 898 aa, Homo sapiens; identical to SEQ ID NO: 919745

SEQ ID NO: 919753 - protein, 898 aa, Homo sapiens; identical to SEQ ID NO: 919745

SEQ ID NO: 919754 - protein, 930 aa, Homo sapiens
KFAVTQSGRLLALGGRGGSSSRRWRPGCQEQFRRVSLQTKMEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 919755 - protein, 307 aa, Homo sapiens
MVWDRQTKMEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPK

SEQ ID NO: 919756 - protein, 199 aa, Homo sapiens
GNELRLGCSGGEERTFQASEMPNMSSSAGQTDHGPPQPGQVSVIVGQREDGTGLDPCPGPLTPRPQLFPHSVFHLHFAPEDFLKLSLVHTASAPGSCPVICVAKCYTQQENVTRDTNPSVTKQDTITIRPEPTLQMDPAQWKAGQEAEVQVPTLDSITKHCTRGSQAASEDLILLNTSIPVSGRTFANPSQLDAATSEG

SEQ ID NO: 919757 - protein, 157 aa, Homo sapiens
MNGPDFLQGIKERNEQHKKERKKEQRPNDWDFLEERRSPNRQKHLKLVNSCFRIRSQRLGKNASSEHAHNFRKHTVHVAPPKCWQATARADSPTQGKISGEEKGEKECNTPETCQHIKPAAMSTITVLRGMWVRISALALLHWMILGKRFHLFKPML

SEQ ID NO: 919758 - protein, 136 aa, Homo sapiens [sequence omitted]

SEQ ID NO: 919759 - protein, 136 aa, Homo sapiens [sequence omitted]

SEQ ID NO: 919760 - protein, 297 aa, Homo sapiens
MPAGWGGQPMMFVASSISDKDDSVDAQNICHVWHMNVEALPEWISCLIQKAQWTVGKLNCPFCGARLGGFNFVSTPKCSCGQLAAVHLSKSRTDYQPTQAGRLMRPSVKYLSHPRVQSGCDKEALLTGGGSENRNHRLLNMARNNNDPGRLTEALCLEVRPTYFEMKNEKLLSKASEPKYQLFVPQLVTGRCATRAFHRKSHSLDLNISEKLTLLPTLYEIHSKTTAYSRLNETQPIDLSGLPLQSSKNSYSFQNPSSFDPSMLLQRFSVAPHETQTQRGGEFQCGLEAASVYSGPY

SEQ ID NO: 919761 - protein, 282 aa, Homo sapiens
MFPAQEEADRTVFVGNLEARVREEILYELFLQKAGPLTKVTICKDREGKPKSFGFVCFKHPESVSYAIALLNGIRLYGRPINVQYRFGSSRSSEPANQSFESCVKINSHNYRNEEMLVGRSSFPMQYFPINNTSLPQEYFLFQKMQWHVYNPVLQLPYYEMTAPLPNSASVSSSLNHVPDLEAGPSSYKWTHQQPSDSDLYQMTAPLPNSASVSSSLNHVPDLEAGPSSYKWTHQQPSDSDLYQMNKRKRQKQTSDSDSSTDNNRGNECSQKFRKSKKKKRY

SEQ ID NO: 919762 - protein, 282 aa, Homo sapiens; identical to SEQ ID NO: 919761

SEQ ID NO: 919763 - protein, 247 aa, Homo sapiens
VKPEKGRGLSSYFILRPRPEDVPCSGGGRQDRVCWEFRGPSSGRDSVRAVPSGSSRSSEPANQSFESCVKINSHNYRNEEMLVGRSSFPMQYFPINNTSLPQEYFLFQKMQWHVYNPVLQLPYYEMTAPLPNSASVSSSLNHVPDLEAGPSSYKWTHQQPSDSDLYQMTAPLPNSASVSSSLNHVPDLEAGPSSYKWTHQQPSDSDLYQMNKRKRQKQTSDSDSSTDNNRGNECSQKFRKSKKKKRY

SEQ ID NO: 919764 - protein, 790 aa, Homo sapiens
MLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSFSDDGALGPVLTTFDHTLDHESLNPGVFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRENRGLEELAVSVGVDGTLYKLHPRFSSLVAATVRELAPRCVVTFLQSEDGSGKGAALVTAVACRLAQLTRV

SEQ ID NO: 919765 - protein, 197 aa, Homo sapiens
MRCVWLGGVCVTREGGVCEMSTRGMRGTCSCGGRVPESRGYPLSGCGPRSCRLGAGPLRRAPTQQAQKCLHKVQLRQELWGPGPGPVCACMAVCMRGPWRGTGGEVASHAHTHTQMGWAWPRLQALSLLGPGAEWPAATPHVFRLVQREVDLIDLPSGYGIWGDEEADSWNGRKRARAYPLPKHPTPHHTAPPGAFL

SEQ ID NO: 919766 - protein, 761 aa, Homo sapiens
MLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSFSDDGALGPVLTTFDHTLDHESLNPGGSHGALVGWGASGLSPKPLPFPSSPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRENRGLEELAVSVGVDGTLYKLHPRFSSLVAATVRELAPRCVVTFLQSEDGSGKGAALVTAVACRLAQLTRV

SEQ ID NO: 919767 - protein, 522 aa, Homo sapiens
MSNESCLPYYTAHSYSSMSAFKTSMGDLQRQLYNRGEYNIFKYAPMFESNFIQINKKGEVIDVHNRVRMVTVGIVCTSPILPLPDVMVLAQPTKICEQHVRWGRFAKGRGRRPVKTLELTRLLPLKFVKISIHDHEKQQLRLKLATGRTFYLQLCPSSDTREDLFCYWEKLVYLLRPPVESYCSTPTLLSGDAPPEDNKSLVAAELHREGDQSETGLYKPCDVSAATSSAYAGGEGIQHASHGTASAASPSTSTPGAAEGGAARTAGGMAVAGTATGPRTDVAIAGAAMSPATGAMSIATTKSAGPGQVTTALAGAAIKNPGENESSKSMAGAANISSEGISLALVGAASTSLEGTSTSMAGAASLSQDSSLSAAFAGSITTSKCAAERTEGPAVGPLISTLQSEGYMSERDGSQKVSQPSAEVWNENKERREKKDRHPSRKSSHHRKAGESHRRRAGDKNQKASSHRSASGHKNTRDDKKEKGYSNVRGKRHGSSRKSSTHSSTKKDSSTLEDRSWVSGKT

SEQ ID NO: 919768 - protein, 288 aa, Homo sapiens
MSDKLKERKRTPVSHKVIEKRRRDRINRCLNELGKTVPMALAKQEALAQIRSRVRSLVLSSATVPDQQALGRCEGPFLLLQSSGKLEKAEILEMTEGRGPAKAPLPARRQQGGEGELVPREAAELLAEFANYFHYGYHECMKNLVHYLTTVERMETKDTKYARILAFLQSKARLGAEPAFPPLGSLPEPDFSYQLHPAGPEFAGHSPGEAAVFPQGSGAGPFPWPPGAARSPALPYLPSAPVPLASPAQQHSPFLTPVQGLDRHYLNLIGHAHPNALNLHTPQHPPVL

SEQ ID NO: 919769 - protein, 30 aa, Homo sapiens
MSDKLKERKVSRLSPNGTCALVVEASDSPT

SEQ ID NO: 919770 - protein, 132 aa, Homo sapiens
MYKSMFLNDLRVKVIALIKDNVYGIEFRDKRQFVAHGNSGSHNTIVFTLTLYGPIPTGQKQMGQEHMILCRFADQTAVQLPPQRRLIGKQCMCLVDLDRARAAEECGYSVQVISMEPESCSPKNNMIVGVPI

SEQ ID NO: 919771 - protein, 140 aa, Homo sapiens
SRESSDSAHFKYGGLGEALPSGSYPRSRSERLGVAVEVSPLMPTPFKKQELASSCILGTGGKSPRLTQSSGFFGNLSMVTNLDDSNWAAAFSSQRSGLFTNTEPHSITEDVTISAVMLREDDPGEAGKMALSFVTSSFSL

SEQ ID NO: 919772 - protein, 174 aa, Homo sapiens
MFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELVNVL

SEQ ID NO: 919773 - protein, 327 aa, Homo sapiens [sequence omitted]

SEQ ID NO: 919774 - protein, 227 aa, Homo sapiens [sequence omitted]

SEQ ID NO: 919775 - protein, 180 aa, Homo sapiens
MPSSVPKTSVESLGSPSSLSSSKPREPLCPLKHPSHQPPASTLSPNPTSSTESLGYLSSLSSSQPPEPLRPLKHPSHKPHGRSPPRRRNPGWVSWSDSMQADSETDAIICPMCKAPERSCPHTWWVPSSPRVIRGVGRCSDPNLGLSWRQEAARAWCHCTSSQYPFEHPNLPTHLPKASF

SEQ ID NO: 919776 - protein, 353 aa, Homo sapiens
MPRAQLPEDSSAVDMDILFPLDSVIGTELCPSPIPQIIHFVLFVVFSLVILIILRLYIPREPSSVPPREEDSENDQAEVGEWLRIGNKYITLKDYRILLKELENLEIYTFLSKKCLKKLSREGSSHHLPRQVRPGPVYKPAPARNHRPRGGRGKASPTSFHVSPRAPLAPLASMPSSVPKTSVESLGSPSSLSSSKPREPLCPLKHPSHQPPASTLSPNPTSSTESLGYLSSLSSSQPPEPLRPLKHPSHKPHGRSPPRRRNPGWVSWSDSMQADSETDAIICPMCKAPERSCPHTWWVPSSPRVIRGVGRCSDPNLGLSWRQEAARAWCHCTSSQYPFEHPNLPTHLPKASF

SEQ ID NO: 919777 - protein, 150 aa, Homo sapiens
AQLPEDSSAVDMDILFPLDSVIGTELCPSPIPQIIHFVLFVVFSLVILIILRLYIPREPSSVPPREEDSENVRSPQPTPSRECFYFSCSLFHFSTSARGAPVMGTLIIPLGTAGQAGVGVGIGFPTQAPRPSVEVHGRRQSKTKPQDSAA

SEQ ID NO: 919778 - protein, 322 aa, Homo sapiens
MPRAQLPEDSSAVDMDILFPLDSVIGTELCPSPIPQIIHFVLFVVFSLVILIILRLYIPREPSSVPPREEDSENDQAEVGEWLRIGNKYITLKDYRILLKELENLEIYTFLSKKCLKKLSREGSSHHLPRQVRPGPVYKPAPARNHRPRGGRGKASPTSFHVSPRAPLAPLASMPSSVPKTSVESLGSPSSLSSSKPREPLCPLKHPSHQPPASTLSPNPTSSTESLGETPHAGRWRQGSRFPQPGCANAAGRIRHQNPRHSHGHRISDIHEQWESPEDNLEMESHSVASGWSAVDHLGSPNFLRIQAILLLSSEYRIQACA

SEQ ID NO: 919779 - protein, 394 aa, Homo sapiens
LSFLVCKIVELNLDPLMLVLKSKAKNNCKRPYFRVASYSSCACAVSLEQRRGQQACFRNPPVLSSFRTQDSKLIGGLSCLTAPSRFLRRFSARHSLRCEDGVGQRGKVLCLRRRFCGVGNGFSDLNRDKLLHPTGFPISPRDPRVQVQELPSNRPWQRVSRIAEVSRVGVLRLPQSSRTVQRGFAFKTSCRHLDREGAVPCFSRGPDTATDLDAFSSPQTKNLDFRRKWDKDEYEKLAEKRLTEEREKKDGKPVQPVKRELLRHRDYKVDLESKLGKTIVITRQPLNLRWEDQRNLGMSMRVERSTLDQVKKRFEVNKKKMEEKQKDYDFEERMKELREEVTAEKETVNRGHTCGRALQGLGKATSLSLLCVPRWTTPQLSGGPFDPVLSSGPE

SEQ ID NO: 919780 - protein, 307 aa, Homo sapiens
PTFAHSSLARASHMLFLVMMGTGSAPPLALLQLPLTVGLCEALDDVELGFCISPENCGDFVWKLTQSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKFRPGAVAHACYPSTLGGQGRWIA

SEQ ID NO: 919781 - protein, 193 aa, Homo sapiens
DREMRLNPKIHSGLTLYQDTGYKIPPGNDKYQKPGSKVLNINGPLVERKKNTVVLFNSTSRPVPGEIVPSSSNSGASKIERVRLPLGGLKYLWPLCENIRSDHPRFPEWYSFSLMASSTRSRPQARVVAMESREVVPRAAVMRGDGPVSSLKAEHTTTAGKLQQLQRTMWKGRCLNGLEFYIKNSGGLEEAPR

SEQ ID NO: 919782 - protein, 247 aa, Homo sapiens
MTCSSLSSTIVVSPPQPHETVSPLNLSLYKLPIIRDLECSEDRQMWESLELPRDLLNGFVQNADSDVNNKVQNDVISDGDEELVGNWSKSDSSYGENNGFLGQVQGPPKDLVSCVPATPAVAKRGQSTAWLWLQGMQAPSFVSSYIVLSLQAHKSQELRFGNLHLDFRGCMEIPGCPGRSLLQGVQVVLWIIAKEIYYTESESGMFLTERQHGTERGYEENCPGLPRDLDIQIQEAQRTPEKFIAKR

SEQ ID NO: 919783 - protein, 247 aa, Homo sapiens; identical to SEQ ID NO: 919782

SEQ ID NO: 919784 - protein, 168 aa, Homo sapiens [sequence omitted]

SEQ ID NO: 919785 - protein, 129 aa, Homo sapiens
APGPSGRTRRRPDAPAPDPERIQRLRRLMVAKEEGDGAAGAGRRGPGRSRKAPRNVLTRMPCESAGRAGSGAAAVRKLAAEGASAGRRWPGAGLHVLRERLGENLRGSSVTMGWICLSNVGNEGVGRVT

SEQ ID NO: 919786 - protein, 305 aa, Homo sapiens
VAEYESFLRTGVRGGGRGRGRARGAAAGSGVPAAPGPSGRTRRRPDAPAPDPERIQRLRRLMVAKEEGDGAAGAGRRGPGRSRKAPRNVLTRMPLHEGSPLGELHRCIREGVKVNVHIRTFKGLRGVCTGFLVAFDKFWNMALTDVDETYRKPVLGKAYERDSSLTLTRLFDRLKLQDSSKKEADSKSAVEDSTLSRYSQTSTWKLASVWGRADTGRGSHKRSRSVPSSLQASAREESRSELSGRTTRTDGSSVGGTFSRATTLSRGQSRKKKRKPKVDYQQVFTRHINQIFIRGENVLLVHLAQ

SEQ ID NO: 919787 - protein, 136 aa, Homo sapiens
MPEPPTHSMGSCVARASPTSTTPCSTAPSPIDHPRAEECERTAQDWQAAPPAAPLRDCKYTNQHPVFSSFVNAPIDTLYLAALAIVHGWLPASQINTDTQRRGPMPGSGNSPQRRWGWPLHMDPWLGPKYHLIPGL

SEQ ID NO: 919788 - protein, 136 aa, Homo sapiens; identical to SEQ ID NO: 919787

SEQ ID NO: 919789 - protein, 94 aa, Homo sapiens
VTGLTGPWVLGRMRMLRSQGRALGGGDQPPVLQFPVSLGTVAAVSVSGGCRREAGLGQREVALWEWKACISLPGPHAPRARRVELKMLGICFTF

SEQ ID NO: 919790 - protein, 99 aa, Homo sapiens
VTGLTGPWVLGRMRMLRSQGRALGGGDQPPVLQFPVSLGTVAAVSVSGGCRREAGLGQREVALWEWKACISLPGPHAPRARRVELKFRDDGLSKDPSSC

SEQ ID NO: 919791 - protein, 192 aa, Homo sapiens
VVPMETFTTGDSKLNTGDGKGLVKSPDVDLKSSGISSKGSARSHLTGYDQYWGLYSSKGSLSNFWTTLMVSEAFCRLSSNNSLLVVLGQQCVATEIKSNSSSYVVVVCAQAGLEFLSSSSPPSLASQSAGITGVSHHAQYLRYLRQHWGFSCTLLQLISLHTQRCQASFHCDTNQVPKGGVPPSTVEPIGST

SEQ ID NO: 919792 - protein, 136 aa, Homo sapiens
MSVYMHITRYNANTLKILNTQALAPPPTFHHIEGLTCLVPAKWKHSHATIGECDSASWSYWGCVLTYGPHENCNPSKCGGCEAFKKLGQEQGLKEEHQFMGATEAFRDFVTYQTGTASKWMTSVKNTTCEVMESIC

SEQ ID NO: 919793 - protein, 116 aa, Homo sapiens
TILSWSKQSQDQTASRKLHTMTPCLESFCQRAKDCKQNIPLPFLIQDWPLSESKPQGQDFWTPQPLQAAAPSHEFQQVALHPARTRLASRPQGGRLMSSREVGLRAPRCSCGKRKR

SEQ ID NO: 919794 - protein, 391 aa, Homo sapiens
VPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKFEKERSWGWANVWVFMQMAWKDVRHEMVVKKGLAPEVADRIGDYVQCHGGVSLVEQMFQDPRLSQNKQAGLEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 919795 - protein, 106 aa, Homo sapiens
MHVVTERLPEGHFHDQRDLFNTLWVPAPISGSRVHLSTTKSQGGWVSAHQSQTAGWHKTTLPTKPQEEEKLRLSFSTQKTLYWTRTLGRHPRLTFRRKENMTNGYS

SEQ ID NO: 919796 - protein, 190 aa, Homo sapiens
HHTLGPVVGLLTSRHIGCGVCCYSPSFAMPPKDDEKKDAGKSAKKDKDPVNKSGGKAKKKKWSKGKVRDKLNNLVLFDKATYDKLCKEVPNYKLITPAVVSERLKIRGSLARAALQELLSKGLIKLVSKHRAQVIYTRNTKGGDAPAAEHWAKNQGTQEVERRCVRREQPAASSGEEGKLYQPGRQSSSL

SEQ ID NO: 919797 - protein, 138 aa, Homo sapiens
HHTLGPVVGLLTSRHIGCGVCCYSPSFAMPPKDDEKKDAGKSAKKDKDPVNKSGGKAKKKKWSKGKVRDKLNNLVLFDKATYDKLCKEVPNYKLITPAVVSERLKIRGSLARAALQELLSKGLIKLVSKHRAHSEHTG

SEQ ID NO: 919798 - protein, 152 aa, Homo sapiens
HHTLGPVVGLLTSRHIGCGVCCYSPSFAMPPKDDEKKDAGKSAKKDKDPVNKSGGKAKKKKWSKGKVRDKLNNLVLFDKATYDKLCKEVPNYKLITPAVVSERLKIRGSLARAALQELLSKGLIKLVSKHRAQVIYTRNTKGGDAPAAGEDA

SEQ ID NO: 919799 - protein, 136 aa, Homo sapiens
MRLGNKGVSTLQMFRRRISTCLEVFLVSASCLQYRGPQIHDTSPGAPQESLAEDLTIPSKTKHCCPGSATVTSLQLSSGHNLQIFLAIQTFTIIRINACRTKEPDTWVQTCPTIYSESLTCQSRALNHKNTKAKQA

SEQ ID NO: 919800 - protein, 136 aa, Homo sapiens; identical to SEQ ID NO: 919799

SEQ ID NO: 919801 - protein, 488 aa, Homo sapiens
MGTRDYSPRQMAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGEEQNQASPAAVPLPSVLKLKLFCVMYVGDLTHKSVSPGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 919802 - protein, 260 aa, Homo sapiens
MKESAFNCVRWYEGKNPKPWVIYCQKTENHQYQEGSSPERSPLTHLQNKRFSLVRRKQFPRIGNLWSPMAASPAPSASLSPFWRNCSPGKPAPSWDPNPAHSPTPQWQGQQPWTSGPLFSYKASAPCLISLRRLAIVANSQSTGILFWFLLTNQEAHSPSPCLTLSKPRNVDRGYAATGLTKAALASPWRAGPGAAGTEWTPTWELLHGKTHAKVDLLDCSVIPLELDGLVAHGLENYLHTNSNRKKDTRLTVIRALSIQ

SEQ ID NO: 919803 - protein, 187 aa, Homo sapiens
SHHRERSRLSLVAAMTTASTSQAAINRQINLELYASCVYLSMSYYFDRDDVALKNFAKYFLHQSHEEREHAEKLMKLQNQGGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 919804 - protein, 149 aa, Homo sapiens [sequence omitted]

SEQ ID NO: 919805 - protein, 103 aa, Homo sapiens
MEDYHFSLHHTGRSVWKWMWTRCCCLRLAGSNSFPIWRDPDITYIALICCLKALLGQEMVLQQQKTMNWALGDRISGCILAIHTLKEDRDREFEYPTNIPTKG

SEQ ID NO: 919806 - protein, 82 aa, Homo sapiens
GRGKRSCPPCSQVPLLTWVMAFSPRLSALWLAALQLAAARISVEMDVDAVLLPEISRKQFFSHLERPRLCWARRWFCSSRRL

SEQ ID NO: 919807 - protein, 439 aa, Homo sapiens
MRPWALAVTRWPPSAPVGQRRFSAGPGSTPGQLWGSPIGASSLWCSPGLEGPLASPPARDERLPSQQPPSRPPHLPVEERRASAPAGGSPRMLHPATQQSPFMVDLHEQVHQGPVPLSYTVTTVTTQGFPLPTGQHIPGCSAQQLPACSVMFSGQHYPLCCLPPPLIQACTMQQLPVPYQAYPHLISSDHYILHPPPPAPPPQPTHMAPLGQFVSLQTQHPRMRLDNDVDLRGDQPSLGSFTYSTSAPGPALSPSVPLHYLPHDPLHQELSFGVPYSHMMPRRLSTQRYRLQQPLPPPPPPPPPPPYYPSFLPYFLSMLPMSPTAMGPTISLDLDVDDVEMENYEALLNLAERLGDAKPRGLTKADIEQLPSYRFNPDSHQSEQTLCVVCFSDFEARQLLRVLPCNHEFHTKCVDKWLKANRTCPICRADASEVPREAE

SEQ ID NO: 919808 - protein, 160 aa, Homo sapiens
RGSCRTSTSDALQGSKRVYCVGQPPWAVQLQFRAYFLSMLPMSPTAMGPTISLDLDVDDVEMENYEALLNLAERLGDAKPRGLTKADIEQLPSYRFNPDSHQSEQTLCVVCFSDFEARQLLRVLPCNHEFHTKCVDKWLKANRTCPICRADASEVPREAE

SEQ ID NO: 919809 - protein, 439 aa, Homo sapiens; identical to SEQ ID NO: 919807

SEQ ID NO: 919810 - protein, 439 aa, Homo sapiens; identical to SEQ ID NO: 919807

SEQ ID NO: 919811 - protein, 439 aa, Homo sapiens; identical to SEQ ID NO: 919807

SEQ ID NO: 919812 - protein, 387 aa, Homo sapiens
MRPWALAVTRWPPSAPVGQRRFSAGPGSTPGQLWGSPIGASSLWCSPGLEGPLASPPARDERLPSQQPPSRPPHLPVEERRASAPAGGSPRMLHPATQQSPFMVDLHEQVHQGPVPLSYTVTTVTTQGFPLPTGQHIPGCSAQQLPACSVMFSGQHYPLCCLPPPLIQACTMQQLPVPYQAYPHLISSDHYILHPPPPAPPPQPTHMAPLGQFVSLQTQHPRMRLDNDVDLRGDQPSLGSFTYSTSAPGPALSPSVPLHYLPHDPLHQELSFGVPYSHMMPRRLSTQRYRLQQPLPPPPPPPPPPPYYPSFLPYFLSMLPMSPTAMGPTISLDLDVDDVEMENYEALLNLAERLGDAKPRGLTKADIEQLPSYRFNPGRRLRGAQGG

SEQ ID NO: 919813 - protein, 142 aa, Homo sapiens
MLLTSSGQRPELLLNVSQEVKDFCNEHYKTLMKEIEKDTKNEKIFHVHGLEELILLKHPYYPKQSTDQCNPYEYTNDILHRNMKKNSKVYIESQSPRIAKAILSKRNKTRGITLPDFKLYYRAIVTKKAWYCHKNKQTNGTE

SEQ ID NO: 919814 - protein, 142 aa, Homo sapiens; identical to SEQ ID NO: 919813

SEQ ID NO: 919815 - protein, 142 aa, Homo sapiens; identical to SEQ ID NO: 919813

SEQ ID NO: 919816 - protein, 142 aa, Homo sapiens; identical to SEQ ID NO: 919813

SEQ ID NO: 919817 - protein, 142 aa, Homo sapiens; identical to SEQ ID NO: 919813

SEQ ID NO: 919818 - protein, 239 aa, Homo sapiens
KESQGREMGWGPFIGFGAASSGIGAAWEPRVGEIKLKEDLWASKSIRAAAAAARRHDDQPKTVRSSCLDKKATGCDPGPCVRILTAQPCTSAVCNENDWHELGRARVGAVSKAVFKEWKENWGKDLGSMGSARFPFVNLYNDFVRMAKPGQEKWGNCKESLQALKGHGVAGSVSLQPLSQEDLGRSQRALGQSSRGPGSGYQQLTRRLSQEMRLSQEDPCQVSERFHFYSNYIVRALAL

SEQ ID NO: 919819 - protein, 156 aa, Homo sapiens
SHSADSLMAPKSVKRKGLPLQGHLLISSPFPKQDETVCRARKKDCCMDNIYRQKKKSDVHKIEVGTETAELVIAQSPANYLRPKTTVSADGRVRIMMRTTMETQTFSCRASPAPSCRPLAFSVAATQQLTRLGSPLETEQRRTIPQRVRLDPKAGP

SEQ ID NO: 919820 - protein, 173 aa, Homo sapiens
MQGQHCCEDPGRQMQSTSPGERPLEEPALQTPYPGVAASRTVREERSYVRPHLRRFVLAAQAQECSHQMSTSTFMYPGPGCLQPPRQREETAGVTLSHSHTGARTPPLIKNGLDCIPGPACKVNDELAIKHPRGCEPCTAPRWPAFLLVGLGSGPGRLVFDTQTRMFPGALRG

SEQ ID NO: 919821 - protein, 394 aa, Homo sapiens
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKG

SEQ ID NO: 919822 - protein, 362 aa, Homo sapiens
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERG

SEQ ID NO: 919823 - protein, 408 aa, Homo sapiens
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKGYSNLETRNTEKSMR

SEQ ID NO: 919824 - protein, 504 aa, Homo sapiens
VCRGQGAPATNPQAPVAAAARVARRVNMAALTTVVVAAAATAVAGAVAGAGAATGTGVGATPAPQQSDGCFSTSGGIRPFHLQNWKQKVNQTKKAEFVRTAEKFKNQVINMEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKG

SEQ ID NO: 919825 - protein, 244 aa, Homo sapiens
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESLQSGKELLKMKSIRHNQSSR

SEQ ID NO: 919826 - protein, 135 aa, Homo sapiens
MGVSSEKSWLLHRRQCSLERNPAPMPGKQSHCFRVTKTPPFSGPAGRRKATCVSSVRQQGSRSRKRASKKTPTLAGRHVPVKIEKEAIQFSLIEKKDVYIIEKKKKPNVDSAQLTRSTCQGTDTAGINCRLHFWS

SEQ ID NO: 919827 - protein, 167 aa, Homo sapiens
SLREPWVGTVSQSAMTAEQGSTAFRPEALRLGKAAKPEKTQGSCLRGSKEGLDFPIRKGKEPGSGHEATLLTFTIPASYWVRVRQIDLQLGWAMVGLQLICDFVQEDEQNKDMLQAVFSGRLLSQEGFSPVRSMDSGVIGLECKSQLYRLPAVQLGQVTLYYSVSTS

SEQ ID NO: 919828 - protein, 156 aa, Homo sapiens
LGKIHALKNIGLSSWVMVGAPPLASLPPCSLISDCCASNERGSVGIGPSKSCAGYNLLEREFPDPLHFLGEAMLHPASAHAWCTAPTVLHPVSLNPQCDEPSTSVGNAEITCLLCRSRWELQTGAVPIRPSYISEFLNSYFRENRPSSLAANMETG

SEQ ID NO: 919829 - protein, 254 aa, Homo sapiens
ASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLEARAVCDRIMAASS

SEQ ID NO: 919830 - protein, 148 aa, Homo sapiens
MPASLGELRGAGAIGLLKILPEIIHPKLVDLWKTRLPELLQPLEGKNISTVLWETMLLQLLKESLWKISDVAWTIQLTQDFKQQMGSYSNNSTEKSLFSGKKSLTKTDVMVIYGAVALHAPKKQLLSRLNQDIISQVLSLHGQCSQPF

SEQ ID NO: 919831 - protein, 461 aa, Homo sapiens
MTLPNPPLEFHQQKELRTDTDTMCFQPTAQPDHPTVKLSGNKYHLQASHWAFQASRGVTPGAPPRALAQSWGPRLRERDGSERVPPLPLLVSVGVVSAAASSAASSPASRSPSAVPSVPGRAEPGCTVPAVGPHHGDQTGGDSRQRPGRSLQVLLVQGYLAKSGWGFPKGKVNKEEAPHDCAAREVFEETGFDIKDYICKDDYIELRINDQLARLYIIPGIPKDTKFNPKTRREIRNIEWFSIEKLPCHRNDMTPKSKLGLAPNKFFMAIPFIRPLRDWLSRRFGDSSDSDNGFSSTGSTPAKPTVEKLSRTKFRHSQQLFPDGSPGDQWVKHRQPLQQKPYNNHSEMSDLLKGKNQSMRGNGRKQYQDSPNQKKRTNGLQPAKQQNSLMKCEKKLHPRKLQDNFETDAVYDLPSSSEDQLLEHAEGQPVACNGHCKFPFSSRAFLSFKFDHNAIMKILDL

SEQ ID NO: 919832 - protein, 313 aa, Homo sapiens
MTLPNPPLEFHQQKELRTDTDTMCFQPTAQPDHPTVKLSGNKYHLQASHWAFQASRGVTPGAPPRALAQSWGPRLRERDGSERVPPLPLLVSVGVVSAAASSAASSPASRSPSAVPSVPGRAEPGCTVPAVGPHHGDQTGGDSRQRPGRSLQVLLVQGYLAKSGWGFPKGKVNKEEAPHDCAAREVFEETGFDIKDYICKDDYIELRINDQLARLYIIPGIPKDTKFNPKTRREIRNIEWFSIEKLPCHRNDMTPKSKLGLAPNKFFMAIPFIRPLRDWLSRRFGDSSDSDNGFSSTGSTPAKPTVEKLRIKV

SEQ ID NO: 919833 - protein, 404 aa, Homo sapiens
MTLPNPPLEFHQQKELRTDTDTMCFQPTAQPDHPTVKLSGNKYHLQASHWAFQASRGVTPGAPPRALAQSWGPRLRERDGSERVPPLPLLVSVGVVSAAASSAASSPASRSPSAVPSVPGRAEPGCTVPAVGPHHGDQTGGDSRQRPGRSLQVLLVQGYLAKSGWGFPKGKVNKEEAPHDCAAREVFEETGFDIKDYICKDDYIELRINDQLARLYIIPGIPKDTKFNPKTRREIRNIEWFSIEKLPCHRNDMTPKSKLGLAPNKFFMAIPFIRPLRDWLSRRFGDSSDSDNGFSSTGSTPAKPTVEKLSRTKFRHSQQLFPDGSPGDQWVKHRQPLQQKPYNNHSEMSDLLKGKNQSMRGNGRKQYQDSPNQKKRTNGLQPAKQQNSLMVRVIAVTLSRQFIL

SEQ ID NO: 919834 - protein, 461 aa, Homo sapiens; identical to SEQ ID NO: 919831

SEQ ID NO: 919835 - protein, 154 aa, Homo sapiens
MTLPNPPLEFHQQKELRTDTDTMCFQPTAQPDHPTVKLSGNKYHLQASHWAFQASRGVTPGAPPRALAQSWGPRLRERDGSERVPPLPLLVSVGVVSAAASSAASSPASRSPSAVPSVPGRAEPGCTVPAVGPHHGDQTGGDSRQRPGRSLQDM

SEQ ID NO: 919836 - protein, 160 aa, Homo sapiens
GWSPRQGPHPSLPSTPLPPFHVNMKADIGSWEPTSSCPQTHGGVVGSWASSNSTEYFPGYLTKLLQNHTTYACDGDYLNLQCPRHSTISVQSAFYGQDYQMCSSQKPASQREDSLTCVAATTFQDGSLNTTSSRGLENAGTHVAEEWKGQEKERGPTCLL

SEQ ID NO: 919837 - protein, 160 aa, Homo sapiens; identical to SEQ ID NO: 919836

SEQ ID NO: 919838 - protein, 364 aa, Homo sapiens
VVVVMMKVVVVTVVVVLVMVEVVVVIDGGSGGDGGADDDGEGGGDEGGGRVVIMVVVVIKIVLVDVVVMVEVVVVIKVVEVVVTVDVVVVIKVVVVVVVEVVVVIKLVLVVVVLVMVVVTVEVVVVMMLVVVLVEVVVTVEVVVVMKVVVVVVVEVVVVMKLVLVVVVLVMVVVTVEVVVVMVVVVVVMKVLVVMMEVVVIMVMVVVMVVMVEVVGCGIGGGSGGNKGGGGGDGGGGGGDDAGGGVGGGSGDGGGSGGSEGGGGDGGGDGGDDGGGVGGGSGDGGGSGGNEGDGGGGGDNDGGDSGSDEVGDGGDDGDSGGGSSEGPYGRENFGFRVVMGGFIKKTSGNREGISGISEIVIIIS

SEQ ID NO: 919839 - protein, 181 aa, Homo sapiens
GAHPPIVAMAAAVSSVVRRVEELGDLAQAHIQQLSEAAGEDDHFLIRASAALEKLKLLCGEEKECSNPSNLLELYTQAILDMTYFEENKLVDEDFPEDSSSQKVKELISFLSEPEILVKENNMHPKHCNLLGDELLECLSWRRGALLYMYCHSLTKRREWLLRKSSLLKKVRRHSLHIFHC

SEQ ID NO: 919840 - protein, 225 aa, Homo sapiens
GAHPPIVAMAAAVSSVVRRVEELGDLAQAHIQQLSEAAGEDDHFLIRASAALEKLKLLCGEEKECSNPSNLLELYTQAILDMTYFEENKLVDEDFPEDSSSQKVKELISFLSEPEILVKENNMHPKHCNLLGDELLECLSWRRGALLYMYCHSLTKRREWLLRKSSLLKKYLLDGISYLLQMLNYRCPIQLNEGVSFQDLDTAKLLSAGIFSDIHLLAMMYSGEM

SEQ ID NO: 919841 - protein, 141 aa, Homo sapiens
LELHEAGMGSHSKFSIATAAAAGEGYNNQWILKPSGERLMENLKVEGSSCHHLNPLINAAISKSDSRHCMPPAIMQCEPYPKGRYAKDKSGFFNDLMTKKWRGVKEQSTFFRCSVGPLWISGLFSQSFWSKIHDESLCMLL

SEQ ID NO: 919842 - protein, 141 aa, Homo sapiens; identical to SEQ ID NO: 919841

SEQ ID NO: 919843 - protein, 158 aa, Homo sapiens
FFTPQRGAGRGEMVQDSNSSLETLSLYLFHLSSIKGWWWPPTVLGNPGGQQRAAVQQEILWNPCTEESAREQEFQSDPLKAISGRARRGTLVSHLEGLERPFAPEFSKVGSTLCPRGRCTGGTDSAAGGQLQFPMSSSRTQPIRALDSLASPYPPSCP

SEQ ID NO: 919844 - protein, 255 aa, Homo sapiens
NVLILMDQSAWDSNATLRQMAIRGLGNTASGAPHKVKKHKQLMLESIIRGLYHLARTEVVCESLKALKKILELLTDRDVSFYFKEIVLQTRTFFEDACRDVLMVCIPFLGLQELYGVLDRLLDQDLPRARDFYRQFCVKLAKKNQEILWILHTHSFTFFTSTWEVIRSAAVKLTESPWWLPLAKSKSHKFTSGITCDLDRDSHMALPRLALCLEKRFSLLLPCEEGRFCFPSRGNCKFPEAFSAMQNSLLSPAAM

SEQ ID NO: 919845 - protein, 280 aa, Homo sapiens
MAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFEWSFKGKGIQLSFLEWLCMDITGNAAHQPSLAGEGQEEQARQGCQQVVHTIQTIPLG

SEQ ID NO: 919846 - protein, 151 aa, Homo sapiens
MVRAHLKKGGEEIFFPDADSPYCCVILLLARENNKEETKDGRSATDLQSPGPDCNKGIKTSGGGKGYKYVEDLAIKELTDTHGSTCGEETSKLLLEPFGGLAACYREAEGGPPWKRTCFTQVFSATVRKPPPPHQPQVLSQPKSKSHWYYH

SEQ ID NO: 919847 - protein, 538 aa, Homo sapiens
MGAVKLESTVEIISCMVLNASCFVFSTTEMDSHGRVLSNRVTLCRFKFCEILTIVRNGLSWGNIGVTGGSMITSLEGLGTDNVFSLHEDNHYRISKSLVKSAEGSTVPLTRVKCLVSMTTPHDIRLHGSSVTPAFVEFDTSLEGLAPHNAPTNNTVTTGLIDGAVVSGIGSGERFFPPPSGLSYSSWFCIEHFSSPPNNHPVRLLTVVRRANSSEQHYVCLAIVLSAKDRSLIVSTKEELLQNYVDDFSEESSFYEILPCCARFRCGELIIEGQWHHLVLVMSKGMLKNSTAALYIDGQLVNTVKLHYVHSTPGGSGSANPPVVSTVYAYIGTPPAQRQIASLVWRLGPTHFLEEVLPSSNVTTIYELGPNYVGSFQAVCMPCKDAKSEGVVPSPVSLVPEEKVSFGLYALSVSSLTVARIRKVYNKLDSKAIAKQLGISSHENATPVKLIHNSAGHLNGSARTIGAALIGYLGVRTFVPKPVATTLQYVGGAAAILGLVAMASDVEGLYAAVKALVCVVKSNPLASKEMERIKGYQN

SEQ ID NO: 919848 - protein, 267 aa, Homo sapiens
GSPLRFGIHILHLTFSLVGTVDSGHETSIIPNSTAFQDLLCDFEVWLHAPYELHLSLFEHFIELLTESSEASKNAKLMREFQLIPKLLLTLRDMSLSQPTIAAISNVLSFLLQGFPSSNDLLSKLSKNYVVNFLLAYLLGRFNVFIFILGTEEEFGGLVSANLILLRNRLLDILLKLIYTSKEKTSINLQACEELVKTLGFDWIMMFMEEHLHSTTVTAAMRILVVLLSNQSILIKFKEGLSGGGWLEQTDSVLTNKIGTVLGMGLF

SEQ ID NO: 919849 - protein, 153 aa, Homo sapiens
MAQNKYYDLLNQRGRVPTSRVSNLVGLEWSHNMCISDKFQSDADTMGWEPYFGEPLLKGHLVFIFHWLAQGTCCVSLIKCHCGECPLLNTAVSLHTVERSQTQALHAPRDSWRTYAMCLSSFQESTSEEPFNEFPREILKESTVDILTVNRLQ

SEQ ID NO: 919850 - protein, 416 aa, Homo sapiens
CHGEEHPAEFPVTRNIPQEEMEAERLRLLEEEAKLKKVARMGFNASSMLRKSQLGFLNVTSYSRLANELRVSCMERKKVQIRSLDPSSLASDRFNFILASTNSDQLFVVNQVEVEGSKYGIISLRTLKIPSFHVYVLRNLYVPNRKVKSLCWASLNQLDSHVLLCFEGITDAPSCAVLLPASRFLSVHTRVNQPGMLCSFQIPEAWSCAWSLNTRAYHCFSAGLSQQVLLTSVATGHQQSFDTSSDVLAQQFASTAPLLFNGCRSGEIFAIDLRCRNRGKGWRATRLFHDSAVTSVQILQEEQCLMASDMTGKIKLWDLRATKCVRQYEGHVNESAYLPLHVHEEEGIVVAVGQDCYTRIWSLHDAHLLRTIPSPYSASEDDIPSVAFASRLGGIRGAAPGLLMAVRQDLYCFPFS

SEQ ID NO: 919851 - protein, 1225 aa, Homo sapiens
IDSGEGCVVKPIPVKGDGSEMNHLAAESPGEVQASAASPASKGRRSPSPGNSPSGRTVKSESPGVRRKRVSPVPFQSGRITPPRRAPSPDGFSPYSPEETNRRVNKVMRARLYLLQQIGPNSFLIGGDSPDNKYRVFIGPQNCSCARGTFCIHLLFVMLRVFQLEPSDPMLWRKTLKNFEVESLFQKYHSRRSSRIKAPSRNTIQKFVSRMSNSHTLSSSSTSTSSSENRAAQQQTVQQQPLAGSRRNQESNFNLTHYGTQQIPPAYKDLAEPWIQVFGMELVGCLFSRNWNVREMALRRLSHDVSGALLLANGESTGNSGGSSGSSPSGGATSGSSQTSISGDVVEACCSVLSMVCADPVYKVYVAALKTLRAMLVYTPCHSLAERIKLQRLLQPVVDTILVKCADANSRTSQLSISTLLELCKGQAGELAVGREILKAGSIGIGGVDYVLNCILGNQTESNNWQELLGRLCLIDRLLLEFPAEFYPHIVSTDVSQAEPVEIRYKKLLSLLTFALQSINNSHSMVGKLSRRIYLSSARMVTTVPHVFSKLLEMLSVSSSTHFTRMRRRLMAIADEVEIAEAIQLGVEDTLDGQQDSFLQASVPNNYLETTENSSPECTIHLEKTGKGLCATKLSASSEDISERLASISVGPSSSTTTTTTTEQPKPMVQTKGRPHSQCLNSSPLSHHSQLMFPALSTPSSSTPSVPAGTATDVSKHRLQGFIPCRIPSASPQTQRKFSLQFHRNCPENKDSDKLSPVFTQSRPLPSSNIHRPKPSRPTPGNTSKQGDPSKNSMTLDLNSSSKCDDSFGCSSNSSNAVIPSDETVFTPVEEKCRLDVNTELNSSIEDLLEASMPSSDTTVTFKSEVAVLSPEKAENDDTYKDDVNHNQKCKEKMEAEEEEALAIAMAMSASQDALPIVPQLQVENGEDIIIIQQDTPETLPGHTKAKQPYREDTEWLKGQQIGLGAFSSCYQAQDVGTGTLMAVKQVTYVRNTSSEQEEVVEALREEIRMMSHLNHPNIIRMLGATCEKSNYNLFIEWMAGGSVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 919852 - protein, 829 aa, Homo sapiens
MVLEQYVVVANYQKQESSEISLSVGQVVDIIEKNESVSWRYWSLPRPVGRRRTLGDLYAISWRQGAYLGVFFPLPEQITLGVGAVLALWDTLPECSDEQPALPSPGPPGLLWEGRSWGQLSGRRLPFVPTEEKYTVIYPYTARDQDEMNLERGAVVEVIQKNLEGWWKIRYQPLPPTVAGYQGKEGWAPASYLKKNSGEPLPPKPGPGSPSHPGALDLDGVSRQQNAVGREKELLSSQRDGRFEGRPVPDGDAKQRSPKMRQRPPPRRDMTIPRGLNLPKPPIPPQVEEEYYTIAEFQTTIPDGISFQAGLKVEVIEKNLSGWWYIQIEDKEGWAPATFIDKYKKTSNASRPNFLAPLPHEVTQLRLGEAAALENNTGSEATGPSRPLPDAPHGVMDSGLPWSKDWKGSKDVLRKASSDMSASAGYEEISDPDMEEKPSLPPRKESIIKSEGELLERERERQRTEQLRGPTPKPPGVILPMMPAKHIPPARDSRRPEPKPDKSRLFQLKNDMGLECGHKVLAKEVKKPNLRPISKSKTDLPEEKPDATPQNPFLKSRPQVRPKPAPSPKTEPPQGEDQVDICNLRSKLRPAKSQDKSLLDGEGPQAVGGQDVAFSRSFLPGEGPGRAQDRTGKQDGLSPKEISCRAPPRPAKTTDPVSKSVPVPLQEAPQQRPVVPPRRPPPPKKTSSSSRPLPEVRGPQCEGHESRAAPTPGRALLVPPKAKPFLSNSLGGQDDTRGKGSLGPWGTGKIGENREKAAAASVPNADGLKDSLYVAVADFEGDKDTSSFQEGTVFEVREKNSSGWWFCQVLSGAPSWEGWIPSNYLRKKP

SEQ ID NO: 919853 - protein, 829 aa, Homo sapiens; identical to SEQ ID NO: 919852

SEQ ID NO: 919854 - protein, 829 aa, Homo sapiens; identical to SEQ ID NO: 919852

SEQ ID NO: 919855 - protein, 145 aa, Homo sapiens
RSMSFSSMIIIHTYFMCMAALFSIIVFDCIDQEVAFIVRHNHLGVLCPQAFNHILCHEASGVSCVPKPSTTSSAMKPQVSVSSRKGSASSQALSGRRLQRPIQDGSGKKHRNLRQGIAAPAAGQAQQKVLPIIGTKKGISASEGC

SEQ ID NO: 919856 - protein, 145 aa, Homo sapiens; identical to SEQ ID NO: 919855

SEQ ID NO: 919857 - protein, 373 aa, Homo sapiens
AESGNRILSVVQSYFVYWARIESSVVSQQTHSSAHSDDRMEPRLLMPNLHQRLGDVEGAAPAPRTPITLPQQHTHVFAVALPGAAEEDNLDPVPASIWVTKFPGDAETLSQPSSHTATEGSINQQPSGDSNPTLEPSLEVHRLERLVALKRVSSESFASSLSTHHRTQDDPSFDSLETCLSSDGGEQDKTKASNRTVTQPPLSTVQLTYPQCLWSSETFTGNGVRASNPIPVLQTSGTSGLPAAGDQSEASRASASFLPQSKHKELRAGKGNGEGGVGYPRQTNPRPDIGLEGAQAPLGIQLRTPQLGILLCLSATLGMALAAGLRYLHTQYCHQQTEVSFSEPASDAVARSNSETQGSSKQGLKTMNNAFFR

SEQ ID NO: 919858 - protein, 128 aa, Homo sapiens
PGPPADAAMVTTPAVRAGAQAGAPANRALVAGKFDSTNHRPRRGKSPAGASEAEPNGAAARRRKGWRSRFVYAPLRRAGGGEALLRKVSEAGGSSEDNAALGHTAAEDGTPIESSCWSGARISTVAVS

SEQ ID NO: 919859 - protein, 132 aa, Homo sapiens
PGPPADAAMVTTPAVRAGAQAGAPANRALVAGKFDSTNHRPRRGKSPAGASEAEPNGAAARRRKGWRSRFVYAPLRRAGGGEALLRKVSEAGGSSEDNAALGHTAAEDGTPIESSCWSGARISTSRMLKCEA

SEQ ID NO: 919860 - protein, 151 aa, Homo sapiens
PGPPADAAMVTTPAVRAGAQAGAPANRALVAGKFDSTNHRPRRGKSPAGASEAEPNGAAARRRKGWRSRFVYAPLRRAGGGEALLRKVSEAGGSSEDNAALGHTAAEDGTPIESSCWSGARISTMKSHSVPPGWSCSELRSHHSIPAWATE

SEQ ID NO: 919861 - protein, 140 aa, Homo sapiens
MVLHRRSSFTETIGALGTCVNVVTPSYCFKEQETNAVRTAETTAYSGIPQMGLIRRLIWGQLFNNLDSQACESKKGGYPSDRVARFWGTRERQVRPRPFKTLESVDVANQCLAGPKNPTTSGSRARALVRALTRNFLLEC

SEQ ID NO: 919862 - protein, 140 aa, Homo sapiens; identical to SEQ ID NO: 919861

SEQ ID NO: 919863 - protein, 140 aa, Homo sapiens
MCCFLNKYGSKLRISLNKVDYLHFLKALPPVVWQLAEKRKATRSHLKHGHHLSKEQKYNDSVLYGCIDKGSEQETLVLSDGRGNRSVLPFTSPAFRLAESIRQDRPSDSPPPFHFCQVYIRPNYFSLGCQSCFLDRPDHP

SEQ ID NO: 919864 - protein, 158 aa, Homo sapiens
MAEERSFEAHEKLNQPLTERCMAHGPVPEARYLKARYCLLLEAGLGATCHSWAGVELSDIFETLSWAGWDSWGSSPHSLPSSDRSTRAHSCSDGRAPWKQQERASPKERVFLQASACIACADVPLAAIVIHTAKPRLNVGRGYLQTEGVNHWWPLLQK

SEQ ID NO: 919865 - protein, 289 aa, Homo sapiens
MYKKSNKQSLIHYVNVETGEKTYVCVECGKSFLKKSQIIIHQRIHTGEKPYDCGACGKAFSEKSHLIAHQRTHTGEKPYDCSECGKGFSQKSSLIIHQRVHTGEKPYECSECEKAFSQKSPLIIHQRIHTGEKPYECRVWESLFPESQLIIHHRAHTGEKPFHTGEKPYKCAQCEEAFSRKSELIIHQIIHTGEKPYECTECGKTFSRKSQLIIHQRTHTGEKPYKCTKCGKSFCQQSHLIGHQRIHTGEQPYKSDLVVHQIIHTGEKPDRCTKETLIYKYSMPGKDGT

SEQ ID NO: 919866 - protein, 147 aa, Homo sapiens
MLTDARGERHSTMTYFKDEFVNCQIKGERLPGWYPTHLPPYCNGPELQTLVTYVPWTVCKNCVPNAQSTQSPLWFTGTTTSTITITRNKQIQKLANNIPPSSPLTTPYLSTFTVDSMFSLKSFLLPHHSYHCCENSHVQHSREVTSG

SEQ ID NO: 919867 - protein, 189 aa, Homo sapiens
MHRVSRLIGVAFLGIGWVDICVVPNTLEPTGNNAQTWPSQLLQGPLLPLGSPSIFPGFMGAVISYSLLEREQSTLFLFGHQEEGCLYLDGLAWQEALGTLVDPCLFRFADGTPPSSYVIFPGFKLFFGCKCTFGRRTVGSPGTESKPAGTEYAGSLDRVEFLGVLVFKGAAAILQLGLEYMMSSCYLSV

SEQ ID NO: 919868 - protein, 524 aa, Homo sapiens
VSKQLYAMKSADSGSASALPDGLVDCLDPDCCLQSACQNSLLCRGSRDPLDIIQQGQTDWPAVKSFYDRIKLLAGKDSTHIIPGENPFNSRTPRNAKVSASKNRADFDKIVTKDGLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRHPVGNREPWEKTEANQPSPGTVSPPNLHSCCLLCLKYLLYLIYHITSTCKAQCQGPLFHVA

SEQ ID NO: 919869 - protein, 523 aa, Homo sapiens
EDPLFKAHPPVLIDKDYEGDGLVDCLDPDCCLQSACQNSLLCRGSRDPLDIIQQGQTDWPAVKSFYDRIKLLAGKDSTHIIPGENPFNSRTPRNAKVSASKNRADFDKIVTKDGLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRHPVGNREPWEKTEANQPSPGTVSPPNLHSCCLLCLKYLLYLIYHITSTCKAQCQGPLFHVA

SEQ ID NO: 919870 - protein, 134 aa, Homo sapiens
MASGKDTCPTLPKLTNNCSDESLYKSANKYEEIHLPRFSLKQGMIPRRYVMPWKENMIFRNVNLKQAEVCGIHTGPLEDSLFLNHSERLCHGEDRKVVFQKGPPEIKIADMPLHSPLSRYQSTVISHGFRRRLV

SEQ ID NO: 919871 - protein, 171 aa, Homo sapiens
SVRLYELIMKTYTCFSGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHNHGWLPPEWIVFWYLRCKPGNHWNNQPCT

SEQ ID NO: 919872 - protein, 175 aa, Homo sapiens
SVRLYELIMKTYTCFSGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQLKETRINGSDPEGSPKFGIL

SEQ ID NO: 919873 - protein, 256 aa, Homo sapiens
MDEGMEISSEGNSLIKAVHQSRLRLTRLLLEGGAYINESNDRGETPLMIACKTKHVDHQSVSKAKMVKYLLENNADPNIQDKSGKTALMHACLEKAGPEVVSLLLKSGADLSLQDHSSYSALVYAINSEDTETLKVLLSACKAKGKEVIIITTAKSPCGKHTTKQYLNMPPVDIDGCHSPATCTTPSEIDIKTASSPLSHSSETELTLFGFKDLELAGSNDDTWDPGSPVRKPALAPKGPKLPHAPPWVKNVCNSS

SEQ ID NO: 919874 - protein, 162 aa, Homo sapiens
MCRTLWLWNLGPNTGSGWMGTSSICDPYSDASHRNLLSTAKPFPVHSIGTNWKETTRFRNDISTGLELNPGVSECFQLVSFWVSVVERQHSAKTWNQPKCPTTIDWIEKMWHIHTMEYYAAIKNDEFMSFVGTWMKLETIILSKLSQGQKTKHRMFSLIGGN

SEQ ID NO: 919875 - protein, 146 aa, Homo sapiens
QVCPAPDLPLPMAFQFPELLQPNHQIQSIKIHLAFIYSLIHPSSPTYAPSPLHVTHSAPVRLLEPGNIFQGPYLLPQEAFQELAFIALPTSDQIVWLQGPYLLPQEAFQELAFIALPTSDQIDVAVDFKQEEWQQLDLAQRVLYMM

SEQ ID NO: 919876 - protein, 146 aa, Homo sapiens
AKEVSKEMCALHPTIGKCSHCLPSDETFLICSVCQEGTMRGLGANSLSLATQNVVWGLKKTSTSSSAEGAGLDLGQPPQKLAKPRTHHFTLHSEAQGASAWHGGRRKKPVCVLRPCCDFGSCLSAGASVPAQLDLGGSIAWRREIK

SEQ ID NO: 919877 - protein, 171 aa, Homo sapiens
RKLALPCQEPPAAGGMNESCKMGLSHSHAPRLRPLYGAVGGGAGNSLDGFQTEGDIPAFILEHTLGTETAGQFGARNQVIKKKAYEPGRRRRGGKCRQFTAASESDELPLRGSVIMGKDEQALLSCMFFSSAGFLHAIPVKQELSRMCLTITNGHNGKTFVNGISALIKEA

SEQ ID NO: 919878 - protein, 170 aa, Homo sapiens
MADAPPAVKLQHNRLISDCCASSEQDSMGMGCAKPGMGGYLLVYRLLRPWEKSSIWSGVYRFSSQIRNPPGKGEESPPLRASAMFLSSGAAPSSKSPAYDSPLGQCSLVNHLLGLLTASLLISILNNGSQTLAGISHLGGWFVKAQIADPTLRVSDSAGLGWGLLMCISN

SEQ ID NO: 919879 - protein, 239 aa, Homo sapiens
FQMDVHVSDFALPQCRLRTGMRGAFGKPQGTVARVHIGQVIMSICTKLQNKEHVIEALHRAKFKFPGRQKIHISKKWGFIKFNANEFEDMVAEKRLILDGCGVKYIPSRGLLDKWRALHSRGLPLLMSSRNPGQRAELSFAAATGATPIAGHFTPGTFINQVQAAFWELRLLVDTDPRVATGLSQQHLMITYLPYLCGTQVLLCAVWIFPSHATRELTRGSDVGNAGSGSSAHAWHCLL

SEQ ID NO: 919880 - protein, 166 aa, Homo sapiens
QQQVKTSGCGTCGLSYCQQGGRAEDMAFVRLILELCKELLDSTVPNRQLSPDGQRAAGLVDGSSKVDHSTIDLVKLYPQHWQVTLIPSLQSLAWPDLAGSETARGEAVLGEGPPSPSFLPTGRSHTGSHHLPQGVAWPLLFLCGNWDANGWWEAPKWDEDGWWEAP

SEQ ID NO: 919881 - protein, 166 aa, Homo sapiens; identical to SEQ ID NO: 919880

SEQ ID NO: 919882 - protein, 184 aa, Homo sapiens
MLSYWKTSPRWLGGPVGPALEAVPLEQMAVKLWRRDKLGLTAAPFGTRLASTSLQEATHPATAFLSRRRPPPHSFRPQISPETSPEGGTAPSPRPVTSAKLAAGLSPSSAIRRGLKREARSVAVLQRSGGASLLGPPPRGILYQNNTPGARVRAAHSPPPVPARSHSAGPVTQPGDPALSLNST

SEQ ID NO: 919883 - protein, 145 aa, Homo sapiens
THMLTHTLAHPHTHSLHTHKVTYTHIPTHTYSLTHSYTHIHMYLTQPTLSHTFTHSITHTLTGIFSHFTHTKKPLVLKQLDSLRIDVSLTQSYFKRQVLSEGMTLSFNFINSWAQLAIKLSARVFLSSNDFAAETLIHRRGAQRE

SEQ ID NO: 919884 - protein, 112 aa, Homo sapiens
MPHLCRSHANICPVLRHPPGSQLLLLKIQISSAPSEAEVTVSGRHWSRLGGKHSGQQGGGVAHVAVLDDNIPTLPSDTSQTLVPQDPSDSTEERCRAACHQVTNSFFSSYIH

SEQ ID NO: 919885 - protein, 313 aa, Homo sapiens
MNSVFPPTSIVARESPFGHLAAWEETFTCGIPGYSKWRIHRCDYDGCNKVYAKSSHLKAHRRRHTEKPYKCTWEGCTWTFARSDELKRHLGKHTGIKPLQCPDCNRRNQPLKKEKPKWKSDYPMTDGQLRSKRDEFWDTAPAFEGRKEIWDALKAAAHAFESNDHELAQAIIDGANITLPHGALTECYDELGNRYQLPVYCLAPPINMIEEKSDIETLDIPEPPPNSGYECQLRLRLSTGKDLKLVVRSTDTVFHMKRRLHAAEGVEPGSQRWFFSGRPLTDKMKFEELKIPKDYVVQVIVSQPVQNPTPVEN

SEQ ID NO: 919886 - protein, 148 aa, Homo sapiens [sequence omitted]

SEQ ID NO: 919887 - protein, 261 aa, Homo sapiens
APEEAAAAAAAGPDERPEVADEAPGAPMGGCVGAQHDSSGSLNENSEGTGVALGRNQPLKKEKPKWKSDYPMTDGQLRSKRDEFWDTAPAFEGRKEIWDALKAAAHAFESNDHELAQAIIDGANITLPHGALTECYDELGNRYQLPVYCLAPPINMIEEKSDIETLDIPEPPPNSGYECQLRLRLSTGKDLKLVVRSTDTVFHMKRRLHAAEGVEPGSQRWFFSGRPLTDKMKFEELKIPKDYVVQVIVSQPVQNPTPVEN

SEQ ID NO: 919888 - protein, 261 aa, Homo sapiens; identical to SEQ ID NO: 919887

SEQ ID NO: 919889 - protein, 261 aa, Homo sapiens; identical to SEQ ID NO: 919887

SEQ ID NO: 919890 - protein, 202 aa, Homo sapiens
MHSLRIKFLFISSLSEGALTECYDELGNRYQLPVYCLAPPINMIEEKSDIETLDIPEPPPNSGYECQLRLRLSTGKDLKLVVRSTDTVFHMKRRLHAAEGVEPGSQRWFFSGRPLTDKMKFEELKIPKDYVVQVIVSQPKIKITGRVRWLTPVIPALGEAEAGGSRGQEIKTILANTVKSHLYYFFHVRRILMNSTLSFLKF

SEQ ID NO: 919891 - protein, 261 aa, Homo sapiens; identical to SEQ ID NO: 919887

SEQ ID NO: 919892 - protein, 261 aa, Homo sapiens; identical to SEQ ID NO: 919887

SEQ ID NO: 919893 - protein, 261 aa, Homo sapiens; identical to SEQ ID NO: 919887

SEQ ID NO: 919894 - protein, 140 aa, Homo sapiens
MAWDWRAAPPAAPVRDPLGEASWAPESGGALENLYLRDYKRTNQCPVKTDHSALPISRTWVGPDKRIKAGCPSQQWQPARVPFDTLWKMVKLRFRMMNNTPKSNSQVSERGLRPQVCPGRAKSLIRLLHCCYQEWSLGFS

SEQ ID NO: 919895 - protein, 518 aa, Homo sapiens
YDLQQPAPGGSEVAPSMLEITIQNAKAYLLKTSSNSGFNLYDHLSNMLTKILNERPENAVDIFENISQDVKMAHFSKKFDALQNENELLPTYEIAEKQKALFLQGHLEGVDQELEDEIAENALPNVMESAFYFEQAGVGLGTDETYRIFLALKQLTDTHPIQRCRFWGKILGLEMNYIVAEVEFREGEDEEEVEEEDVAEERDNGESEAHEDEEDELPKSFYKAPQAIPKEESRTGANKYVYFVCNEPGRPWVKLPPVIPAQIVIARKIKKFFTGRLDAPIISYPPFPGNESNYLRAQIARISAGTHVSPLGFYQFGEEEGEEEEEAEGGRNSFEENPDFEGIQVIDLVESLSNWVHHVQHILSQGRCNWFNSIQKNEEEEEEEDEEKDDSDYIEQEVGLPLLTPISEDLGYFTNANIEEHDEPKGPASLTATSRKDSSALYSKSDVPGWGHKYSPDNYTPPVPPPVYQEYPSGPEITEMDDPSVEEEQAFRAAQEAVLLAAENEESEEDEDEEDDYD

SEQ ID NO: 919896 - protein, 318 aa, Homo sapiens
MALPIIVKWGGQEYSVTTLSEDDTVLDLKQFLKTLTGVLPERQKLLGLKVKGKPAENDVKLGALKLKPNTKIMMMGTREESLEDVLGPPPDNDDVVNDFDIEDEVVEVENREENLLKISRRVKEYKVEILNPPREGKKLLVLDVDYTLFDHRSCAETGVELMRPYLHEFLTSAYEDYDIVIWSATNMKWIEAKMKELGVSTNANYKITFMLDSAAMITVHTPRRGLIDVKPLGVIWGKFSEFYSKKNTIMFDDIGRNFLMNPQNGLKIRPFMKAHLNRDKDKELLKLTQYLKEIAKLDDFLDLNHKYWERYLSKKQGQ

SEQ ID NO: 919897 - protein, 318 aa, Homo sapiens; identical to SEQ ID NO: 919896

SEQ ID NO: 919898 - protein, 146 aa, Homo sapiens
MYCIIIPRVLAATNMKWIEAKMKELGVSTNANYKITFMLDSAAMITVHTPRRGLIDVKPLGVIWGKFSEFYSKKNTIMFDDIGRNFLMNPQNGLKIRPFMKAHLNRDKDKELLKLTQYLKEIAKLDDFLDLNHKYWERYLSKKQGQ

SEQ ID NO: 919899 - protein, 318 aa, Homo sapiens; identical to SEQ ID NO: 919896

SEQ ID NO: 919900 - protein, 227 aa, Homo sapiens
PPHLKSPMHLNSVSMHVIVVQGLLVGGTFVGMDSGCPGFEATAPTVTLARAAPTVTLARAAPTVTLARAAPTVTLARAAPTVTLARAAPTVTLARAAPTVTLARAAPTVTLARAAPAVGEGEWWLRHLGSVKAKIDVNVASVANKYFAYDTIYAITMGGIKRSQSQWEGSRGANHNGRDQEEPITMGGIKRSQSQWEGSRGANHNGWDQEEPITMRGIKRSQSQWAG

SEQ ID NO: 919901 - protein, 139 aa, Homo sapiens
ERNREVRMGNRFLEGKLGLKDDYFIFGHTLRFLSGAVFNNGIMCAHNSVDCILSLALLMVEEWLSTVVKVLCFLFHGLSSNIEDYNLTKDLSGDTDPNHISTNKTYENEVKIELGQVNLVLNCCTSLPDVCSLSNIPRV

SEQ ID NO: 919902 - protein, 149 aa, Homo sapiens
MPMVMADQHRSVSELLSNSKFDVNYAFGRVKRSLLHIAANCGSVECLVLLLKKGANPNYQDISGCTPLHLAARNGQKKCMSKLLEYSADVNICNNEGLTAIHWLAVNGRTELLHDLVQHVSDVDVEDAMGQTALHVACQNGHKTSSSEL

SEQ ID NO: 919903 - protein, 183 aa, Homo sapiens
MERAMEQLNRLTRSLRRARTVELPEDNETAVYTLMPMVMADQHRSVSELLSNSKFDVNYAFGRVKRSLLHIAANCGSVECLVLLLKKGANPNYQDISGCTPLHLAARNGQKKCMSKLLEYSADVNICNNEGLTAIHWLAVNGRTELLHDLVQHVSDVDVEDAMGQTALHVACQNGHKTSSSEL

SEQ ID NO: 919904 - protein, 485 aa, Homo sapiens
MSIEELCSDFKKYLFPNSFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAIEMNINKMWIASDNWSTATKITTIPNVKKIGKVVGFAFRRGNISSFHSFLQNLHLLPSDSHKLLHEYAMHLSACAYVKDTDLSQCIFNHSQRTLAYKANKAIERNFVMRNDFLWDYAEPGLIHSIQLAVFALGYAIRDLCQARDCQNPNAFQPWELLGVLKNVTFTDGWNSFHFDAHGDLNTGYDVVLWKEINGHMTVTKMAEYDLQNDVFIIPDQETKNEFRNLKPKDFAPAISFAYNNFL

SEQ ID NO: 919905 - protein, 258 aa, Homo sapiens
MSIEELCSDFKKYLFPNSFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAGCGSPFFFTYATSTI

SEQ ID NO: 919906 - protein, 350 aa, Homo sapiens
AYIKIGETSNKQSNDASSWERWLTSVIPALWEAKVGPVSLLAIGVLTVHCMVILLNCAQHLSQRLQKTFVNYGEATMYGLETCPNTWLRAHAVWGRYTVSFLLVITQLGFCSVYFMFMADNLQQQPHCLSLCFMSDGGKSHVTSNICQPREILTLTPILDIRFYMLIILPFLILLVFIQNLKGIPYPSNLPLMANWKTFLLFFGTAIFTFEGVGMVLPLKNQMKHPQQFSFVLYLGMSIVIILYILLGTLGYMKFGSDTQASITLNLPNCWYVLPTSGEIGRDTGTVLVVIAESTAKLSHEAGNPSLEVTYVSPAHTASVKASHMAAPHSKGAGKCNSAMCLEVFGEQHK

SEQ ID NO: 919907 - protein, 185 aa, Homo sapiens
MRVVAVMKKMCQNCDAESGAPTSPSLLEEDDPGPLSSQQQATSSRDKKPLSSLHLSHRAQVALEYLPFFCTYGCLLEEEGLVLQPKTPLQEDSELLSGFFPYYRSEEESLPSLALPGWSHRGSQDLPTEKEARAGCFCRTTVRDECSTLTGPWTGPSQGCCGPWSKVSLVGSTDTAGRLSCSSPA

SEQ ID NO: 919908 - protein, 533 aa, Homo sapiens
MGRTVFGAWRCLLDATVAGGQTRLQASDRYRDLAGGTGRSAKEQVLRKRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEEAASSAQEHLRDPLTSLSHTELEAAEVILEHAHRGEQTTSQVCVLEWGAEGVAGKSGLEKEVQRLTSRAARDYKIQNHGHRVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPDLSLPESSQDSDNPCGAEPTAFLAQALYSYTGQSAEELSFPEGALIRLLPRAQDGVDDGFWRGEFGGRVGVFPSLLVEELLGPPGPPELSDPEQMLPSPSPPSFSPPAPTSVLDGPPAPVLPGAPTYK

SEQ ID NO: 919909 - protein, 406 aa, Homo sapiens
ISIVEARCVDPVADRLAGAEMQPPPRKVKPAQEVKLRFLEQLSILQTWQQREADLLEDIRSYSKQRAAIEREYGQALQKLAGPFLKREGHRSGEMDSRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKALVSELSEHLRDPLTSLSHTELEAAEVILEHAHRGEQTTSQVSWEQDLKLFLQEPGVFSPTPPQQFQPAGTDQVCVLEWGAEGVAGKSGLEKEVQRLTSRAARDYKIQNHGHRVRWGGTGVMCTFLSQQEELREGILESLRVSWSYRGEGKVF

SEQ ID NO: 919910 - protein, 406 aa, Homo sapiens; identical to SEQ ID NO: 919909

SEQ ID NO: 919911 - protein, 397 aa, Homo sapiens
EFTQGWGFMILQAPVYNEQKPAQEVKLRFLEQLSILQTWQQREADLLEDIRSYSKQRAAIEREYGQALQKLAGPFLKREGHRSGEMDSRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKALVSELSEHLRDPLTSLSHTELEAAEVILEHAHRGEQTTSQVSWEQDLKLFLQEPGVFSPTPPQQFQPAGTDQVCVLEWGAEGVAGKSGLEKEVQRLTSRAARDYKIQNHGHRVRWGGTGVMCTFLSQQEELREGILESLRVSWSYRGEGKVF

SEQ ID NO: 919912 - protein, 406 aa, Homo sapiens; identical to SEQ ID NO: 919909

SEQ ID NO: 919913 - protein, 705 aa, Homo sapiens
GFLQFRSPVADRLAGAEMQPPPRKVKPAQEVKLRFLEQLSILQTWQQREADLLEDIRSYSKQRAAIEREYGQALQKLAGPFLKREGHRSGEMDSRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKALVSELSEHLRDPLTSLSHTELEAAEVILEHAHRGEQTTSQVSWEQDLKLFLQEPGVFSPTPPQQFQPAGTDQVCVLEWGAEGVAGKSGLEKEVQRLTSRAARDYKIQNHGHRVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPDLSLPESSQDSDNPCGAEPTAFLAQALYSYTGQSAEELSFPEGALIRLLPRAQDGVDDGFWRGEFGGRVGVFPSLLVEELLGPPGPPELSDPEQMLPSPSPPSFSPPAPTSVLDGPPAPVLPGDKALDFPGFLDMMAPRLRPMRPPPPPPAKAPDPGHPDPLT

SEQ ID NO: 919914 - protein, 406 aa, Homo sapiens; identical to SEQ ID NO: 919909

SEQ ID NO: 919915 - protein, 412 aa, Homo sapiens
GPQMMYEAGPGVKYTSGGSALELNCEMHAARRKEKPAQEVKLRFLEQLSILQTWQQREADLLEDIRSYSKQRAAIEREYGQALQKLAGPFLKREGHRSGEMDSRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKALVSELSEHLRDPLTSLSHTELEAAEVILEHAHRGEQTTSQVSWEQDLKLFLQEPGVFSPTPPQQFQPAGTDQVCVLEWGAEGVAGKSGLEKEVQRLTSRAARDYKIQNHGHRVRWGGTGVMCTFLSQQEELREGILESLRVSWSYRGEGKVF

SEQ ID NO: 919916 - protein, 344 aa, Homo sapiens
MYVMQLAKYQSHSKSCPTVFPPTPVLCLPNQVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPDLSLPESSQDSDNPCGAEPTAFLAQALYSYTGQSAEELSFPEGALIRLLPRAQDGVDDGFWRGEFGGRVGVFPSLLVEELLGPPGPPELSDPEQMLPSPSPPSFSPPAPTSVLDGPPAPVLPGGEWKELGALGG

SEQ ID NO: 919917 - protein, 162 aa, Homo sapiens
VVGRILTRGAGFMNGKSFDPKLKIIHTGDKPFKGDECHKAFNQFSTLTNCKRIHTGEKPYKRKECGKGFNQFSHLTKHKKTHTGEKPYKCKECGKGFNQFSHLTKHKKTHTGKKSYKCEECGKAFNQFANLIKHKRIHTGEKSYNMKNDEKLLPSPQTLLNT

SEQ ID NO: 919918 - protein, 148 aa, Homo sapiens
NWVTAEVGTEEDRKMWESLELPRDLLDNFNQNADSDMDNEVQAEMASDGDEELIGNGKGAGSKPWWLPCGVGPVVRRRQELSFGTVCQFQRMYGNTWMSRQKSVAGWSCERGPPSSRAQKGRSIDSLHHAPGKTIGIQQQPVKAVQGF

SEQ ID NO: 919919 - protein, 148 aa, Homo sapiens; identical to SEQ ID NO: 919918

SEQ ID NO: 919920 - protein, 240 aa, Homo sapiens
MQNNSPSVLCLYCLLFSKMSHIWDHTVLPLENKMKNARHFPAILSLGMSIVTSLYIGMAALGYLRFGDDIKASISLNLPNCWLYQSVKLLYIAGILCTYALQFYVPAEIIIPFAISRVSTRWALPLDLSIRLVMVCLTCLLAILIPRLDLVISLVGSVSGTALALIIPPLLEVTTFYSEGMSPLTIFKDALISILGFVGFVVGTYQALDELLKSEDSHPFSNSTTFINQPTNFQTRVKPS

SEQ ID NO: 919921 - protein, 122 aa, Homo sapiens
MLIEETVVEAVNSTTNNCYSNETVILTPTMDSRLYMLSFLPFLVLLVLIRNLRILTIFSMLANISMLVSLVIIIQYITQEIPDPSRLPLVASWKTYPLFFGTAIFSFESIGVVRFELRWPYP

SEQ ID NO: 919922 - protein, 156 aa, Homo sapiens
MDSRLYMLSFLPFLVLLVLIRNLRILTIFSMLANISMLVSLVIIIQYITQEIPDPSRLPLVASWKTYPLFFGTAIFSFESIGVVLPLENKMKNARHFPAILSLGMSIVTSLYIGMAALGYLRFGDDIKASISLNLPNCWYLHGLSGGGDSGMGGNV

SEQ ID NO: 919923 - protein, 126 aa, Homo sapiens
MCLCMRVYALTRVCVLSKRYSSLEKVKKYEGFLHLVCKLNSPLFSSNPLCVCLQEINLLDLLLRWLVTCCMKWGGDEKVQLLLQQLSLQQNFQRYLRMPIVGSVFEIKNKTKQKKSVCFSALSAVG

SEQ ID NO: 919924 - protein, 194 aa, Homo sapiens
RPPLHMRPSCTLAWTQLPAMLVILWLPSATPVQKSGLNKAVLQTVQHKGYSNVVNHFNENQSFSVNSLGKNDVRFRALKPSPTACRWDRCTPPLEAGCTSPWTPLPKPLTWVCSKSWPLEDFPTLLCKIVPVLAYWTTWKANLGGECICFQSGIHASCSMELRRQETSLGLVGRSGSRFSGVLMISQVPLRTRI

SEQ ID NO: 919925 - protein, 212 aa, Homo sapiens
MFIMEKFEDVLLLALKMEEDGGRGHKPSKPPLEIGNGRQCARARLGGAPEPGHLRRLGCALSRRTLCGFLPSSEPLLWPPRGREAEMADEIAKAQVARPGGDTIFGKIIRKEIPAKIIFEDDRCLAFHDISPQAPTHFLVIPKKHISQISVAEDDDESLLGHLMIVGKKCAADLGLNKGYRMVVNEGSDGGQSVYHVHLHVLGGRQMHWPPG

SEQ ID NO: 919926 - protein, 164 aa, Homo sapiens
MFIMEKFEDVLLLALKMEEDGGRGHKPSKPPLEIGNGRQCARARLGGAPEPGHLRRLGCALSRRTLCGFLPSSEPLLWPPRGREAEMADEIAKAQVARPGGDTIFGKIIRKEIPAKIIFEDDRCLAFHDISPQAPTHFLVIPKKHISQISVAEDDDESSVEYLM

SEQ ID NO: 919927 - protein, 189 aa, Homo sapiens
MFIMEKFEDVLLLALKMEEDGGRGHKPSKPPLEIGNGRQCARARLGGAPEPGHLRRLGCALSRRTLCGFLPSSEPLLWPPRGREAEMADEIAKAQVARPGGDTIFGKIIRKEIPAKIIFEDDRCLAFHDISPQAPTHFLVIPKKHISQISVAEDDDESVITKEKPEKPLGLQLPSCFPKLLHHFVSHQQ

SEQ ID NO: 919928 - protein, 189 aa, Homo sapiens; identical to SEQ ID NO: 919927

SEQ ID NO: 919929 - protein, 182 aa, Homo sapiens
MRGSEARWEAWEHRMCKISISLPFTLSALFKGHLSLVYIGRGSSNGFHLAFPLNSPHPTSEAANVGVLPAPKYIYANDAFWHWGNDHRMSPGAHWTHYKGGKADGSMGRGEDAATTGDGEAVPSGKKRSSEFTNSVSPTSSGSSHKSTFQVSGSQSFPMNALTLTVDTWQSCTCIFHWGEDC

SEQ ID NO: 919930 - protein, 182 aa, Homo sapiens; identical to SEQ ID NO: 919929

SEQ ID NO: 919931 - protein, 869 aa, Homo sapiens
QKALVPTSSPCSVGGECVPVICWVCRGAQAWCKQTQEARRTSLEFTVTSQENLKMSSRRKRAPPVRVDEEKRQQLHWNMHEDRRNEPIIISDDDEQPCPGSDTSSAHYIILSDSLKEEVAHRDKKRCSKVVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFLAEQDIVIITYDVLRSELNYVDIPHSNSEDGRRLRNQKRYMAIPSPLVAVEWWRICLDEAQMVECPTVKAAEMAQRLSGINRWCISGTPVQRGLEDLFGLVVFLGIEPYCVKHWWVRLLYRPYCKKNPQHLYSFIAKILWRSAKKDVIDQIQIPPQTEEIHWLHFSPVERHFYHRQHEVCCQDVVVKLRKISDWALKLSSLDRRTVTSILTMTMEELLTSLQKKCGTECEEAHRQLVCALNGLAGIHIIKGEYALAAELYREVLRSSEEHKGKLKTDSLQEKYLVI

SEQ ID NO: 919932 - protein, 123 aa, Homo sapiens
RGARRRHQAVRLEPCVSRRHAHTCPPPLPAASLAAGAERARLNLPFIPGPGGRARPRWSFTAGAPEPPKRVPAQAVGAHGRCRRLFWWRLRVPGPVTPGSPRAACPGHHSEQHNSRVAETTKM

SEQ ID NO: 919933 - protein, 137 aa, Homo sapiens
MSLRGATVKANIKDFNLTKMWSEIVFPVQILAEKNLVHLILDYSKESENGVCSEKPSASLRTIQAARELLEVKVSGEADQTWAESPSSHAHMCFLRLDFSPPGSANLRGNSTPAGVTPSPTDSLQHTQTFPVIPKKG

SEQ ID NO: 919934 - protein, 801 aa, Homo sapiens
MHSSLNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGEDQARYAGDIIKALELSGTAVPPDLEKLWSDFKDQQKAGFKFDETEQALANERKKLQKAALGLQDSDDEDAAVDIDEQIESMFNSKKRVKDMAAPGTSSVPAPTAGNAEKLEIAKRLALRINAQKNLGIESQDVMQQATNAILRGGTILAPTVSAKTIAEQLAEKINAKLNYVPLEKQEEERQDGGQNESFKRYEEELEINDFPQASNRWKVTSKEALQRISEYSEAAITIRGTYFPPGKEPKEGERKIYLAIESANELAVQKAKAEITRLIKEELIRLQNSYQPTNKGRYKVL

SEQ ID NO: 919935 - protein, 184 aa, Homo sapiens
MTEGRKTNGKLNYVSIQGVCEIKQKKNIFTIHEVEVDHHKGLHPHHLHVVEEEEKEKGSDSPWVGLAVAAVVDGGVVLRPMELCSQGDYDYLCCVMQNLISKKRLVEPVLCEIYFGKFGLGKGKPVNVLRRVTWSKIFYRAFSWQEYDLMRKRLEAQRTDESSLASALGHLRELCIKAEMWLEL

SEQ ID NO: 919936 - protein, 245 aa, Homo sapiens
YRGASAMLLRDVPGYCLYFIPYVFLSEWITPEACTGPSPCAVWLAGGMAGACAHAQLLVRAQSVPTGREDGKAPFALTFAESRVNPALSELQTFSLMPHPGLSSGALGRCSQVPVEPVTLSPIKTANKYCHVSSTGCGLALAQCFTFINSFGPQNSPIKIGAISWGTATPMDVVKSRLQADGVYLNKYKGVLDCISQSYQKEGLKVFFRGITVNAVRGFPMSAAMFLGYELSLQAIRGDHAVTSP

SEQ ID NO: 919937 - protein, 391 aa, Homo sapiens
MFSGSWKESSMNIIELEIPDQNIDVDALQVAFGSLYRDDVLIKPSRVVAILAAACMLQLDGLIQQCGETMKETINVKTVCGYYTSVEIYGLDSVKKKCLEWLLNNLMTHQNVKLFKELGINVMKQLIGSSNLFVMQVEMDVYTTLKKWMFLQLVPSWNGSLKQLLTETDVWFSKQRKDFEGMAFLETEPGKPFVSVFRHLRLQYIISDLASARIIEQDGIVPSEWLSSVYKQQWFAMLRAEQDHEVGPQEINKEDLEGSSMRCGRKLAKDGEYYWCWTGFNFGFDLLVIYTNGYIIFKRNTLNQPCSGSVSLRPRRSIAFRLRLASFDSSGKLVCSRTTGYQILILKKDQEQVVMNLDSRFLTFPLYICCELIQFPGMKSHLYENDSNLFL

SEQ ID NO: 919938 - protein, 391 aa, Homo sapiens; identical to SEQ ID NO: 919937

SEQ ID NO: 919939 - protein, 161 aa, Homo sapiens
MEKPLTVLRVSLYHPTLGPSAFANVPPRLQHDTSPLLLGRGQDAHLQLQLPRLSRRHLSLEPYLEKGSALLAFCLKALSRKGCVWVNGLTLRYLEQVPLSTVNRVSFSGIQMLVRVEEGTSLEAFVCYFHVSPSPLIYRPEAEETDEWEGISQGQPPPGSG

SEQ ID NO: 919940 - protein, 164 aa, Homo sapiens
CGGNNPEMTQGVERRLVEEGYEEEEGWQIHPWELNTQSKKIRGSGKGSESRQAREKDESEHLQDLVYQRRQAARRPLNFCPGTVCCREAAPELVETASRVQRPESGGGALGAGSAACGCRGTQEHKLKSHIPVEELGDKMQSAANRSHSFRDDRPPGFEEQQTA

SEQ ID NO: 919941 - protein, 189 aa, Homo sapiens
MRLKQGSFLWYLYLDKIYCLLSVRNVKALAEYFHILDVHGKNTLNDVLFYHFLHHVTDLKKAQINIVFDMLDWNAVGEIDFEKFYMLNHLEGQFMYRHSRPVFDLLDLKGDLRIGAKNFEMYRFLFNIQKQELKDLFRDFDITGDNRLNYQEFKLYTIIYTDKLQKRQKTEEKEKGERKRSLYSKCHIK

SEQ ID NO: 919942 - protein, 155 aa, Homo sapiens
MPPHFSPSRAPRSVEVYVSWDLIAPNYPRSLSPASAWLSPREPEATGQFIGCPRGKGSSCRDERSGAGGGERLQKEDHEHVRRNKSHHVCTRAGAQGRERGARPRGPGTVVPCSGHSRGRGYSHESVVDERPAAGSLQHVVQKLIREPRTTSEII

SEQ ID NO: 919943 - protein, 154 aa, Homo sapiens
EEEEAARMAGSALARSPSHGQVRLTTLLLPLTHSPLGSPSSSSFPCGIRSPPPPPPQTASRGSQTSARNPALRACRRGGRRARSFRPLLARERALSAPGASTFRGPGLGARLRRGMSVASPPTLPPPTAHSAPEGPITRLASEGRSQALAGIEP

SEQ ID NO: 919944 - protein, 154 aa, Homo sapiens; identical to SEQ ID NO: 919943

SEQ ID NO: 919945 - protein, 153 aa, Homo sapiens
MKAERGEEAAEDKFDTSRGAKVGTHGVHWEHRGGTSCPVLRERGSEEASPGKVTSNPSPDREWGLGQQRDVWKCISGPWKVCEMGEHDSFMEPQLWFTCKVPSPNSSSGIHRCLKWKFLGRGLPSRWHFPVAERERNDVTVSASTVLGTPRML

SEQ ID NO: 919946 - protein, 134 aa, Homo sapiens
MPQLLPKQALGPALVAILQAEGKHGLGTGGRWAFLTSHFPIFLSTFSRPEAQERQVEKPGEAAALSCSRSLSTLHRPGHRHCTWAGERGLARNPRRSTSDQRAVLTSPLRIKNGTLSGFCERAQGGFEKGEARV

SEQ ID NO: 919947 - protein, 140 aa, Homo sapiens
MENCSAASTFLTDSLELELGTEWCKPPYFSCAVDNRGGGKHFSGESYLCSGALKRLILNLDPLPTNFEEDTLEIFGIQWVTETALVNSSRELFHLFRQQLYNLETLLQSSCDFAFSTVMAFITSPLGYTLAGARNSLHAG

SEQ ID NO: 919948 - protein, 156 aa, Homo sapiens
ELHGLLLYIGHLSELPSVNIGAFVNQNQIKLFPPSWHLLHLHLDIHWLVLEILYMLGEKLKQVVYGHQFMNLASDNLTNISLFEEHCETLLCDLISLSLNRYDKVRSSESLMSDQCPCLCIKELWVLLIHLLDHRSKWFVSESYGGQEVPNLRLAS

SEQ ID NO: 919949 - protein, 141 aa, Homo sapiens
MGTVFPQDLYVSLDNVKIQLPGLLSRAKSGKQARGHHITSTFSLEPADEPGLTTPATPQASVRRLCSGPALALEKRRRHSEPRGFQAAFSTRVRSPNTVSAALHARQWEGSPFPSITPGSSRADGVLCSIFKLEVPHSGFY

SEQ ID NO: 919950 - protein, 149 aa, Homo sapiens
WWRADFHVCALTGDVSVLLMPKKILHKIKSQALRQLTEHNSLHIYEVFHFIYNFLHLCNVMVFDPLCELSTPATISPTQQLSSQGFWDKFLSMRFNWRSMRGIPLGTMLKSSLTSIVASICSSWASAISRRRTCLMALTGPKRMRDTWS

SEQ ID NO: 919951 - protein, 377 aa, Homo sapiens
CLFHWDVPHSRTGKVVNMGTIRAHLLLIPLARGLHSPPGLRLPGRPAGAQSPPPEPAGRGYKTTATQGGCHQRGANSRLACGRDLGPLRKRRGGERGGETLRTWRRRRRRRRRNKEQEFTWANRLRGTCRAGGRPAEKTNRCFFFLLLLLLPHRNTHKHPTTGPSYRGGIAAGPGTNSPVGGGVPPCGLVVSEQNADRKCSCRNDSLRRRQTLTTTPSSPLHFRHRRSRRCRHLGSRPRPRRAAPGPSSREAAALLYARPLRAAVDVASIVDASERRLPCDTGGPALLCLYFPGGRQERGPSSVVVVSVGGTQARTGSQVADGGGWRPRWLSQVVVSFREPISGRPHRGRPRFDGDDARFKWCPCSRVDGWIVHLAF

SEQ ID NO: 919952 - protein, 377 aa, Homo sapiens; identical to SEQ ID NO: 919951

SEQ ID NO: 919953 - protein, 377 aa, Homo sapiens; identical to SEQ ID NO: 919951

SEQ ID NO: 919954 - protein, 175 aa, Homo sapiens
ECVGPNCNAFKCLISTPKRGCPCDTHVSLLCMCTPTFMTVRTSSYNLLNMWPLVSQWLGFMWSDSEPADTRTSQREVWQDWRFCVVCMYSKSFREKLQAMQTHELNSGRGAGDDLEGKDECLAQDGTDRKETWITLSLILTGCGIQKNSPNLQSQFSHLKNGVNISVCITLCCED

SEQ ID NO: 919955 - protein, 461 aa, Homo sapiens
MSGLDGVKRTTPLQTHSIIISDQVPSDQDAHQYLRLRDQSEATQVMAEPGEGGSETVALPPPPPSEEGGVPQDAAGRGGTPQIRVVGGRGHVAIKAGQEEGQPPAEGLAAASVVMAADRSLKKGVQGGEKALEICGAQRSASELTAGAEAEAEEVKTGKCATVSAAVAERESAEVVVKEGLAEKEVMEEQMEVEEQPPEGEEIEMAEEDRLEEEAREEEGPWPLHEALRMDPLEAIQLELDTVNAQADRAFQQLEHKFGRMRRHYLERRNYIIQNIPGFWMTAFRNHPQLSAMIRGQDAEMLRYITNLEVKELRHPRTGCKFKFFFRRNPYFRNKLIVKEYEVRSSGRVVSLSTPIIWRRGHEPQSFIRRNQDLICSFFTWFSDHSLPESDKIAEIIKEDLWPNPLQYYLLREGVRRARPPTAPFHYPKAVDHKECSPDQQYLHHLDLVRNADFQTPPMSY

SEQ ID NO: 919956 - protein, 163 aa, Homo sapiens
PCFPAAAGMRAADTSISGREIMYVAEMARNLYNSSWIIKDALVVLPKQILFNFPFNMILQVSFFDTENCISKCVLQVVYICKDIGLHPKSSRLSISVRKMKQKTDGKSRSLYFFSFTSPEKAFLANSHPYFPAPTSHLQFNSPSSFAVFIANTLQDFCQCILR

SEQ ID NO: 919957 - protein, 176 aa, Homo sapiens
SPTSKGKQKSDKRSCSYCMFRVAASMNAWRQSILLAHERASTAIPLAKGPVTNSTFYHYPSAAEKLTETSGCQHNLVPDKAKVITKACKTLHLLYPSYFPLCPLIPGLLGPQHVLTLLPRVFAGAGSSAWSMESSDPHTGDPSPPSSPDSNVTLSASTSLITTLIKIITSLSILLP

SEQ ID NO: 919958 - protein, 176 aa, Homo sapiens; identical to SEQ ID NO: 919957

SEQ ID NO: 919959 - protein, 246 aa, Homo sapiens
MKPGIVSTEKAFMLSVKPTFLNPLLLEIFLKIIQKTSSSQGGKSELVKQSLKKPKLPEGRFDAPEDSHLEKEPLEKFPDDVNPVTKEKGGPRGPEPTRYGDWERKGRWLAAPGCLGPLLLGILAAQAALAQVVPSVARPATPKGPSCKSWQHCPVMQVVSDAAHAPTPEGTSSEPWRPAHAAYSAGTQQELAMLSGNVGPELLQKVPNRAVHSGAAGAGPPWDLRTVELPVCNTSLEKLQAPDSNL

SEQ ID NO: 919960 - protein, 146 aa, Homo sapiens
WVELPKTMGTHFLHWHDLDVSHGVKGDHFGTLRLDCPNDFGLAWAFSPLFCFKGETLPPGDTTIIPLNWKLRLPPGHFGFLLPLSQQAKKGVTVLAGVIDPDYQDEISLPLHNREMAEERDLLVSTDWVILSTCFLQFSSTEVILC

SEQ ID NO: 919961 - protein, 101 aa, Homo sapiens
RDRAEQLGTASRAARAWAAVRPRRPKWLRKETYWYLQTGSSYLLVFYNSPLLRSSFADHSELPMRLQLQAEKRSHCSKAETMDICATSSWTLLVPSGPAWV

SEQ ID NO: 919962 - protein, 154 aa, Homo sapiens
SVPGRMTPLQTAQRCGSRELGSRGQGRGRGSRNRYWMGRVREAGALGAPELAEQWSGKGRGTRDCNRHFQALAPRAWSPQGHSQGSSRALKQKSLEPVSSPCLSRPRIPVSSSPAPSCSEHPGLLVKILVPGRSELRLLKWFILVNPGATFCGL

SEQ ID NO: 919963 - protein, 141 aa, Homo sapiens
SVPGRMTPLQTAQRCGSRELGSRGQGRGRGSRNRYWMGRVREAGALGAPELAEQWSGKGRGTRDCNRHFQALAPRAWSPQGHSQGSSRALKQKSLEPVSSPCLSRPRIPVSSSPAPSCIVSALNLGNKCFQHKRCEGIKTC

SEQ ID NO: 919964 - protein, 164 aa, Homo sapiens
MFLCHFLEAVLCLPPNSPPPGCTPPPSVPQLPGNSEWFRRCCSRAARPLAATQNNEQQQFPTPFMGLMRGHFDDLLVAQDRAVRQQKHRWQHLAGDKSQPSDNLREILQNVARLQGVSNMRKLGHLNNFTKQYLLDNLLQLLYRHLLLYLAILCYGDGFFPLTS

SEQ ID NO: 919965 - protein, 130 aa, Homo sapiens
MPLELQNQQVFIRDFKRGEGYKQGDGKGDPRVIAAPGVESTQSRLELCDSRDRHVKGCLSNTPEAMEWFCESEDRMARMRAPCGQKFLSALFNAVSLVPRTVSGTCSYSMADLSASKFSLCLKALRLKHK

SEQ ID NO: 919966 - protein, 171 aa, Homo sapiens
MRDDSIADPANHLFPSIITTTIHQGNQTKEDRCTKNENTKCKKEEIISDINLMICASIKMSREDNQEIMVFRKTREEGIQRIKEWATVQNVLEGPNKCRPGKDHLKALAVMGDLVTKADPEGIYFLWASKLSFGPHAGPDGSPLSTLGISFWQTSSQLLHTSCSLNRKHCK

SEQ ID NO: 919967 - protein, 616 aa, Homo sapiens
RKRDCPHSVTYAGRSVLKAGGPRPAGGADNPVREVSQEGHSGDGGGPKERQREGAVCCSFTSLGAGKDTRSSCHWAAPALSVCPVGDLVHSCMIVFAAGRDRLHRVLYHGLSVLLGGADMWHTVACVVVRAVAAGPAGIAMGSVGSLLERQDFSPEELRAALAGSRGSRQPDGLLRKGLGQREFLSYLHLPKKDSKSTKNTKRAPRNEPADYATLYYREHSRAGDFSKTSLPERGRFDKCRIRPSVFKPTAGNGKGFLSMQSLASHKGQKLWRSNGSLHTLACHPPLSPGPRASQARAQLLHALSLDEGGPEPEPSLSDSSSGGSFGRSPGTGPSPFSSSLGHLNHLGGSLDRASQGPKEAGPPAVLSCLPEPPPPYEFSCSSAEEMGAVLPETCEELKRGLGDEDGSNPFTQVLEERQRLWLAELKRLYVERLHEVTQKAERSERNLQLQLFMAQQEQRRLRKELRAQQGLAPEPRAPGTLPEADPSARPEEEARWESEDTTSGQRAQAQAQDAELVRLREAVRSLQEQAPREEAPGSERIRGQEQALRFEQERRTWQEEKERVLRYQREIQGGYMDMAAQGTSEKLSAESPPSLPLATLAVPGSPSGPTAPGNH

SEQ ID NO: 919968 - protein, 214 aa, Homo sapiens
APRNSWDIMYGAAGSLLEQVGIRPLWQESRSTPRASAPGLCTDSRGTCGAEGKWQHSASGQDWPSPLPCAQLLPMEERGEQDWLLEDTRDWACLRVTVLGLSLLPVNASQGVGPRRLQCFPSPKVTNCPAAGSVCRGRFSSQGGAGIKGVWGDRKRLSLWGLRASPLGRVGSLGCLRFPPPPLSLLPLDKALQRSPISFSPLLPLGCKFPEGLE

SEQ ID NO: 919969 - protein, 214 aa, Homo sapiens; identical to SEQ ID NO: 919968

SEQ ID NO: 919970 - protein, 1234 aa, Homo sapiens
MKEEVKGIPVRVALRCRPLVPKEISEGCQMCLSFVPGETQVVVGTDKSFTYDFVFDPCTEQEEVFNKAVAPLIKGIFKGYNATVLAYGQTGSGKTYSMGGAYTAEQENEPTVGIIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISIEQRKKSDKNCSFRSKLHLVDLAGSERQKKTKAEGDRLKEGININRGLLCLGNVISALGDDKKGSFVPYRDSKLTRLLQDSLGGNSHTLMIACVSPADSNLEETLSTLRYADRARKIKNKPIVNIDPHTAELNHLKQQVQQLQVLLLQAHGGTLPGSINAEPSENLQSLMEKNQSLVEENEKLSRCLSKAAGQTAQMLERIILTEQVNEKLNAKLEELRQHVACKLDLQKLVETLEDQELKENVEIICNLQQLITQLSDETVACTAAAIDTAVEEEAQVETSPETSRSSDAFTTQHALHQAQMSKEVVELNNALALKEALVRKMTQNDNQLQPIQFQYQDNIKNLELEVINLQKEKEELVRELQTAKKNVNQAKLSEHRHKLLQELEGQIADLKKKLNEQSKLLKLKESTERTVSKLNQEIWMMKNQRVQLMRQMKEDAEKFRQWKQKKDKEVIQLKERDRKRQYELLKLERNFQKQSSVLRRKTEEAAAANKRLKDALQKQREVTDKRKETQSHGKEGIAARVRNWLGNEIEVMVSTEEAKRHLNDLLEDRKILAQDVVQLKEKKESRENPPPKLRKCTFSLSEVHGQVLESEDCITKQIESLETEMELRSAQIADLQQKLLDAESEDRPKQCWENIATILEAKCALKYLIGELVSSKIHVTKLENSLRQSKASCADMQKMLFEEQNHFSEIETELQAELVRMEQQHQEKVLYLVSQLQESQMAEKQLEKSASEKEQQLVSTLQCQDEELEKMREVCEQNQQLLQENEIIKQKLILLQVASRQKHLPNDTLLSPDSSFEYIPPKPKPSRVKEKFLEQSMDIEDLKYCSEHSVNEHEDGDGDGDSDEGDDEEWKPTKLVKVSRKNIQGCSCKGWCGNKQCGCRKQKSDCGVDCSCDPTKCRNRQQGKDSLGTVEQTQDSEGSFKLEDPTEVTPGLSFFNPVCATPNSKILKEMCDMEQVLSKKTAPAPSPFDLPESKHGATEYQQNKPPGKKKKRALASNTSFFSGCSPIEEEAH

SEQ ID NO: 919971 - protein, 134 aa, Homo sapiens
MGQKPGPFLSRKYHEAGKAGTAEGGGALLGYQDSLSLCLAFEGLETLVETQRAGFTYKDHVDQVCLDQVCLKRCSAWVQNVTAVFASPLHWQRPTLFMTSKATVALQLQSQQQQEFNEGRLCARYYNLMTKSRN

SEQ ID NO: 919972 - protein, 186 aa, Homo sapiens
MGAYKYIQELWRKKQSDVMRFLLRVRCWQYRQLSALHRAPRPTRPDKARRLGYKAKQGYVIYRIRVRRGGRNQLKFARSLQSVAEERAGRHCGALRVLNSYWVGEDSTYKFFEVILIDPFHKAIRRNPDTQWITKPVHKHREMRGLTSAGRKSRGLGKGHKFHHTIGGSRRAAWRRRNTLQLHRYR

SEQ ID NO: 919973 - protein, 164 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVILIDPFHKAIRRNPDTQWITKPVHASPCRQRP

SEQ ID NO: 919974 - protein, 268 aa, Homo sapiens
MGTSLTVLSTDGQTSMLLRATILSTRQKVKNHLHSHSSLAQPLKTDEARAHGPRLPAPTAITASEPRVTLLVAGKLISFLIDSGATYSALPEFSGPTHPSQVSVVGVDGLISCPLATRPLTCYVIYRIRVRRGGRKRPVPKGATYGKPVHHGVNQLKFARSLQSVAEERAGRHCGALRVLNSYWVGEDSTYKFFEVILIDPFHKAIRRNPDTQWITKPVHKHREMRGLTSAGRKSRGLGKGHKFHHTIGGSRRAAWRRRNTLQLHRYR

SEQ ID NO: 919975 - protein, 204 aa, Homo sapiens [sequence omitted]

SEQ ID NO: 919976 - protein, 63 aa, Homo sapiens
MGAYKYIQELWRKKQSDVMRFLLRVRCWQYRQLSALHRAPRPTRPDKARRLGYKAKQGYVIYR

SEQ ID NO: 919977 - protein, 204 aa, Homo sapiens [sequence omitted]

SEQ ID NO: 919978 - protein, 157 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVILIDPFHKAIRRNPDTQNAPVCPPE

SEQ ID NO: 919979 - protein, 150 aa, Homo sapiens
MAHCSLNVLERHGNMINQLHNWALGNIIRESVFKVCTEAVAVRILCLVVSLQSRIDQHPKFGLNVKADEEPFTHQVSRHQPRANLTSRLEGLTAPKSCYPQRSSFVLMKQLLVGSQRVSRQELVAKETNHAIRGLEYSAPPHDFQRQRKG

SEQ ID NO: 919980 - protein, 125 aa, Homo sapiens
ENKDLLLALRLPPALGDTCTMAGYARLKNVLLALQTRLQPLQEGDSRQDPASQKRLLVESLFRDLDADGNGHLSSSELAQHVLKKQDLDEDLLGCSPGDLLRFDDYNSDSSLTLREFYMAFQESW

SEQ ID NO: 919981 - protein, 924 aa, Homo sapiens
RWHSSGQRRLRQLEPQQPPASPGPADSPRNQPKDAGRGRRRQPRGAPVHSPSQLFSANLGHSRSSPRPVIRLSQEGQPGTAFGVHLTAAREPSRAGLRMGLACDPVNPCSEARMWVWGSHMADGAQNALKSQEEKGFSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLALQTRLQPLQEGDSRQDPASQKRLLVESLFRDLDADGNGHLSSSELAQHVLKKQDLDEDLLGCSPGDLLRFDDYNSDSSLTLREFYMAFQVVQLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 919982 - protein, 605 aa, Homo sapiens
MFNSPQVVQLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 919983 - protein, 605 aa, Homo sapiens; identical to SEQ ID NO: 919982

SEQ ID NO: 919984 - protein, 605 aa, Homo sapiens; identical to SEQ ID NO: 919982

SEQ ID NO: 919985 - protein, 160 aa, Homo sapiens
LNLMTSSKPLVIYNIVRGSGISTVIFWRPLFCLLHSSVNLHDEHAGISCSNNIDHRERKGPWKSIGPDLSFLIRSQFYLKVNLKGYTGDFRSLLASNWALRLLAILPVPIRLANAFSKRPFSKRLLRPLEEGGAKREMLPSDSLWRISNATTGGWKQFSL

SEQ ID NO: 919986 - protein, 160 aa, Homo sapiens; identical to SEQ ID NO: 919985

SEQ ID NO: 919987 - protein, 160 aa, Homo sapiens; identical to SEQ ID NO: 919985

SEQ ID NO: 919988 - protein, 160 aa, Homo sapiens; identical to SEQ ID NO: 919985

SEQ ID NO: 919989 - protein, 167 aa, Homo sapiens
MFFRTECRLPSKTPKTFSSLLLEGPNTEDSLKNQFIHSSLVDLKQSLSWRNLLSYRDMCQLSKTVTWPKHNKTVIFLRLREPQPKAPMGAHTAKEELSQPGERTAGREDTHTDQPRLHTPHRALGSWPCPLLTGLEPLTLQGQTCPGQLPPLGTVGQRRAWGLLGIC

SEQ ID NO: 919990 - protein, 167 aa, Homo sapiens; identical to SEQ ID NO: 919989

SEQ ID NO: 919991 - protein, 322 aa, Homo sapiens
NLEEAVEKEYMKQLVKLTRLLFNLSEVKSIFSKAQVEYLSISEDPKKALVRFFEAVGVTYGNVQTLSDKSAMVTKSLEYLGEVLKYIKPYLGKKVFSAGLQLTYGMMGILVKSWAQIFATSKAQKLLFRIIDCLLLPHAVLQQEKELPAPMLSAIQKSLPLYLQGMCIVCCQSQNPNAYLNQLLGNVIEQYIGRFLPASPYVSDLGQHPVLLALRNTATIPPISSLKKCIVQVIRKSYLEYKGSSPPPRLASILAFILQLFKETNTDIYEVELLLPGILKCLVLVSEPQVKRLATENLQYMVKACQVGSEEEPSSQLTSVFR

SEQ ID NO: 919992 - protein, 404 aa, Homo sapiens
NLEEAVEKEYMKQLVKLTRLLFNLSEVKSIFSKAQVEYLSISEDPKKALVRFFEAVGVTYGNVQTLSDKSAMVTKSLEYLGEVLKYIKPYLGKKVFSAGLQLTYGMMGILVKSWAQIFATSKAQKLLFRIIDCLLLPHAVLQQEKELPAPMLSAIQKSLPLYLQGMCIVCCQSQNPNAYLNQLLGNVIEQYIGRFLPASPYVSDLGQHPVLLALRNTATIPPISSLKKCIVQVIRKSYLEYKGSSPPPRLASILAFILQLFKETNTDIYEVELLLPGILKCLVLVSEPQVKRLATENLQYMVKACQVGSEEEPSSQLTSVFRQFIQDYGMRYYYQVYSILETVATLDQQVVIHLISTLTQSLKDSEQKWGLGRNIAQREAYSKLLSHLGQMGQDEMQRLENDNT

SEQ ID NO: 919993 - protein, 623 aa, Homo sapiens
MEELTEVGLQNFFSLFLLLAAVAEVEDVASHVLDLLNFLKPAFVTSQRALIWKGHMAFLLMYAQKNLDIGVLAEKFSCAFREKAKEFLVSKNEEMVQRQTIWTLLSIYIDGVQEVFETSYCLYPSHEKLLNDGFSMLLRACRESELRTVLSFLQAVLARIRSMHQQLCQELQRDNVDLFVQSSLSAKERHLAAVASALWRHFFSFLKSQRMSQVVPFSQLADAAAEKEYMKQLVKLTRLLFNLSEVKSIFSKAQVEYLSISEDPKKALVRFFEAVGVTYGNVQTLSDKSAMVTKSLEYLGEVLKYIKPYLGKKVFSAGLQLTYGMMGILVKSWAQIFATSKAQKLLFRIIDCLLLPHAVLQQEKELPAPMLSAIQKSLPLYLQGMCIVCCQSQNPNAYLNQLLGNVIEQYIGRFLPASPYVSDLGQHPVLLALRNTATIPPISSLKKCIVQVIRKSYLEYKGSSPPPRLASILAFILQLFKETNTDIYEVELLLPGILKCLVLVSEPQVKRLATENLQYMVKACQVGSEEEPSSQLTSVFRQFIQDYGMRYYYQVYSILETVATLDQQVVIHLISTLTQSLKDSEQKWGLGRNIAQREAYSKLLSHLGQMGQDEMQRLENDNT

SEQ ID NO: 919994 - protein, 182 aa, Homo sapiens
MSSTFLDSTYDARGSPSLHTLINDCLPANSARGSPSLHTLNNDCLPANSARGSPSLHTLNNDCLPANSARGSPSLHTLINDCLPANSPGLAPMEVRDFVAMEGPWANPTPFASGDADREQPRKPGPEPAPVASRPFLYSGSHLRGQQLCLELGDPNYHCASGWPLRLASTPQTPAAPPSPWI

SEQ ID NO: 919995 - protein, 539 aa, Homo sapiens
LWQTCTTMTMKNLHDLYLFHVAQLQIAELTKSLLNGGMLASCHVGFPYCYTMLLIAFIWKESSPSASHQTCHGTKGVFELLSGWRRTKENLPFKDRIADAYSDVMVTYTMTSSLYFITFGMGASPFTNIEAVKVFCQNMCVSILLNYFYIFSFFGSCLVFAGQLEQNRYHSIFCCKIPSAEYLDRKPVWFQTVMSDGHQQTSHHETNPYQHHFIQHFLREHYNEWITNIYVKPFVVILYLIYASFSFMGCLQISDGANIINLLASDSPSVSYAMVQQKYFSNYSPVIGFYVYEPLEYWNSSVQDDLRRLCSGFTAVSWVEQYYQFLKVSNVSANNKSDFISVLQSSFLKKPEFQHFRNDIIFSKAGDESNIIASRLYLVARTSRDKQKEITEVLEKLRPLSLSKSIRFIVFNPSFVFMDHYSLSVTVPVLIAGFGVLLVLILTFFLVIHPLGNFWLILSVTSIELGVLGLMTLWNVDMDCISILCLIYTLNFAIDHCAPLLFTFVLATEHTRTQCIKSSLQDHGTAILQNVTSFLIGVH

SEQ ID NO: 919996 - protein, 140 aa, Homo sapiens
MKIFEPERVSLAGLGETNFCVMERARDNSCKDLDSANNLNKLGKGSLAFDDIMAHQHLDYNFIRPKKKRAQHDFCDLEEEDEKKEKENFLAMTTVVIMTITVYKVMALMMLMTKYTFTNSCHALNNSRNYNAKNDFPSLY

SEQ ID NO: 919997 - protein, 140 aa, Homo sapiens; identical to SEQ ID NO: 919996

SEQ ID NO: 919998 - protein, 161 aa, Homo sapiens
AAIGDVLVKMVVFGEEVDLAYQEAMLNMATINRTAAGLMHKFNAHVATDITGFGILGHSQNLVKQQRNDVSFVICNLPVIAKMAAISKARGQVMEVGKSKIKVLADSVPHEDLHPEIWVKEPSDDSSDQDFEQPQLMLSGAETNQPQWALTKSQIHNAQSH

SEQ ID NO: 919999 - protein, 148 aa, Homo sapiens
ELLLVLCVGLKLQLPPDIPAMSLLRVLTSLSRLTPMLSMKIKRTFHEVSPESSTGEEVPLRNENQSQMERSLFVETPFPSVYLDLILKVTSHFIWAGGKSTKPDVERHCRMSKKQPHCIPKTWESRSRRYDDTIYSQDISSCVVFNEY

SEQ ID NO: 920000 - protein, 156 aa, Homo sapiens
MDLQTPLHKNSLSALDNMIDDGGRQTGSWAERGGAVPCRATGEELLKALADYLLHRCALDDALGLMSHCIVILKICHTLREKLVAMTMGSEAEKKTSTTVSSIIVVAKWIIPRVDDVVKSVYHLLSTKLLDAPSAESREEKQLDIQEKQLDFKETT

SEQ ID NO: 920001 - protein, 134 aa, Homo sapiens
MDLQTPLHKNSLSALDNMIDDGGRQTGSWAERGGAVPCRATGEELLKALADYLLHRCALDDALGLMSHCIVILKICHTLREKLVAMTMGSEAEKKTSTTVSSIIVVAKWIIPRVDDVVKSVYHLLSTKLLDMKL

SEQ ID NO: 920002 - protein, 277 aa, Homo sapiens
EAAGAMGRVRNRATAQRRRRKRPGDPPAACAAIAVTGASRAQCPRVQVGVGSHAAAKRWLGRWRRKRRWRRVRKAGPRDLLPSAPTPYPPGPAPSPKDLDLGAQRERWETFRKLRGLSCEGAAKVLLDTFEYPGLVHHTGGCHCGAVRFAVWAPADLRVVDCSCRLCRKKQHRHFLVPASRFTLLQGAESIVTYRSNTHPALHSFCSRCGVQSFHAAVSDPRVYGVAPHCLDEGTVRSVVIEEVGGGDPGEEAAEEHKAIHKTSSQSAPACPREQEQ

SEQ ID NO: 920003 - protein, 460 aa, Homo sapiens
TSGCQNLPLTRRRPTGSCVCLGRGGPGGGGLRAGSRHPAPAAMHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 920004 - protein, 443 aa, Homo sapiens
TSGCQNLPLTRRRPTGSCVCLGRGGPGGGGLRAGSRHPAPAAMHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSEIIRDNTGILECGLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 920005 - protein, 327 aa, Homo sapiens
MKTEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 920006 - protein, 444 aa, Homo sapiens
TSGCQNLPLTRRRPTGSCVCLGRGGPGGGGLRAGSRHPAPAAMHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 920007 - protein, 460 aa, Homo sapiens; identical to SEQ ID NO: 920003

SEQ ID NO: 920008 - protein, 110 aa, Homo sapiens [sequence omitted]

SEQ ID NO: 920009 - protein, 460 aa, Homo sapiens; identical to SEQ ID NO: 920003

SEQ ID NO: 920010 - protein, 233 aa, Homo sapiens
TSGCQNLPLTRRRPTGSCVCLGRGGPGGGGLRAGSRHPAPAAMHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGPRALWKGMGSTFIVQGVTLGAEGIISEFTPLPRYHF

SEQ ID NO: 920011 - protein, 460 aa, Homo sapiens; identical to SEQ ID NO: 920003

SEQ ID NO: 920012 - protein, 460 aa, Homo sapiens; identical to SEQ ID NO: 920003

SEQ ID NO: 920013 - protein, 391 aa, Homo sapiens
TSGCQNLPLTRRRPTGSCVCLGRGGPGGGGLRAGSRHPAPAAMHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSGEKHGDRHRDEGLLGPRLAACRPRKRRRGSRLLFLLILSRATPFALLCSTAMCQQLPAEEQMWSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 920014 - protein, 460 aa, Homo sapiens; identical to SEQ ID NO: 920003

SEQ ID NO: 920015 - protein, 460 aa, Homo sapiens; identical to SEQ ID NO: 920003

SEQ ID NO: 920016 - protein, 271 aa, Homo sapiens
MYWHILALFYAANVRLITMLSITISLHLQSSILCTVSTKLREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 920017 - protein, 374 aa, Homo sapiens
TSGCQNLPLTRRRPTGSCVCLGRGGPGGGGLRAGSRHPAPAAMHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSFALNFVFQNRCTWREKQLFLSPFI

SEQ ID NO: 920018 - protein, 776 aa, Homo sapiens
MNCAFVILRAIVPSQPESKVIPVVKEMQLFLHYYCHMFKGKELLLCDPVHTLPNPFTQPMAVLNNFMRYSIDYIKLKKGHRSPCKNLLKKKKQAKQNAETASAVATRTHTGKEDNNTVVLEPDKCNIAVEEEYMTDEKKKRKSNQLKEIRRTELKRYYSIVELLMVLCCQPPEPPSDALMIEIDGGESWSFMGLSTWPSAITRDLKSERGRQERARETTQAALLALRVKAGPWLKLPADAELARYADANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIEDILPSKEEKSKTPPMFLCIKVGKPMRKSFATHTAAMVQQYGKRRKQPEYWFAVPRER

SEQ ID NO: 920019 - protein, 246 aa, Homo sapiens
MAMERFLVSTKSSLSASHSQREGKRHGSGAATPLKNVRSSTPSLQVRDKQKETQQVIVAQGVTAIQAISVAQIVSVTQAITASKIISATQVISFAQHASVTELVSVTQGVSATQVVTISQDISTTQVVTVSQVVQSQQVVTVSQGCLVTQNEAMVAMVDQNAWPCLYKLHFFMCPHHITLSVSVSGTFMLFQKCFIPFLKCFQFGHIPNVFLPNFFLFNLSTFQRKFEPSVSVSLASLFKILCGRN

SEQ ID NO: 920020 - protein, 356 aa, Homo sapiens
LVREKLDLTCAGPQQLGHSPLQMKGEAGHMLHNEKSKQEGHIWGSMRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHRSGSRKFASGTTLGLSVYPTKSLHLPGPCLQSSLLLQVSNMLPVIVGPLVMGSHLSSITMWFSLALIITTISHCGYHLPFLPSPEFHDYHHLKFNQCYGVLGVLDHLHGTDTMFKQTKAYERHVLLLGFTPLSESIPDSPKRME

SEQ ID NO: 920021 - protein, 343 aa, Homo sapiens
LLELLFEFWMKGEAGHMLHNEKSKQEGHIWGSMRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHRSGSRKFASGTTLGLSVYPTKSLHLPGPCLQSSLLLQVSNMLPVIVGPLVMGSHLSSITMWFSLALIITTISHCGYHLPFLPSPEFHDYHHLKFNQCYGVLGVLDHLHGTDTMFKQTKAYERHVLLLGFTPLSESIPDSPKRME

SEQ ID NO: 920022 - protein, 187 aa, Homo sapiens
LCVSVAKVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 920023 - protein, 139 aa, Homo sapiens
MTSFLLALGNIYKSGYLPTMSIRRLLCSREWSFHTSSRQQLPPPPPLTLITLELHTHNTQQLLLLPPPLLPMTSTPMQPLQLLQDMLLLGAMATQSSSQSPQRHLGQLPPPLQQLLPLQHLASTSLSSCRQTECNRPAI

SEQ ID NO: 920024 - protein, 158 aa, Homo sapiens
MFKMVNLHYVYLPQLNFFKLKRQKSIKVIQKTSSRASSAVSSFQSQYIHSLRQERQTDSNSWTVPDLWSLAHPTEDSQGHGMQRITAHLPWHWEEGVVACMPIFCHAWFMVYRWTHWMFQWTQPAFKKHVDLEKALPPTCQRMFMLRTAGKKEMAYID

SEQ ID NO: 920025 - protein, 137 aa, Homo sapiens
MLTIKQRQSGPSGGIPEEDIVTIGDDSSMHTIVPEDLMGQDVEVKDSDIDDPDPVGKCYATLNFVNIIPCFSLQLYHGKCISTSFILNAIYSVYRDSSIIYFQGTANISSTIAISVYTSPSPANASIFCLKAFSGHQ

SEQ ID NO: 920026 - protein, 137 aa, Homo sapiens; identical to SEQ ID NO: 920025

SEQ ID NO: 920027 - protein, 120 aa, Homo sapiens
MAGRDTWLFMRNIPLQSDAKLDFFGTLLVWMKMNLITANSWFEFEAGFHCDFLFFEPCSGAKLSCSVEIVRQKEAEIQKGAGKIDHGNEEDQHSLPCLQCSYSTPVSFLMPRLFYPSLTF

SEQ ID NO: 920028 - protein, 166 aa, Homo sapiens
FIFRGKNAVIMLINLELSLRKLKKFEIEYNVEQRSLKNTGPWGLLSQWVPWILPFLGPPAAIILRLFFGPCIFNLLVKFVSSRIEAVKLLIVLQKEPQMQSMTKIYHRPLDRPASPCTDVNDIESTPPRKFQLHNPYYAPIQQEAVRAVVGQPPQQHLGFPVERGD

SEQ ID NO: 920029 - protein, 144 aa, Homo sapiens
MFEVSPPSDGMSCLLPGPWGLSVRQAGKDTSFRKALLSPDPSTTTETLWLGVSSPRNLKAKEHSCASENQENFGRRRRTSFLREWLSPPLQMVPGKHLLSPPGSGLWNGQEEVQDVGHRKSCDWETFETQVLLPCHTSSRVSIL

SEQ ID NO: 920030 - protein, 151 aa, Homo sapiens
CVFQRMPLIMFSLDTSQAPDKIKCLLTLFPILILKKQIIYSLKHRIFIRICQLLLEHNRLIINGSEPDAFAEALRKRTGSSTELLRKEQLRGGVSRFAHLHLSDPLHRKARKQGSQESSALLPMTLPAPDDTYWCSLKHSVRKLFGVKHVY

SEQ ID NO: 920031 - protein, 346 aa, Homo sapiens
MLFKQQAWLRQKLLVLGSLAVGSLLYLVARVGSLDRLQPICPIEGRLGGARTQAEFPLRALQFKRGLLHEFRKGNASKEQVRLHDLVQQLPKAIIIGVRKGGTRALLEMLNLHPAVVKASQEIHFFDNDENYGKGIEWYRKKMPFSYPQQITIEKSPAYFITEEVPERIYKMNSSIKLLIIVREPTTRAISDYTQVLEGKERKNKTYYKFEKLAIDPNTCEVNTKYKAVRTSIYTKHLERWLKYFPIEQFHVVDGDRLITEPLPELQLVEKFLNLPPRISQYNLYFNATRGFYCLRFNIIFNKCLAGSKGRIHPEVDPSVITKLRKFFHPFNQKFYQITGRTLNWP

SEQ ID NO: 920032 - protein, 136 aa, Homo sapiens
MLLNILWDDIPSTTKNCLAHNVNSSKVEKPCTKTIITLYPWGQRCFDPRTEAINQKQAKWKTGVLVWINHPPLIEISNQTENTHNQPDQNIGFSSGEAGLESMSWVQMEKGFSYPSHLHPPMASSWRSAGLPPVVL

SEQ ID NO: 920033 - protein, 797 aa, Homo sapiens
HRESPAEQEGRAMIVKNKNHLPKGFSDLGPGHDGALGVAEGPSQGFGAKNCLGLVLSPPKRPWTHSRVTAMGSCIYYFFSAVDGCHPRLPGKPSHQAPPQGDPAPTRILPPRGPAPMRPCPHAAQPPPGSCPCILRWVGICIFGVFQGKGNMADKAKPAKAANRTPPKSPGDPSKDWAAKKLSLELEDMCTEWCGRPSRGAVVLVRPRATTALSMQNNSAFGDLKSDELELLYSAYGDETGVQCAPRQVLAPGSPWLLSSFSCALVWDPEPHMCVGGERAIPQPSRWQLRSSRCFQSSTQMDTRSGSQCSVTPEAIRNNEELVLPPRISRVNGWSLPLHYFRVREGFLEDPAMDLAVGSGPWLPGGTSHLSWARLCPPSLQCSSGLKGPSSVARVGTEAEEVPRVSEGCQGCQRAVTSQHHCVVLGLGHPGQVSGKWTASPAALPMPAPQRPPRAPWPAACGFALWRLEGACAIRHLQGPGRLWEVTSQAQWLQPLTPREVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPRVLRTDPRYEDVKNMNTWLLFLPLFPVQVQTLIVVIIRMLVLLLDLLGLVQLGQLLIFHIYLKAKKMTTFEYLINTRKEESSKHQAVRKDPYVQMDKGFLQQGAGALGSSAQGVKAKSSLLIYKCPCHFCTSVNQDGDSKAQEADDAPSTSTLGLQQETTEPMKTDSAESED

SEQ ID NO: 920034 - protein, 318 aa, Homo sapiens
MNTWLLFLPLFPVQVQTLIVVIIRMLVLLLDLLGLVQLGQLLIFHIYLKAKKMTTFEYLINTRKEESSKHQAVRKDPYVQMDKGFLQQGAGALGSSAQGVKAKSSLLIYKCPCHFCTSVNQDGDSKAQEADDAPSTSTLGLQQETTEPMKTDSAESEELRFGSSGAPVIQVFYPETPPSIKVLPVESTLQSLLLLPMLQARNQSPSSQRPLDVLRRNQDPQSPASISVIIFITPKEEPALQEGLHLQEDGLPATAEDAATCLTVLSSQPASCRASCCLRADGPGMLAHTCEHSTGKWEHSTGKWEHSTEKWEHSTGKW

SEQ ID NO: 920035 - protein, 143 aa, Homo sapiens
APVSRCWTQCLSLVSPDVKNMNTWLLFLPLFPVQVQTLIVVIIRMLVLLLDLLGLVQLGQLLIFHIYLSMSPTLSPRSPQAWLVRAAHLTPLLEYVPNPEPPTPGARVFVPRVRMCSGSASPRSEIMDKKGKSQEEIKSMRAQ

SEQ ID NO: 920036 - protein, 212 aa, Homo sapiens
MSTVLGNGSTWHWEIGVYSTGKWEHSTGNWEHSTGKWEHSTRKWELTALGNGNIVLGNGSTVLGKGSPQYWELGAQYWEMGVHSTRKWEHSIGKWEHKYWKMGAHSTGKWEHSIGKWEHSTGNWEHSAEKWELTVLGNGAQYLEMGAQYWEMGAHSTGKWDTVLGIGSTVLGNGSSQYWEMGAHSTGKWEHSIRKWEHSTGKWELTALGNGA

SEQ ID NO: 920037 - protein, 122 aa, Homo sapiens
MLQARNQSPSSQRPLDVLRRNQDPQSPASISVIIFITPKEEPALQEGLHLQEDGLPATAEDAATCLTVLSSQPASCRASCCLRADGPGMLAHTCEHSTGKWEHSTGKWEHSTEKWEHSTGKW

SEQ ID NO: 920038 - protein, 144 aa, Homo sapiens
SGISMVIGGRKDKSWKVFGNVQLSIHATSRVPRATSGRYHEKYGGNVKFWDTCAEHSGPSAAGLLEFAGGPFQTLFAWLSLAEAAEQQRLLPVPSSGSFVPGGTRQMPVGALLYEVSVDPSWEVSPSQENDQTMQALATKGCSS

SEQ ID NO: 920039 - protein, 681 aa, Homo sapiens
MTSHHYAKYFLSTRLAQNKTPILKDSTGASRLSVAAPSIPLHILDFRAPETIESVAQGIRKNCPFDYACITDMVKSSETTSGNIAFIVELLKNISTDLSDNVTREKMKGKNYSDSNHQSNSRHFTSDLGYTAGENIPPLSSIKQSLKSHGKLGFYTLQSGNAALRAIIKQSYSEVANHILDTAAISNWAFIPNKNASSDLLQSVNLFARQLHIHNNSENIVNELFIQTKGFHINHNTSEKSLNFSMSMNNTTEDILGMVQIPRQELRKLWPNASQAISIAFPTLGAILREAHLQNVSLPRQVNGLVLSVVLPERLQEIILTFEKINKTRNARAQCVGWHSKKRRWDEKACQMMLDIRNEVKCRCNYTSVVMSFSILMSSKSMTDKVLDYITCIGLSVSILSLVLCLIIEATVWSRVVVTEISYMRHVCIVNIAVSLLTANVWFIIGSHFNIKAQDYNMCVAVTFFSHFFYLSLFFWMLFKALLIIYGILVIFRRMMKSRMMVIGFAIGYGCPLIIAVTTVAITEPEKGYMRPEACWLNWDNTKALLAFAIPAFVIVAVNLIVVLVVAVNTQRPSIGSSKSQDVVIIMRISKNVAILTPLLGLTWGFGIATLIEGTSLTFHIIFALLNAFQGFFILLFGTIMDHKIRDALRMRMSSLKGKSRAAENASLGPTNGSKLMNRQG

SEQ ID NO: 920040 - protein, 712 aa, Homo sapiens
MVELLDLYQMEDEAYSSLAEATTELYQYLLQPFRDMRELAMLRRQQIKISMENDYLGPRRIESLQKEDADWQRKAHMAVLSIQDLTVKYFEITAKAQKAVYDRMRADQKKFGKASWAAAAERMEKLQYAVSKETLQMMRAKEICLEQRKHALKEEMQSLRGGTEAIARLDQLEADYYDLQLQLYEVQFEILKCEELLLTAQLESIKRLISEKRDEVVYYDTYESMEAMLEKEEMAASAYLQREELQKLQQKARQLEARRGRVSAKKSYLRNKKNTGEHLKVCAEERDQRERVIEVGRSRRARSHRSEDDDSTQQDEFREKLWARSRSWWSEKGVQQRFKAVTDGIAKETVQEICIAKHNEKIQQRTRIEDEYRTHHTVQLKREKLHDEEERKSAWVSQERQRTLDRLRTFKQRYPGQVILKSTRLRLAHARRKGAASPVLQEDHCDSLPSVLQVEEKTEEVGEGRVKRGPSQTTEPQSLVQLEDTSLTQLEATSLPLSGVTSELPPTISLPLLNNNLEPCSVTINPLPSPLPPTPPPPPPPPPPPPPPPLPVAKDSGPETLEKDLPRKEGNEKRIPKSASAPSAHLFDSSQLVSARKKLRKTAEGLQRRRVSSPMDEVLASLKRGSFHLKKVEQRTLPPFPDEDDSNNILAQIRKGVKLKKVQKDVLRESFTLLPDTDPLTRSIHEALRRIKEASPESEDEEEALPCTDWEN

SEQ ID NO: 920041 - protein, 712 aa, Homo sapiens; identical to SEQ ID NO: 920040

SEQ ID NO: 920042 - protein, 167 aa, Homo sapiens
ISGVYSDLNKVAGPMHQDPEDRIFSNYYSMGLCPACLDSTSSVHCLIGTDVIVNVPTDSAIIWQQHSSSTHIVYVQPSANEKIWLAGYQDCQSFCLIHKFHSLGYRAHQCHKEVEDLDCVRGNLFGMGLKMEAGAVHGLTLMGYYQTVRETHSLREKCLLCHLQLPC

SEQ ID NO: 920043 - protein, 911 aa, Homo sapiens
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPIVQAVPQGAETPRPLFQTKLSRFLPQKEAAVMYPAELPQSSPADSEQRVSETCIVPAWLPSLPDEVFLEEAPLVRMRSPPDPHASQGPPASVHASDQPYGTGLGQRTGQVTVPTEYPLHECPGTAGADDCWQGVNGSVGISRPTSHTPTGTANDNIPTIDPTGLTTNPPTAAESDLLKPVPADALGLSGNDTPGPSHNTALARGTGQPGSRPTWPSQCLEELVQELARLDPSLCDPLASQPSPEPPLGLLDGLIPLAEVRAAMRPACGEAGEEAARNLDTEPLKLGTGNPGSSGFVPRSYQFSFTQLLPAPREETRLENPATHPVLDQPCGQGLPAPNNSIQGKKVELAARLQKMLQDLHTEQERLQGEAQAWARRQAALEAAVRQACAPQELERFSRFMADLERVLGLLLLLGSRLARVRRALARAASDSDPDEQASLLQRLRLLQRQEEDAKELKEHVARRERAVREVLVRALPVEELRVYCALLAGKAAVLAQQRNLDERIRLLQDQLDAIRDDLGHHAPSPSPARPPGTCPPPPAPLPHPPSWLPAAVLSGFWGSTGRGWHRCWATGSPAAASPARLFRPRCSS

SEQ ID NO: 920044 - protein, 153 aa, Homo sapiens
MAQGSHTAGWLVPNHKPPQPSPFLAKGFSFIGQKTLTHFPKTVPPVSRKQLRSVFILILNLMAVRCTSLEGEVRQPGGRGSSEKLQVLGETLAILPTEVEPREVHALCSMACLAPPLPSLETRDSNSNLNFHGCGMEKKPVFSRTKESPATVS

SEQ ID NO: 920045 - protein, 148 aa, Homo sapiens
MLYKKGSEELKRKEEEYGKDVEINQQLKRTLKTRAMELRTVRKNLDQISLSHKKEKGLLHENSMLQEEIAMLRLELDTIKHQNEIKEKKYFEDIESVKEEHDNLLKAITLNEEALAKTVFQYNGQLSILTTENKMLSSELKNVKHNKE

SEQ ID NO: 920046 - protein, 141 aa, Homo sapiens
PISQSGQQRLASERMGPSVECFLLRRRELRLLQTHTNLLPLTGVLLMITLGQEYIAGAIAGKLTLNIHPTSRISSYCTPAPFTLQGDCSATAGSTGILKHKLTVLPTLISHTNPSLLSGTVGFVTFSMCWTVAWSLLPGTL

SEQ ID NO: 920047 - protein, 171 aa, Homo sapiens
VKEAQEPRQGGRSFAQKNNQSPFYWLMAWHEHWHVYNGVQEDVRSDSTNSDITAKLFLLKNKLISFLCGTFYTVFPAFFEAWSFSCQSILKVYWPLDRASESLGTEIQNCVYLIFHASPRCPPFPAKVSQCGGLIQEEGMQTDRQMALKDESPMSHQQTGTNGTRFGGLLV

SEQ ID NO: 920048 - protein, 1091 aa, Homo sapiens
VKAGTSHFHLFCGSSVASGHLDIYVQTWAQRPDKDFLPRPHQPTYAIASVPEYTLFTSVTMGEPSVLWAEANLSMCTLDPTLSPKDRVWLCCRGGSVVDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEEYVIDKS

SEQ ID NO: 920049 - protein, 1001 aa, Homo sapiens
QRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEEYVIDKS

SEQ ID NO: 920050 - protein, 156 aa, Homo sapiens
MVTNVFIISSPGDFKENVLLFSINNTEFYLLNLVNFSIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQK

SEQ ID NO: 920051 - protein, 693 aa, Homo sapiens
VKAGTSHFHLFCGSSVASGHLDIYVQTWAQRPDKDFLPRPHQPTYAIASVPEYTLFTSVTMGEPSVLWAEANLSMCTLDPTLSPKDRVWLCCRGGSVVDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKVSQDRTETPCILNEGRSLSVLRSKCKRNLEIPGKSL

SEQ ID NO: 920052 - protein, 134 aa, Homo sapiens [sequence omitted]

SEQ ID NO: 920053 - protein, 139 aa, Homo sapiens
MHVFFVFLSLLETLRRLPVADVSVPHTGENCSPRMEAALTKNTVDIAEGLEQVQMGSLPGTISENSPSPSERNRRVNSDLVTNGLINKPQSLESRERQKSSDILEELIVQGIIQSHSKVFRNGESYDVTASNFVINISL

SEQ ID NO: 920054 - protein, 268 aa, Homo sapiens
MHVFFVFLSLLETLRRLPVADVSVPHTGENCSPRMEAALTKNTVDIAEGLEQVQMGSLPGTISENSPSPSERNRRVNSDLVTNGLINKPQSLESRERQKSSDILEELIVQGIIQSHSKVFRNGESYDVTLTTTEKPLRKPPSRLKKLKIKKQVKDFTMKDIEEKMEAAEERRKTKEEEIRKRLRSDRLLPSANHSDSAELDGAEVAFAKGLQRVRSAGFEPSDLQGGKPLKRKKSKCDATLIDRNESDESFGVVESDMSYNQADDIVY

SEQ ID NO: 920055 - protein, 242 aa, Homo sapiens
MCGCCICPGEQCLGASEYVRRSPSPSGISSSTISLPCAPAAGRSCLYVCMNSPRASREGCGMLPDSQAGAQYSLHAHTLCSLCCARHTWTYMDLSHGGDYEPQDGIVQLVPLMSLGNRNPFLEFLTEEHPRGPAGHPAAAPGHRAQAQLAVTPDTHSVLVTRSSEQQNEEGALEAAPGSLLSCNGRGFPILHIPASIWWFSVLDFGHTHSSRAEDMTGPWIKGFSLKPGCSVCASRRAQCLP

SEQ ID NO: 920056 - protein, 163 aa, Homo sapiens
SGFRKNTYRRKSIKLCKISEEIGSEPNMSDQWPVTRPAGDPENMWPRWTLKSQSLKPPCSFPWEFSVSLWVPLVSPPPSAYSKRFHCLVMRVWQDSLAADDSYPRRDFRRHLPYPHASDDTYRYLQFYLLLTPPECKFHEGRGLASLLHCQQLERSACYTVGA

SEQ ID NO: 920057 - protein, 146 aa, Homo sapiens
VYKSMTTSPKVADGVVYATRHPRRDPFCVISPAPPPVPSSSFRSACGRRAAQLTYGSGWSRPRRGRFENPGPPLAILVEACPSERSQYSVLCPVCVRLKSRAALRAALLSTRGRPRRDLLSTYLGGLLRVSSSVSFSQNNFGPLLG

SEQ ID NO: 920058 - protein, 153 aa, Homo sapiens
IWKHLTTMRIPMPPWIPSFYIFPDHASPVNFNKLVLGMRPHIRKHSSLKGSCKGGCFSPVNLHQSLNGAPKESEGTSLHYLPLHFRAGHVWTRSRTWKSKGSWEMCEAVINPLPAKLTADSLQTSTDLRCCCPFIQNKGILSVARQASTWFLS

SEQ ID NO: 920059 - protein, 158 aa, Homo sapiens
MGLWKASSSLSCSVGTEMALGAQYPDKGHPPDKGHHPFPRAGLGKGRGRGENGGVSGQQWGYRLCLWLPWLRALAGPSFPTWSGRAAPQDQLARLLGPVGLCPVRRSLRKDRVRERLKPGPEKHHRNYSWKFPVDPDRLLLDTSRPICWLPTMVLPQF

SEQ ID NO: 920060 - protein, 308 aa, Homo sapiens
GVGGIYVSEKHTLTDMCWLLHQLITSRPMEYKWINQMTQSQTFPMTEMNFLNHPECEERRSDSPEENEEALATWWGPERTHLHQQLLGPPKTLGAFSTWGDLHWGPKWAALLPLVLTLTRHQMAQTPCFLHSRLLPGILYDEHFLGQQKAKVMPSLHKPFESQTTMRNMVYLRSAPSPGPAPPAACPRSPPRLRKWRGWRRCVLTPSSQAPTPHPSAGEESEKDQWLENGELSVVRVEAGERQQSLQRRQMAHWSLEENQEGLVVSVNQRREFQKEESTLADLDKMVSGGHRQLIIGVLWDYDFREAT

SEQ ID NO: 920061 - protein, 148 aa, Homo sapiens
PGSLMTLYVAVPDLDCALLDSGDMQGKKNETNKKTRLGLLHLPLAVMEFYATQILYLLQKCASQDGALELWCSIFRQTLWLLLLTAGFQPAVCQLALPSPITRQRVAVVSCVLTLCSLGPAPCFGPALKFYKHTLFLLSNCLKSQEVE

SEQ ID NO: 920062 - protein, 485 aa, Homo sapiens
RYLKSSLSSSKFHRSLGNSRKKFLFSLFPAYLMPVSNTGAQCLQCLCIVRVTLLHFPTNSSSPSETTSAWTLLSISLLTFWSKPFNKSLGSSKLSHIFLSSSEPSKLFQPLPVTHFQSCFHMFGYLYSSTPLYWYQLIVLVCSHTANKDIPETGIIYKGKRLNGLTVLHGWGGLTIMVEGKEVQKHVSHSGRQERACAGELPFIKPSDLMRLSHYHENSMGGTIPMIQLSAPGPTLDTWELLQCKISVKCSNQFKLEVCLLKSENKVVDNQAGTQGQLKVLGANLWWPYLMHEHPAYLYSWEVMVVWDLLKGGLLLPSGSPGFSRSPGQVNGQGRPDGAQAVGALTPGALAVIGAADCTEVTGAFDFYTLPVGLRTVPVTESQWALYVDVIRVNSYYSWYRNYGHLELIQLQLAAQFENCEEYQKSLLEQYHLGLNQKRRKYVVGELIWNFADFMTNQSKDEGKTGPHYGFTFGIHSLFQRRVKG

SEQ ID NO: 920063 - protein, 140 aa, Homo sapiens
AAQCMNHRMLKSTYENCNQSRELGSRLSELDRVFDVAPLMTCSSEDPAQKRQVCLPHGTENQCHFQPIQILTSPPSFNQGCFSLMLIHKCRGSHENAMTIYYSVLSFATVFLHGGYFKCICTAAKHRLHHIPGEGFLGPT

SEQ ID NO: 920064 - protein, 228 aa, Homo sapiens
PRPPHSAGRRRFASQEAASAWARAGRGGELPAQRQVRGGRLIPARTAPPRDKVQRWRGREWRRPESARNLSELKHPALSQRSMKKPFFPARPRGYGAITSPDTLLLVWGEERSRRTATLTWEEGGSRPSGAVVPSSLFPGLKNAWRRGLGAAGESKGCSTFESVGRIQPTVGNSSGHPAVQTPSQCLRVFRLGEDVGSGKVEEKVLVPLLFYVKEFQISSKILVLTLN

SEQ ID NO: 920065 - protein, 134 aa, Homo sapiens
PVAMERHVGFILSMMGNLWEILISATMKQTNTGTENQIPHVLTYKWELNMEYTWPQRREQQQQQQKETQRRENRHQGLLEGGGWKKGEDRKTIYQRMPGEYKFLNYFVNQLTEALTRLYKLLKSTDSPSFVKHS

SEQ ID NO: 920066 - protein, 200 aa, Homo sapiens
MAFRLVLELVQDVWDVWLYLISELWAWRSVCRGPGLGTKGEGPPLSRRGQNADRIPAPLSLRALNTIFPGHKSGDSRVFVVAELGDALELRAHSTGLLWYLCSEVEDRITRMEHRSCRITENLLRVVLTPLMSSVRVFVGWPATQQLSPTRRSSALAQTGMRGTECPGNRSWEQWGTVGYLNSQELGSERPRPAANLAKG

SEQ ID NO: 920067 - protein, 140 aa, Homo sapiens
MDRSNPVKPALDYFSNRLVNYQISVKCSNQFKLEVCLLNAENKVVDNQAGTQGQLKVLGANLWWPYLMHEHPAYLYSWEDGDCSHQSLGPLPACDLCDQLHLRSRQGGSVCGCDPCEQLLLLVSQLRAPGVDSAAAGRPV

SEQ ID NO: 920068 - protein, 140 aa, Homo sapiens; identical to SEQ ID NO: 920067

SEQ ID NO: 920069 - protein, 188 aa, Homo sapiens
MFSSLYPSGLRCSFLKIQGKDGHYRFRGPGFWKRRPPDDWMHFSLGLTLCRYSSSLLKITDRHLHLSPPTEWLHWQLSNELKECVWLTRGPHACMYGALSQLPYLQRGHDWCLPQRVVLRIKQNDVCETLGTVSGSWQEVSVTCLRPFVCLPVCFCKADPVQGTRDVVGATRDDDVPTLRELTLTRGQ

SEQ ID NO: 920070 - protein, 966 aa, Homo sapiens
STAAIRGHPKEGEGETDGAGESAGPLAEPVPNDLHFARMRILWTTAACAAWSLLFSPVRMRSSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQSVEALKIIFGERLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEASMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQVHATPARH

SEQ ID NO: 920071 - protein, 627 aa, Homo sapiens
STAAIRGHPKEGEGETDGAGESAGPLAEPVPNDLHFARMRILWTTAACAAWSLLFSPVRMRSSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQSVEALKIIFGERLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTCESRSGSF

SEQ ID NO: 920072 - protein, 3380 aa, Homo sapiens
NLTNQEGFAQMKERPKPAISEGMRDQLSDQDEEGKIKQEYIISDPSFSMVTVQREDSGITWETNSSRSSTPWASEESQTSGVCSREGSTVNSPPGNVSFIVDEVKKVRKRTHKSKHGSPSLRRKGNRKRNSFESQDVPTNKKGSPLTSASQVLTTEKEKSYTGIYDKARKKKTTSNTPPITGAIYKEHKPLVLRPVYIGTVQYKIKMFNSVKEELIPLQFYGTLPKGYVIKEIHYRKGKDASISLEPDLDNSGSNTVSKTRKLVAQSIEDKVKEVFPPWRGALSKGSESLTLMFSHEDQKKIYADSPLNATSALEHTVPSYSSSGRAEQGIQLRHSQSVPQQPEDEAKPHEVEPPSVTPDTPATMFLRTTKEECELASPGTAASENDSSVSPSFANEVKKEDVYSAHHSISLEAASPGLAASTQDGLDPDQEQPDLTSIERAEPVSAKLTPTHPSVKGEKEENMLEPSISLSEPLMLEEPEKEEIETSLPIAITPEPEDSNLVEEEIVELDYPESPLVSEKPFPPHMSPEVEHKEEELILPLLAASSPEHVALSEEEREEIASVSTGSAFVSEYSVPQDLNHELQEQEGEPVPPSNVEAIAEHAVLSEEENEEFEAYSPAAAPTSESSLSPSTTEKTSENQSPLFSTVTPEYMVLSGDEASESGCYTPDSTSASEYSVPSLATKESLKKTIDRKSPLILKGVSEYMIPSEEKEDTGSFTPAVAPASEPSLSPSTTEKTSECQSPLPSTATSEHVVPSEGEDLGSERFTPDSKLISKYAAPLNATQESQKKIINEASQFKPKGISEHTVLSVDGKEVIGPSSPDLVVASEHSFPPHTTEMTSECQAPPLSATPSEYVVLSTKRQSLNLKGASSPMNLSEEDQEDIGPFSPDSAFVSEFSFPPYATQEAEKREFECDSPICLTSPSEHTILSDEDTEEAELFSPDSASQVSIPPFRISETEKNELEPDSLLTAVSASGYSCFSEADEEDIGSTAATPVSEQFSSSQKQKAETFPLMSPLEDLSLPPSTDKSEKAEIKPEIPTTSTSVSEYLILAQKQKTQAYLEPESEDLIPSHLTSEVEKGEREASSSVAAIPAALPAQSSIVKEETKPASPHSVLPDSVPAIKKEQEPTAALTLKAADEQMALSKVRKEEIVPDSQEATAHVSQDQKMEPQPPNVPESEMKYSVLPDMVDEPKKGVKPKLVLNVTSELEQRKLSKNEPEVIKPYSPLKETSLSGPEVLSAVKMEMKHDSKITTTPIVLHSASSGVEKQVEHGPPALAFSALSEEIKKEIEPKVEAKEVKAGLPVIKTSSSQHSDKSEEARVEDKQDLVFSTVCDSERLVSSQKKSLMSTSEVLEPEHELPLSLWGEIKKKETELPSSQNVSPASKHIIPKGKDEETASSSPELENLASGLAPTLLLLSDDKNKPAVEVSSTAQGDFPSEKQDVALAELSLEPEKKDKPHQPLELPNAGSEFSSDLGRQSGSIGTKQAKSPITETEDSVSEKGPAELRSREGKEENRELCASSTMPAISELSSLLREESQNEEIKPFSPKIISLESKEPPASVAEGGNPEEFQPFTFSLKGLSEEVSHPADFKKGGNQEIGPLPPTGNLKAQVMGDILDKLSEETGHPNSSQVLQSITEPSKIAPSDLLVEQKKTEKALHSDQTVKLPDVSTSSEDKQDLGIKQFSLMRENLPLEQSKSFMTTKPADVKETKMEEFFISPKDENWMLGKPENVASQHEQRIAGSVQLDSSSSNELRPGQLKAAVSSKDHTCEVRKQVLPHSAEESHLSSQEAVSALDTSSGNTETLSSKSYSSEEVKLAEEPKSLVLAGNVERNIAEGKEIHSLMESESLLLEKANTELSWPSKEDSQEKIKLPPERFFQKPVSGLSVEQVKSETISSSVKTAHFPAEGVEPALGNEKEAHRSTPPFPEEKPLEESKMVQSKVIDDADEGKKPSPEVKIPTQRKPISSIHAREPQSPESPEVTQNPPTQPKVAKPDLPEEKGKKGISSFKSWMSSLFFGSSTPDNKVAEQEDLETQPSPSVEKAVTVIDPEGTIPTNFNVAEKPADHSLSEVKLKTADEPRGTLVKSGDGQNVKEKSMILSNVEDLQQPKFISEVSREDYGKKEISGDSEEMNINSVVTSADGENLEIQSYSLIGEKLVMEEAKTIVPPHVTDSKRVQKPAIAPPSKWNISIFKEEPRSDQKQKSLLSFDVVDKVPQQPKSASSNFASKNITKESEKPESIILPVEESKGSLIDFSEDRLKKEMQNPTSLKISEEETKLRSVSPTEKKDNLENRSYTLAEKKVLAEKQNSVAPLELRDSNEIGKTQITLGSRSTELKESKADAMPQHFYQNEDYNERPKIIVGSEKEKGEEKENQVYVLSEGKKQQEHQPYSVNVAESMSRESDISLGHSLDETQSFSLVKATSVTEKSEAMLAEAHPEIREAKAVGTQPHPLEESKVLVEKTKTFLPVALSCRDEIENHSLSQEGNLVLEKSSRDMPDHSEEKEQFRESELSKGGSVDITKETVKQGFQEKAVGTQPRPLEESKVLVEKTKTFLPVVLSCHDEIENHSLSQEGNLVLEKSSRDMPDHSEEKEQFKESELWKGGSVDITKESMKEGFPSKESERTLARPFDETKSSETPPYLLSPVKPQTLASGASPEINAVKKKEMPRSELTPERHTVHTIQTSKDDTSDVPKQSVLVSKHHLEAAEDTRVKEPLSSAKSNYAQFISNTSASNADKMVSNKEMPKEPEDTYAKGEDFTVTSKPAGLSEDQKTAFSIISEGCEILNIHAPAFISSIDQEESEQMQDKLEYLEEKASFKTIPLPDDSETVACHKTLKSRLEDEKVTPLKENKQKETHKTKEEISTDSETDLSFIQPTIPSEEDYFEKYTLIDYNISPDPEKQKAPQKLNVEEKLSKEVTEETISFPVSSVESALEHEYDLVKLDESFYGPEKGHNILSHPETQSQNSADRNVSKDTKRDVDSKSPGMPLFEAEEGVLSRTQIFPTTIKVIDPEFLEEPPALAFLYKDLYEEAVGEKKKEEETASEGDSVNSEASFPSRNSDTDDGTGIYFEKYILKDDILHDTSLTQKDQGQGLEEKRVGKDDSYQPIAAEGEIWGKFGTICREKSLEEQKGVYGEGESVDHVETVGNVAMQKKAPITEDVRVATQKISYAVPFEDTHHVLERADEAGSHGNEVGNASPEVNLNVPVQVSFPEEEFASGATHVQETSLEEPKILVPPEPSEERLRNSPVQDEYEFTESLHNEVVPQDILSEELSSESTPEDVLSQGKESFEHISENEFASEAEQSTPAEQKELGSERKEEDQLSSEVVTEKAQKELKKSQIDTYCYTCKCPISATDKVFGTHKDHEVSTLDTAISAVKVNRC

SEQ ID NO: 920073 - protein, 2002 aa, Homo sapiens
NLTNQEGFAQMKERPKPAISEGMRDQLSDQDEEGKIKQEYIISDPSFSMVTVQREDSGITWETNSSRSSTPWASEESQTSGVCSREGSTVNSPPGNVSFIVDEVKKVRKRTHKSKHGSPSLRRKGNRKRNSFESQDVPTNKKGSPLTSASQVLTTEKEKSYTGIYDKARKKKTTSNTPPITGAIYKEHKPLVLRPVYIGTVQYKIKMFNSVKEELIPLQFYGTLPKGYVIKEIHYRKGKDASISLEPDLDNSGSNTVSKTRKLVAQSIEDKVKEVFPPWRGALSKGSESLTLMFSHEDQKKIYADSPLNATSALEHTVPSYSSSGRAEQGIQLRHSQSVPQQPEDEAKPHEVEPPSVTPDTPATMFLRTTKEECELASPGTAASENDSSVSPSFANEVKKEDVYSAHHSISLEAASPGLAASTQDGLDPDQEQPDLTSIERAEPVSAKLTPTHPSVKGEKEENMLEPSISLSEPLMLEEPEKEEIETSLPIAITPEPEDSNLVEEEIVELDYPESPLVSEKPFPPHMSPEVEHKEEELILPLLAASSPEHVALSEEEREEIASVSTGSAFVSEYSVPQDLNHELQEQEGEPVPPSNVEAIAEHAVLSEEENEEFEAYSPAAAPTSESSLSPSTTEKTSENQSPLFSTVTPEYMVLSGDEASESGCYTPDSTSASEYSVPSLATKESLKKTIDRKSPLILKGVSEYMIPSEEKEDTGSFTPAVAPASEPSLSPSTTEKTSECQSPLPSTATSEHVVPSEGEDLGSERFTPDSKLISKYAAPLNATQESQKKIINEASQFKPKGISEHTVLSVDGKEVIGPSSPDLVVASEHSFPPHTTEMTSECQAPPLSATPSEYVVLSTKRQSLNLKGASSPMNLSEEDQEDIGPFSPDSAFVSEFSFPPYATQEAEKREFECDSPICLTSPSEHTILSDEDTEEAELFSPDSASQVSIPPFRISETEKNELEPDSLLTAVSASGYSCFSEADEEDIGSTAATPVSEQFSSSQKQKAETFPLMSPLEDLSLPPSTDKSEKAEIKPEIPTTSTSVSEYLILAQKQKTQAYLEPESEDLIPSHLTSEVEKGEREASSSVAAIPAALPAQSSIVKEETKPASPHSVLPDSVPAIKKEQEPTAALTLKAADEQMALSKVRKEEIVPDSQEATAHVSQDQKMEPQPPNVPESEMKYSVLPDMVDEPKKGVKPKLVLNVTSELEQRKLSKNEPEVIKPYSPLKETSLSGPEVLSAVKMEMKHDSKITTTPIVLHSASSGVEKQVEHGPPALAFSALSEEIKKEIEPKVEAKEVKAGLPVIKTSSSQHSDKSEEARVEDKQDLVFSTVCDSERLVSSQKKSLMSTSEVLEPEHELPLSLWGEIKKKETELPSSQNVSPASKHIIPKGKDEETASSSPELENLASGLAPTLLLLSDDKNKPAVEVSSTAQGDFPSEKQDVALAELSLEPEKKDKPHQPLELPNAGSEFSSDLGRQSGSIGTKQAKSPITETEDSVSEKGPAELRSREGKEENRELCASSTMPAISELSSLLREESQNEEIKPFSPKIISLESKEPPASVAEGGNPEEFQPFTFSLKGLSEEVSHPADFKKGGNQEIGPLPPTGNLKAQVMGDILDKLSEETGHPNSSQVLQSITEPSKIAPSDLLVEQKKTEKALHSDQTVKLPDVSTSSEDKQDLGIKQFSLMRENLPLEQSKSFMTTKPADVKETKMEEFFISPKDENWMLGKPENVASQHEQRIAGSVQLDSSSSNELRPGQLKAAVSSKDHTCEVRKQVLPHSAEESHLSSQEAVSALDTSSGNTETLSSKSYSSEEVKLAEEPKSLVLAGNVERNIAEGKEIHSLMESESLLLEKANTELSWPSKEDSQEKIKLPPERFFQKPVSGLSVEQVKSETISSSVKTAHFPAEGVEPALGNEKEAHRSTPPFPEEKPLEESKMVQSKVIDDADEGKKPSPEVKIPTQRKPISSIHAREPQSKDSSLISVDRQSTKWKGLEWLAPVTLG

SEQ ID NO: 920074 - protein, 3370 aa, Homo sapiens
NLTNQEGFAQMKERPKPAISEGMRDQLSDQDEEGKIKQEYIISDPSFSMVTVQREDSGITWETNSSRSSTPWASEESQTSGVCSREGSTVNSPPGNVSFIVDEVKKVRKRTHKSKHGSPSLRRKGNRKRNSFESQDVPTNKKGSPLTSASQVLTTEKEKSYTGIYDKARKKKTTSNTPPITGAIYKEHKPLVLRPVYIGTVQYKIKMFNSVKEELIPLQFYGTLPKGYVIKEIHYRKGKDASISLEPDLDNSGSNTVSKTRKLVAQSIEDKVKEVFPPWRGALSKGSESLTLMFSHEDQKKIYADSPLNATSALEHTVPSYSSSGRAEQGIQLRHSQSVPQQPEDEAKPHEVEPPSVTPDTPATMFLRTTKEECELASPGTAASENDSSVSPSFANEVKKEDVYSAHHSISLEAASPGLAASTQDGLDPDQEQPDLTSIERAEPVSAKLTPTHPSVKGEKEENMLEPSISLSEPLMLEEPEKEEIETSLPIAITPEPEDSNLVEEEIVELDYPESPLVSEKPFPPHMSPEVEHKEEELILPLLAASSPEHVALSEEEREEIASVSTGSAFVSEYSVPQDLNHELQEQEGEPVPPSNVEAIAEHAVLSEEENEEFEAYSPAAAPTSESSLSPSTTEKTSENQSPLFSTVTPEYMVLSGDEASESGCYTPDSTSASEYSVPSLATKESLKKTIDRKSPLILKGVSEYMIPSEEKEDTGSFTPAVAPASEPSLSPSTTEKTSECQSPLPSTATSEHVVPSEGEDLGSERFTPDSKLISKYAAPLNATQESQKKIINEASQFKPKGISEHTVLSVDGKEVIGPSSPDLVVASEHSFPPHTTEMTSECQAPPLSATPSEYVVLSTKRQSLNLKGASSPMNLSEEDQEDIGPFSPDSAFVSEFSFPPYATQEAEKREFECDSPICLTSPSEHTILSDEDTEEAELFSPDSASQVSIPPFRISETEKNELEPDSLLTAVSASGYSCFSEADEEDIGSTAATPVSEQFSSSQKQKAETFPLMSPLEDLSLPPSTDKSEKAEIKPEIPTTSTSVSEYLILAQKQKTQAYLEPESEDLIPSHLTSEVEKGEREASSSVAAIPAALPAQSSIVKEETKPASPHSVLPDSVPAIKKEQEPTAALTLKAADEQMALSKVRKEEIVPDSQEATAHVSQDQKMEPQPPNVPESEMKYSVLPDMVDEPKKGVKPKLVLNVTSELEQRKLSKNEPEVIKPYSPLKETSLSGPEVLSAVKMEMKHDSKITTTPIVLHSASSGVEKQVEHGPPALAFSALSEEIKKEIEPKVEAKEVKAGLPVIKTSSSQHSDKSEEARVEDKQDLVFSTVCDSERLVSSQKKSLMSTSEVLEPEHELPLSLWGEIKKKETELPSSQNVSPASKHIIPKGKDEETASSSPELENLASGLAPTLLLLSDDKNKPAVEVSSTAQGDFPSEKQDVALAELSLEPEKKDKPHQPLELPNAGSEFSSDLGRQSGSIGTKQAKSPITETEDSVSEKGPAELRSREGKEENRELCASSTMPAISELSSLLREESQNEEIKPFSPKIISLESKEPPASVAEGGNPEEFQPFTFSLKGLSEEVSHPADFKKGGNQEIGPLPPTGNLKAQVMGDILDKLSEETGHPNSSQVLQSITEPSKIAPSDLLVEQKKTEKALHSDQTVKLPDVSTSSEDKQDLGIKQFSLMRENLPLEQSKSFMTTKPADVKETKMEEFFISPKDENWMLGKPENVASQHEQRIAGSVQLDSSSSNELRPGQLKAAVSSKDHTCEVRKQVLPHSAEESHLSSQEAVSALDTSSGNTETLSSKSYSSEEVKLAEEPKSLVLAGNVERNIAEGKEIHSLMESESLLLEKANTELSWPSKEDSQEKIKLPPERFFQKPVSGLSVEQVKSETISSSVKTAHFPAEGVEPALGNEKEAHRSTPPFPEEKPLEESKMVQSKVIDDADEGKKPSPEVKIPTQRKPISSIHAREPQSPESPEVTQNPPTQPKVAKPDLPEEKGKKGISSFKSTPDNKVAEQEDLETQPSPSVEKAVTVIDPEGTIPTNFNVAEKPADHSLSEVKLKTADEPRGTLVKSGDGQNVKEKSMILSNVEDLQQPKFISEVSREDYGKKEISGDSEEMNINSVVTSADGENLEIQSYSLIGEKLVMEEAKTIVPPHVTDSKRVQKPAIAPPSKWNISIFKEEPRSDQKQKSLLSFDVVDKVPQQPKSASSNFASKNITKESEKPESIILPVEESKGSLIDFSEDRLKKEMQNPTSLKISEEETKLRSVSPTEKKDNLENRSYTLAEKKVLAEKQNSVAPLELRDSNEIGKTQITLGSRSTELKESKADAMPQHFYQNEDYNERPKIIVGSEKEKGEEKENQVYVLSEGKKQQEHQPYSVNVAESMSRESDISLGHSLDETQSFSLVKATSVTEKSEAMLAEAHPEIREAKAVGTQPHPLEESKVLVEKTKTFLPVALSCRDEIENHSLSQEGNLVLEKSSRDMPDHSEEKEQFRESELSKGGSVDITKETVKQGFQEKAVGTQPRPLEESKVLVEKTKTFLPVVLSCHDEIENHSLSQEGNLVLEKSSRDMPDHSEEKEQFKESELWKGGSVDITKESMKEGFPSKESERTLARPFDETKSSETPPYLLSPVKPQTLASGASPEINAVKKKEMPRSELTPERHTVHTIQTSKDDTSDVPKQSVLVSKHHLEAAEDTRVKEPLSSAKSNYAQFISNTSASNADKMVSNKEMPKEPEDTYAKGEDFTVTSKPAGLSEDQKTAFSIISEGCEILNIHAPAFISSIDQEESEQMQDKLEYLEEKASFKTIPLPDDSETVACHKTLKSRLEDEKVTPLKENKQKETHKTKEEISTDSETDLSFIQPTIPSEEDYFEKYTLIDYNISPDPEKQKAPQKLNVEEKLSKEVTEETISFPVSSVESALEHEYDLVKLDESFYGPEKGHNILSHPETQSQNSADRNVSKDTKRDVDSKSPGMPLFEAEEGVLSRTQIFPTTIKVIDPEFLEEPPALAFLYKDLYEEAVGEKKKEEETASEGDSVNSEASFPSRNSDTDDGTGIYFEKYILKDDILHDTSLTQKDQGQGLEEKRVGKDDSYQPIAAEGEIWGKFGTICREKSLEEQKGVYGEGESVDHVETVGNVAMQKKAPITEDVRVATQKISYAVPFEDTHHVLERADEAGSHGNEVGNASPEVNLNVPVQVSFPEEEFASGATHVQETSLEEPKILVPPEPSEERLRNSPVQDEYEFTESLHNEVVPQDILSEELSSESTPEDVLSQGKESFEHISENEFASEAEQSTPAEQKELGSERKEEDQLSSEVVTEKAQKELKKSQIDTYCYTCKCPISATDKVFGTHKDHEVSTLDTAISAVKVNRC

SEQ ID NO: 920075 - protein, 1906 aa, Homo sapiens
SADEHSVLAEEDKVAIKGASPIETSSKHLAVVRGREGKEENRELCASSTMPAISELSSLLREESQNEEIKPFSPKIISLESKEPPASVAEGGNPEEFQPFTFSLKGLSEEVSHPADFKKGGNQEIGPLPPTGNLKAQVMGDILDKLSEETGHPNSSQVLQSITEPSKIAPSDLLVEQKKTEKALHSDQTVKLPDVSTSSEDKQDLGIKQFSLMRENLPLEQSKSFMTTKPADVKETKMEEFFISPKDENWMLGKPENVASQHEQRIAGSVQLDSSSSNELRPGQLKAAVSSKDHTCEVRKQVLPHSAEESHLSSQEAVSALDTSSGNTETLSSKSYSSEEVKLAEEPKSLVLAGNVERNIAEGKEIHSLMESESLLLEKANTELSWPSKEDSQEKIKLPPERFFQKPVSGLSVEQVKSETISSSVKTAHFPAEGVEPALGNEKEAHRSTPPFPEEKPLEESKMVQSKVIDDADEGKKPSPEVKIPTQRKPISSIHAREPQSPESPEVTQNPPTQPKVAKPDLPEEKGKKGISSFKSWMSSLFFGSSTPDNKVAEQEDLETQPSPSVEKAVTVIDPEGTIPTNFNVAEKPADHSLSEVKLKTADEPRGTLVKSGDGQNVKEKSMILSNVEDLQQPKFISEVSREDYGKKEISGDSEEMNINSVVTSADGENLEIQSYSLIGEKLVMEEAKTIVPPHVTDSKRVQKPAIAPPSKWNISIFKEEPRSDQKQKSLLSFDVVDKVPQQPKSASSNFASKNITKESEKPESIILPVEESKGSLIDFSEDRLKKEMQNPTSLKISEEETKLRSVSPTEKKDNLENRSYTLAEKKVLAEKQNSVAPLELRDSNEIGKTQITLGSRSTELKESKADAMPQHFYQNEDYNERPKIIVGSEKEKGEEKENQVYVLSEGKKQQEHQPYSVNVAESMSRESDISLGHSLDETQSFSLVKATSVTEKSEAMLAEAHPEIREAKAVGTQPHPLEESKVLVEKTKTFLPVALSCRDEIENHSLSQEGNLVLEKSSRDMPDHSEEKEQFRESELSKGGSVDITKETVKQGFQEKAVGTQPRPLEESKVLVEKTKTFLPVVLSCHDEIENHSLSQEGNLVLEKSSRDMPDHSEEKEQFKESELWKGGSVDITKESMKEGFPSKESERTLARPFDETKSSETPPYLLSPVKPQTLASGASPEINAVKKKEMPRSELTPERHTVHTIQTSKDDTSDVPKQSVLVSKHHLEAAEDTRVKEPLSSAKSNYAQFISNTSASNADKMVSNKEMPKEPEDTYAKGEDFTVTSKPAGLSEDQKTAFSIISEGCEILNIHAPAFISSIDQEESEQMQDKLEYLEEKASFKTIPLPDDSETVACHKTLKSRLEDEKVTPLKENKQKETHKTKEEISTDSETDLSFIQPTIPSEEDYFEKYTLIDYNISPDPEKQKAPQKLNVEEKLSKEVTEETISFPVSSVESALEHEYDLVKLDESFYGPEKGHNILSHPETQSQNSADRNVSKDTKRDVDSKSPGMPLFEAEEGVLSRTQIFPTTIKVIDPEFLEEPPALAFLYKDLYEEAVGEKKKEEETASEGDSVNSEASFPSRNSDTDDGTGIYFEKYILKDDILHDTSLTQKDQGQGLEEKRVGKDDSYQPIAAEGEIWGKFGTICREKSLEEQKGVYGEGESVDHVETVGNVAMQKKAPITEDVRVATQKISYAVPFEDTHHVLERADEAGSHGNEVGNASPEVNLNVPVQVSFPEEEFASGATHVQETSLEEPKILVPPEPSEERLRNSPVQDEYEFTESLHNEVVPQDILSEELSSESTPEDVLSQGKESFEHISENEFASEAEQSTPAEQKELGSERKEEDQLSSEVVTEKAQKELKKSQIDTYCYTCKCPISATDKVFGTHKDHEVSTLDTAISAVKVNRC

SEQ ID NO: 920076 - protein, 130 aa, Homo sapiens
LSSNMAGWRKRNVTEHIKGDVSPGRLTTLVGSSHDQRCCMTHGSTSFPALLWQEGKMLCFSLMNCASYDSVGQPVSIDLFLVDTVGQKALLTTEARVKCALTTISKVNDGALIMGQEADACMLFHTAPFY

SEQ ID NO: 920077 - protein, 259 aa, Homo sapiens
MFPLWGSEEDKKMWESVVLPRDLLNGFDQGADSDVDNKAQAEVISDRNEELVGNWSKAAEICITNEEPNVNHQDNGENVPRACQKSSWQPLPSQAWRPRRKKWFCGLDTGSLCCVQPRDLVPCTAATPALAKRGQCRARATVSEGASLKPLQLTCGVEPMSAQKAVQKGNVGWEPPHRVPTGALPGGDIRRRPPSSRPQNGRSTYSLHCVTGKDVDTQHQPMKAAMREAVLCKTTEVELLKTMGIHLLHKRDQGKDENV

SEQ ID NO: 920078 - protein, 942 aa, Homo sapiens
KRDSQRAPEAVLCLQLWQRTVPLDTLKGLGTCFPSGPELRGAGIAAAMERASERRTASALFAGFRALGLFSNDIPHVVRFSALKRRFYVTTCVGKSFHTYDVQKLSLVAVSNSVPQDICCMAADGRLVFAAYGNVFSAFARNKEIVHTFKGHKAEIHFLQPFGDHIISVDTDGILIIWHIYSEEEYLQLTFDKSVFKISAILHPSTYLNKILLGSEQGSLQLWNVKSNKLLYTFPGWKVGVTALQQAPAVDVVAIGLMSGQVIIHNIKFNETLMKFRQDWGPITSISFRTDGHPVMAAGSPCGHIGLWDLEDKKLINQMRNAHSTAIAGLTFLHREPLLVTNGADNALRIWIFDGPTGEGRLLRFRMGHSAPLTNIRYYGQNGQQILSASQDGTLQSFSTVHEKFNKSLGHGLINKKRVKRKGLQNTMSVRLPPITKFAAEEARESDWDGIIACHQGKLSCSTWNYQKSTIGAYFLKPKELKKDDITATAVDITSCGNFAVIGLSSGTVDVYNMQSGIHRGSFGKDQAHKGSVRGVAVDGLNQLTVTTGSEGLLKFWNFKNKILIHSVSLSSSPNIMLLHRDSGILGLALDDFSISVLDIETRKIVREFSGHQGQINDMAFSPDGRWLISAAMDCSIRTWDLPSGCLIDCFLLDSAPLNVSMSPTGDFLATSHVDHLGIYLWSNISLYSVVSLRPLPADYVPSIVMLPGTCQTQDVEVSEETVEPSDELIEYDSPEQLNEQLVTLSLLPESRWKNLLNLDVIKKKNKPKEPPKVPKSAPFFIPTIPGLVPRYAAPEQNNDPQQSKVVNLGVLAQKSDFCLKLEEGLVNNKYDTALNLLKESGPSGIETELRSLSPDCGGSIEVMQSFLKMIGMMLDRKRDFELAQAYLALFLKLHLKMLPSEPVLLEEITNLSSQVEENWTHLQSLFNQSMCILNYLKSALL

SEQ ID NO: 920079 - protein, 942 aa, Homo sapiens; identical to SEQ ID NO: 920078

SEQ ID NO: 920080 - protein, 942 aa, Homo sapiens; identical to SEQ ID NO: 920078

SEQ ID NO: 920081 - protein, 146 aa, Homo sapiens
MSLLKSCIALKVCVHFSGERICSVHHIFQRSLKSGKPTIYCSAPNSLFFSEEKGEKIKASTGWSCFDSPVDSDEIRESCWQLPSILTLNEQYRVSTALLIVHQFDGLTMVQVEAGRGVCQVAETDTALGCRLVTMRLTSPRLQVGL

SEQ ID NO: 920082 - protein, 146 aa, Homo sapiens; identical to SEQ ID NO: 920081

SEQ ID NO: 920083 - protein, 148 aa, Homo sapiens
RKTHLQEAPSSMWVGTIRSAASTTRKSRQKKVEEDDLLSLLAFIFLFCWMLPALKHQTPRSSAFGLLDLHQWYARGSPAFSHRLKAALVKLKCDFCSSPANCSIKDWKYCEKRKRERNVLIIHNILLLPTANLTTAGKKQQKQTNKKT

SEQ ID NO: 920084 - protein, 148 aa, Homo sapiens; identical to SEQ ID NO: 920083

SEQ ID NO: 920085 - protein, 150 aa, Homo sapiens
MVLGKVKSLTISFDCLNDSNVPVYSSGDTVSGRVNLEVTGEIRVKSLKIHARGHAKVRWTESRNAGSNTAYTQNYTEEVEYFNHKDILIGHERGNRRAPVKVPPERPPPSPYSRLFPGFWGRPARVNIMFCRPSFGPPKGHRKETTSGFN

SEQ ID NO: 920086 - protein, 206 aa, Homo sapiens
MVLGKVKSLTISFDCLNDSNVPVYSSGDTVSGRVNLEVTGEIRVKSLKIHARGHAKVRWTESRNAGSNTAYTQNYTEEVEYFNHKDILIGHERDDDNSEEGFHTIHSGRHEYAFSFELPQTPLATSFEGRHGSVRYWVKAELHRPWLLPVKLKKEFTVFEHIDINTPSLLSPQAGTKEKTLCCWFCTSGPISLSAKIERKGYTPGM

SEQ ID NO: 920087 - protein, 247 aa, Homo sapiens
MVLGKVKSLTISFDCLNDSNVPVYSSGDTVSGRVNLEVTGEIRVKSLKIHARGHAKVRWTESRNAGSNTAYTQNYTEEVEYFNHKDILIGHERDDDNSEEGFHTIHSGRHEYAFSFELPQTPLATSFEGRHGSVRYWVKAELHRPWLLPVKLKKEFTVFEHIDINTPSLLSPQAGTKEKTLCCWFCTSGPISLSAKIERKGYTPGESIQIFAEIENCSSRMVVPKAAIYQHRPSMPRENEGSNTACG

SEQ ID NO: 920088 - protein, 270 aa, Homo sapiens
MHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALEVYIANHMEAFCVICYCCCC

SEQ ID NO: 920089 - protein, 130 aa, Homo sapiens
SLDMLSSCKHKSTRERVGTHAAPEDVETSANAALVKAAPMAKPNTKGQIILLWLPIHMVKPRMDHYECDKNESQVEGDKAVRVNKMEIGKALNTFVSSGETSREEVTEDIEKTSGKWMSKIPEKLRSRDL

SEQ ID NO: 920090 - protein, 172 aa, Homo sapiens
MRQEKMFAENTCFGIEQNPLVQYGWRNSFFFFLFGGSSLELLSVLVLLLLEELESESESEEEEEVVEEAEDEELEELSSMSLSSEEDEANAVEPHISSKMIKLEVFNKLPKAKCGIVNQCEDSSFCRHMGVVCLQKPGSSHWYTIQHLLHYYTVKFFAGFPSMITTGCSQIR

SEQ ID NO: 920091 - protein, 323 aa, Homo sapiens
MEHPSKMEFFQKLGYDREDVLRVLGKLGEGALVNDVLQELIRTGSRPGALEHPAAPRLVPRGSCGVPDSAQRGPGTALEEDFRTLASSLRPIVIDGSNPNAIGRAWLNPEDLAAALWRLTEWATGPVLFTEMGSPKQDYWHHSSFCKRWVNVMRTPSDDVGRVEDGDLVNRPMAAPSFAGPLAVPHKGNQGSQKYRTARPGLPNTTPRSEGKAHPCPVPTEPLATCDTVIQDIRREITLRNTCCVSMISLFSHCSHGNKETFSCRGIKLAVDWFRDRGHTYIKVFVPSWRKDPPRADTPIRGMLEQMYAQEEVNSHNGRLLPS

SEQ ID NO: 920092 - protein, 323 aa, Homo sapiens; identical to SEQ ID NO: 920091

SEQ ID NO: 920093 - protein, 188 aa, Homo sapiens
RVSSCTIQSCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQVRVPAAGPQLKVGTLFTCSF

SEQ ID NO: 920094 - protein, 564 aa, Homo sapiens
PSRSFMVPHTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQSVVQYEQYEQEMKHLQQLIEGAHREIEDKPVATSNIQELQAQISRHEKPLIRPHPLISPFVPTRGRGLGHFGCACAAPRSLRSGSVARCRRTRRLHILPPGPARLCALIGSPCRKMNATTSELAQKIKGYQEQIASLNSKCKMLTMKAKHATMLLTVTEVEGLAEGTEDLDGELLPTPSAHPSVVMVFLDGREKVNKAREDVNRPRSLKKQFMGFSESVGESGLSSETGKHKIRLSQSEFILPHDTATFVSQTAGAFFNTFYQYMILNKTQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQLVVVVLAITAVRRYS

SEQ ID NO: 920095 - protein, 458 aa, Homo sapiens
MHSRRERARGLRGAHHPLVDNGPPQSLRAPPLLSPLKTAGAKSIWEPLASARSLVWETPANPGSHFVVPGRPETPERTPLQKTPEQVPTNFMGALHMKTSAPLSSRNGEGRRGGTSVASCPWVVGAVCSAERQPCTQRICKLRKGAFGSVRAFSLRSPAALRLADLYPTGGWRPKQNSPGRCLPLAPHVPRAHRKLQQNKQLTTGIPLSAARRLPAGKISRKPRGRGAEGRQRGARPSPPGGGQRDSGREGGSASGAALPVLRLQNELWERSCALPASPISPPSRGEGGEPNPSAPRTPAASSRQLSPQSASNRGEQRPSSPPGNPYIATLPPAGAIRLIPALRTAGGGRRRPPRPGPGSVLSSPSPHHTQSCTKTPFTPPAPPSAPPSGPAALPSPTRGTSRFLVGDCATRRQAGRQRTRAGCSHSAPRPRRQMRCPPPRSLAARRQPQNAHLSLRK

SEQ ID NO: 920096 - protein, 458 aa, Homo sapiens; identical to SEQ ID NO: 920095

SEQ ID NO: 920097 - protein, 458 aa, Homo sapiens; identical to SEQ ID NO: 920095

SEQ ID NO: 920098 - protein, 458 aa, Homo sapiens; identical to SEQ ID NO: 920095

SEQ ID NO: 920099 - protein, 458 aa, Homo sapiens; identical to SEQ ID NO: 920095

SEQ ID NO: 920100 - protein, 458 aa, Homo sapiens; identical to SEQ ID NO: 920095

SEQ ID NO: 920101 - protein, 145 aa, Homo sapiens
CGIRPQMTNWQPTGHVRPTDMSCLAHNKLPGGCLSHMKALAAVVERIIHGDLQLYCYYHRETAETKEGILIESKPGRKDALALTCNRSICAMAWRDEVENPCLIGIPDHRLHEGCLLQHSRDSRLWAYCSVSCDKNLKSEPDFRT

SEQ ID NO: 920102 - protein, 145 aa, Homo sapiens; identical to SEQ ID NO: 920101

SEQ ID NO: 920103 - protein, 222 aa, Homo sapiens
MKKGGLIDSQFHRLNRKHDWEASENLQLWQKATGKAKPYHSLRGDNVLAALAGLRSLLGLGVCSGWAQGALQPATALWGPLSGAGRSWSQLPLLAGRCGGGGAGGNRGCTRTSWADTGSCFTPEASETMNPLEGMNNSRRAALKSLTLTAKVCSSPPEVSETMNPPEGINSGHIGTSDGTNSRHTIFKNCNTQPGLKGDFREELTEEIHSRISPFSPHHGQA

SEQ ID NO: 920104 - protein, 913 aa, Homo sapiens
MEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQESLDNNLEALKNQLRQLENVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQTCYYVFDLRNVFVFWIHSR

SEQ ID NO: 920105 - protein, 598 aa, Homo sapiens
MEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQESLDNNLEALKNQLRQLENVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSAADEGGVSQMRGSSR

SEQ ID NO: 920106 - protein, 158 aa, Homo sapiens
MNTCYLGRQDSQLMTCLRNSQQLVGGERNRLDLGGPGLMWISYCRRRSASEGCVPMTTSDSMMGTPGVQTDSTVQLCSGEEELWCSQSIGHNTLMRGFHLKHIVSVVTVGFVLTRTCQKPYQGAHTTLGSNTGGGVAEFNFMKAGVSICFLHHCIPNI

SEQ ID NO: 920107 - protein, 151 aa, Homo sapiens
MTVSTSPSKHTVHSPFLMPAGSGGENTGDTGGLSGELGAVTAEREKRTYVNNVSLRDDSDAEEDWLTLKVISESLSSWEPLRDPDGVVVAGLDCRVPEAQRDSIRGSGRKEGTHSIHWEGSLELEEPTRGKGLPESDANTEASRALSWKER

SEQ ID NO: 920108 - protein, 228 aa, Homo sapiens
MFIHHSSVLIKDILVAGQITFTKPTTEKFTKDVVDSVIAVLFSSEKGQNKQVTSKVTEQMLNCLLEDLCRRRDQASPPTGVHRKWCHTCAEVSRPASTTSNPLSELPSCMGWQCPHSTAENLYYVEQCEDSRSEAASNWSGSSGSSKLQYGPLASIPGGYDADISRVFNGNNGTSCQQKLLPGPLQIYDIDADIKGSVHCKSFPLSYNRNLEHRHMDPSLGSTKKPIL

SEQ ID NO: 920109 - protein, 103 aa, Homo sapiens
MGSRSRNGLGNFNCGSTCWCGLGQRRRTNLVCKLNTRTTILAATNPKGQYDPQESVSVNIALGSPLLSRFDLILVLLDTKNEDWDRIISSFILENKGYVKTNK

SEQ ID NO: 920110 - protein, 211 aa, Homo sapiens
NSRPRRTRLTRRRQKLILVLLDTKNEDWDRIISSFILENKGYPSKSEKLWSMEKMKTYFCLIRNLQPTLSDVGNQVLLRYYQMQRQSDCRNAARTTIRLLESLIRLAEAHARLMFRDTVTLEDAITVVSVMESSMQGGALLGGVNALHTSFPENPGEQYQRQCELILEKLELQSLLSEELRRLESDCEHHPHQHFSVHFSGYQTFRQARWG

SEQ ID NO: 920111 - protein, 253 aa, Homo sapiens
MSEYTEMNCTVSPGSLVCKLNTRTTILAATNPKGQYDPQESVSVNIALGSPLLSRFDLILVLLDTKNEDWDRIISSFILENKGYPSKSEKLWSMEKMKTYFCLIRNLQPTLSDVGNQVLLRYYQMQRQSDCRNAARTTIRLLESLIRLAEAHARLMFRDTVTLEDAITVVSVMESSMQGGALLGGVNALHTSFPENPGEQYQRQCELILEKLELQSLLSEELRRLESDCEHHPHQHFSVHFSGYQTFRQARWG

SEQ ID NO: 920112 - protein, 155 aa, Homo sapiens
MGFPLVAAYTLDCLLALQDEIPLWGEGGHNRTGICKFIEDPTLSLNPSFAYWRCCPSELGMLASFVLKPETPLLRFPPITFWVSYYISWAQLSYLETRILIATLKHGCKEEMKSLCGNAKPSAWHRAGAQRPRIWEKEHALGSKVLFLSLSHSSH

SEQ ID NO: 920113 - protein, 155 aa, Homo sapiens; identical to SEQ ID NO: 920112

SEQ ID NO: 920114 - protein, 155 aa, Homo sapiens; identical to SEQ ID NO: 920112

SEQ ID NO: 920115 - protein, 437 aa, Homo sapiens
NSFCNGVTFTQRPIRLYEQVRLRLVAVRPGWSGALRFGFTAHDPSLMSAQDIPKYACPDLVTRPGYWAKALPENLALRDTVLAYWADRHGRVFYSVNDGEPVLFHCGVAVGGPLWALIDVYGITDEVQLLESAFADTLTPARLSQARFSACLPPSSHDAANFDNNELENNQVVAKLGHLALGRAPGPPPADAAAAAIPCGPRERPRPASSPALLEADLRFHATRGPDVSLSADRKVACAPRPDGGRTLVFSERPLRPGESLFVEVGRPGLAAPGALAFGITSCDPGVLRPNELPADPDALLDRKEYWVVARAGPVPSGGDALSFTLRPGGDVLLGINGRPRGRLLCVDTTQALWAFFAVRGGVAGQLRLLGAAPPEASPRFPTLSARARSTPSKIAGLHPRVPDSVGARCAPRTCISDKCPEMLTKWNGGLNHPILR

SEQ ID NO: 920116 - protein, 151 aa, Homo sapiens
MVGMNLASNSLRRVVFLWQYQGCKGECVPGLVQVHLEAWVPSGTESRKICYYALKGIVINTKFYARQPRPYPGRGLKRHSWKGFGTKYSLDSGTPDNSWARTGGHLRNEVSVKACTPTIRIPDPSPVGSQDTGREVYILQAEDGRFSLQGK

SEQ ID NO: 920117 - protein, 221 aa, Homo sapiens
MWTEGQWDMSGDMWFLSRQGPPPPLCPHGNPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGGKTRPCRDRS

SEQ ID NO: 920118 - protein, 217 aa, Homo sapiens
AASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGGKTRPCRDRS

SEQ ID NO: 920119 - protein, 184 aa, Homo sapiens
QLLDSWTYTSGLVGAPPPMAKRGQATAWAMASEGASLKAWQLPHGIGLAGVQKTKIEIWEPLPKFQTTYGNAWMSRVPTGALPSGAVRRGPPSSRSQNGRSTNSLHLVLGKAIGTQRQSVKAAMGAIPCRATEAELPKAVGGHPLHQCAMDVRHRVKGDSYGALRLNGSPAGFWTHMGPVAPLF

SEQ ID NO: 920120 - protein, 339 aa, Homo sapiens
SSPSRLGSQAEGLLTSQTMGGQAETLLTSQTGLRAATFRLFPQLLMTLLIQIHHSIGLTMSDVDIPSGLYTEQEVPSEKVMYLLVPLLNRGNDKHKLTSAGFFVELLRSPVAKRLPSIYSVARFKDWLQDGNHLFRILGLRGLYNLVGHQEMREDIKSLLPYIVDSLRETDEKIVLSAIQILLQLVRTMDFTTLAAMMRTLFSLFGDVRSDVHRFSVTLFGAAIKSVKNPDKKSIENQVLDSLVPLLLYSQDENDAVAEDVDQEEISPLEFLPSNPEMPQGQKTNTDVLQEPKTSHQKISSLVCLLSKYMDHNELRRMGTDWIEDDLRGFYLQPVFAYR

SEQ ID NO: 920121 - protein, 131 aa, Homo sapiens
MGPRGTAEFGPGSEKMPHSVPFLHGSKEDNFNPLRKGFGARNQKKLSLRESQLKKGSHGLLYQGCYGLVWMCTVGEYTTESPQMEPICQQLDFGLLASKTVRKQIPVVSVHRHTVVFLFVKESATISKAAH

SEQ ID NO: 920122 - protein, 411 aa, Homo sapiens
MLNLPIGGEAPDSLLVMAEHGIQNNSTGEDKASIVVRVLSKDKSRYGCLGSAARSALPTWPLEARLPSPAPRLLGTVKAAACHRLLQPFSSSTTSPPSWSSEDQPSWRRGGNVPRQPTILGFSLEQAWARTLGDLCVHGINLNEIRHNIINDWLGKVFTKHLPPRLLSLNLGGHLNSVDLQGQLSRNRAQAVTATGVRCQLWRFRVFEGNQVVEQVLVWKLEGDLEAQNSQHEKLTLHNAVPELPEAGFQFQGLTARVKVPVGHIDDVMSPQVLLFRFAGQVNGRHGNQLDTCLHDEPRHSEVHPGFGRRLPLGAPRCRPPSAALRGFHEARRPRRKERLLCAQRPAERGGGSRCIFPLRGSHWRLILVQPVPAKQKAKALAHGEVSHGICHRLDVAGTFPRREIFTIVNF

SEQ ID NO: 920123 - protein, 417 aa, Homo sapiens
MSLSKKLTLDKLDVRGKRVIMRVDFNVPMKKNQITNNQRIKASIPSIKYCLDNGAKAVVLMSHLGRPDGVPMPDKYSLAPVAVELKSLLGKDVLFLKDCVGAEVEKACANPAPGSVILLENLRFHVEEEGKGQDPSGKKIKAEPDKIEAFRASLSKLGDVYVNDAFGTAHRAHSSMVGVNLPHKASGFLMKKELDYFAKALENPVRPFLAILGGAKVADKIQLIKNMLDKVNEMIIGGGMAYTFLKVLNNMEIGASLFDEEGAKIVKDIMAKAQKNGVRITFPVDFVTGDKFDENAQVGKATVASGISPGWMGLDCGPESNKNHAQVVAQARLIVWNGPLGVFEWDAFAKGTKALMDEIVKATSKGCITVIGGGDTATCCAKWNTEDKVSHVSTGGGASLELLEGKILPGVEALSNM

SEQ ID NO: 920124 - protein, 417 aa, Homo sapiens; identical to SEQ ID NO: 920123

SEQ ID NO: 920125 - protein, 188 aa, Homo sapiens
MMHPVASSNPAFCGPGKPSCLNEDAMRAADQFDIYSSQQSKYSHTVNHKPMVCQRQDPLNETHLQTTSGRSIEIKDELKKKKNLNRSGKRGRPSGTTKSAGYRTSTGRPLGTTKAAGFKTSPGRPLGTTKAAGYKVSPGRPPGSIKALSRLADLGYGCGTAAFPYPMMHGRAVHGVEETSSEVKPPNE

SEQ ID NO: 920126 - protein, 97 aa, Homo sapiens
VGGGRSGLAMRVSVCVRGPRELAHAASEHYRVVAASSYCVRGRTVRGGRGGCWEPAPASPPPSLPATPSWPVLRTVQRRRAGEGAAPARGSQPLGSP

SEQ ID NO: 920127 - protein, 188 aa, Homo sapiens; identical to SEQ ID NO: 920125

SEQ ID NO: 920128 - protein, 188 aa, Homo sapiens; identical to SEQ ID NO: 920125

SEQ ID NO: 920129 - protein, 130 aa, Homo sapiens
MCRPIIKTFRGGAGCVAMASAEWTFRVIEKMMHPVASSNPAFCGPGKPSCLNEDAMRAADQFDIYSSQQSKYSHTVNHKPMVCQRQDPLNETHLQTTSGRSIEIKDELKKKKNLNRSGKKQQAFRCSSDA

SEQ ID NO: 920130 - protein, 188 aa, Homo sapiens; identical to SEQ ID NO: 920125

SEQ ID NO: 920131 - protein, 31 aa, Homo sapiens
MVLGFSAETPRVASLRTGKPGGVGDPRAKLA

SEQ ID NO: 920132 - protein, 106 aa, Homo sapiens
MMHPVASSNPAFCGPGKPSCLNEDAMRAADQFDIYSSQQSKYSHTVNHKPMVCQRQDPLNETHLQTTSGRSIEIKDELKKKKNLNRSGKRGRPSGTTKSRQTFGDN

SEQ ID NO: 920133 - protein, 155 aa, Homo sapiens
MMHPVASSNPAFCGPGKPSCLNEDAMRAADQFDIYSSQQSKYSHTVNHKPMVCQRQDPLNETHLQTTSGRSIEIKDELKKKKNLNRSGKRGRPSGTTKSAGYRTSTGRPLGTTKAAGFKTSPGRPLGTTKAAGYKVSPGRPPGKKQQAFRCSSDA

SEQ ID NO: 920134 - protein, 130 aa, Homo sapiens; identical to SEQ ID NO: 920129

SEQ ID NO: 920135 - protein, 513 aa, Homo sapiens
MNSDQVTLVGQVFESYVSEYHKNDILLILKERDEDAHYPVVVNAMTLFETNMEIGEYFNMFPSEVLTIFDSALRRSALTILQSLSQPEAVSMKQNLHARISGLPVCPELVREHIPKTKDVGHFLSVTGTVIRTSLVKVLEFERDYMCNKCKHVFVIKADFEQYYTFCRPSSCPSLESCDSSKFTCLSGLSSSPTRCRDYQEIKIQEQVQRLSVGSIPRSMKVILEDDLVDSCKSEMGLTGNGYSSKDAADDIGAQRDWIVENKMCCCEVEIVLKANYIQVNNEQSSGIIMDEEVQKEFEDFWEYYKSDPFAGRNVILASLCPQVFGMYLVKLAVAMVLAGGIQRTDATGTRVRGESHLLLVGDPGTGKSQFLKYAAKITPRSVLTTGIGSTSAGLTVTAVKDSGEWNLEAGALVLADAGFAVLMSSIASKSMIGPVSMKQWSNKHKFAKAGLVCKLNTRTTILAATNPKGQYDPQESVSVNIALGSPLLSRFDLILVLLDTKNEDWDRIISSF

SEQ ID NO: 920136 - protein, 592 aa, Homo sapiens
GVGRERRPGRAAGARPPDTARASPRPVAPRAATCTRALRLTSLLAPETNPLPGWSSLGPSASGATRSRRLLTQPLPRFKMNSDQVTLVGQVFESYVSEYHKNDILLILKERDEDAHYPVVVNAMTLFETNMEIGEYFNMFPSEVLTIFDSALRRSALTILQSLSQPEAVSMKQNLHARISGLPVCPELVREHIPKTKDVGHFLSVTGTVIRTSLVKVLEFERDYMCNKCKHVFVIKADFEQYYTFCRPSSCPSLESCDSSKFTCLSGLSSSPTRCRDYQEIKIQEQVQRLSVGSIPRSMKVILEDDLVDSCKSEMGLTGNGYSSKDAADDIGAQRDWIVENKMCCCEVEIVLKANYIQVNNEQSSGIIMDEEVQKEFEDFWEYYKSDPFAGRNVILASLCPQVFGMYLVKLAVAMVLAGGIQRTDATGTRVRGESHLLLVGDPGTGKSQFLKYAAKITPRSVLTTGIGSTSAGLTVTAVKDSGEWNLEAGALVLADAGFAVLMSSIASKSMIGPVSMKQWSNKHKCAKAGLVCKLNTRTTILAATNPKGQYDPQESVSVNIALGSPLLSRFDLILVLLDTKNEDWDRIISSF

SEQ ID NO: 920137 - protein, 183 aa, Homo sapiens
MLGFSYSLFPKAVEFIPMQANHGLVIVRGQRKQPLAVWSLHVTAVLMVTHVDFILNFLPHNQVIPTITLSTEQEFGGSQLSTTVLNLTHMPIKQEAPSTPYTIPPRQVLEDRALQWLLFHSVSPPRSVHSENTFLIAYLFLKTNPSTCSNGLSKEKAAIHSHRLLKTDCVKDSNGQVSKTLQR

SEQ ID NO: 920138 - protein, 251 aa, Homo sapiens
MYFCNLDLSCPFYIYVCPAPAGISQRNQTTFEINPLSSFRDELARQAFEAGSFWHFTSLSLAKRRSVARVPEVVCFLVGRRRGLGSWSKNQPSKCEMPVQGHVIEKLMMIFSSCCFNHSKTNKTIPGPRRIGEGWVDRYLPGKLAIVNVTAKCPITDARRWGNANFASSGQCCGDAALGPASSGLLAGAGSSPGSAALRGQDSQKDLPDCHVENGLEGTRLELRMLLEDFVYGQHSHGEKGSKNTGAMEGD

SEQ ID NO: 920139 - protein, 143 aa, Homo sapiens
PTSLAERMSHALVLRFPARAQPPFIQVKNSVEPSDSQAYLKPYLCSSSFPAPATSFLNKSLIQVLLTEALLLVNLFQAQCERIKAYKRIIKIQRRGKREEQNFEKHMMYLVREGVGKETEGVSKSLETEEKEEGKEEKTGMDL

SEQ ID NO: 920140 - protein, 260 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSARNESWAR

SEQ ID NO: 920141 - protein, 317 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 920142 - protein, 156 aa, Homo sapiens
MVYMCHIFLIQSIIDGHLEKTTTRGPYAWRNGRENLTGLTFSVPPPHGKEEVRIASYLVEVFVSLRVIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 920143 - protein, 80 aa, Homo sapiens
GDFGVPIAILIMVLCVETDYTFPLAEKVKAFLADPSAFVAAAPVAAATTAAPAAAAAPAKVEAKEESEESDEDMGFGLFD

SEQ ID NO: 920144 - protein, 362 aa, Homo sapiens
MRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKTLKHPCIQRSAGELLLTLAKNTESQFEKVPEIMGVICAQLSIISQPRVRQQIINTMFLTLKFMNHWLKGCALSKFRCIFSTLKMCGKLKAFCNTSLTINSFSKYFIYSLRNPKKITEVISGKEV

SEQ ID NO: 920145 - protein, 362 aa, Homo sapiens; identical to SEQ ID NO: 920144

SEQ ID NO: 920146 - protein, 311 aa, Homo sapiens
MRQEVFVTIADLSYQDVHLLLGSEDRAELFSLTIKSIITLPSVRTLTQIQEIMPNGTCNTECLYRQTFQAFSEMLQSLVVKDPHLENLDTIIKHLVPWLQSVKDHERERATASMAQVLKCLSKHLNLKLPLRFQRLGHLVALMALLCGDPQEKVAEEAAEGIHSLLHITLRLKYITHDKKDQQNLKRALTKCREFLELHSSAAKCFYNCPFRIAQVPEIMGVICAQLSIISQPRVRQQIINTMFLTLKFMNHWLKGCALSKFRCIFSTLKMCGKLKAFCNTSLTINSFSKYFIYSLRNPKKITEVISGKEV

SEQ ID NO: 920147 - protein, 181 aa, Homo sapiens
LSGRRDGSRLQSARPPRAGAESRSAPATRRPGALERTRGAMRRQPAKVAALLLGLLLECTEAKKHCWYFEGLYPTYYICRSYEDCCGSRCCVRALSIQRTGDEPCREFHGNGFPGPTQLTPGECGLPAPSSLLQHASAPVRTGSEGQVVGCPRARGETGEGLSLAFLSSLMFTSRNGLVGC

SEQ ID NO: 920148 - protein, 273 aa, Homo sapiens
VCCSHRVLKNASSSLLKIKPQGSMMGQLDGKVIILTAAAQGIGQAAALAFVREGAKVIATDINVSKLQELEKYLGIQTRVLDVTKKKQIDQFANEVERLDVLFNVAGFVHHGTVLDCEEKDWDFSMNLNVRSTYLMIKAFLPKMLAQKSGNIITMFSVVSSIKGVVNRCVYSTTKAAVIGLTKSVAADFIQQGIRCNCVCPGTVDTPSLQERIQARGNPEEARNDFLKRQKMGRFATAEEIAMLCVYVASDESAYVTDSAPCPTTCKRPKRKN

SEQ ID NO: 920149 - protein, 389 aa, Homo sapiens
MGERAGSPGTDQERKAGKHHYSYSSDFETPQSSGRSSLVSSSPASVRRKNPKRQTSDGQVHHQAPRKPSPKGLPNRKGVRVGFRSQSLNREPLRKDTDLVTKRILSARLLKINELQNEVSELQVKLAELLKENKSLKRLQYRQEKALNKFEDAENEISQLIFRHNNEITALKERLRKSQEKERATEKRVKDTESELFRTKFSLQKLKEISEARHLPERDDLAKKLVSAELKLDDTERRIKELSKNLELSTNSFQRQLLAERKRAYEAHDENKVLQKEVQRLYHKLKSDFADLCTKGVQTMEDFKPEEYPLTPETIMCYENKWEEPGHLTLNGKEKNLIKSKKKRHLYWKEKKSQSGKLEGTFHKDGNNSSQGAKATRTEVALPASPALV

SEQ ID NO: 920150 - protein, 128 aa, Homo sapiens
SPSPNLDLTETGKEMRSIICQGRYKKVVTCMDFLHQQLPISMETAYRMGIFYPKTPETDHSTRCQIFFIRVHQNKMWHQIECRSRYEDSAVFDECYLLRCLVDAAVVAVLGRCYYYYAQCSPTMAALR

SEQ ID NO: 920151 - protein, 151 aa, Homo sapiens
MESRLKESHKERQASEREKPDVKGSRNASREEVFGKVAEVVKDIMKNLEPMKQKDLFWNTWCGILENSRYDRHAARVVTQGPALRRSLHMTQCSTVAILKLLIVFEQEALGSMSYTATRITDYIGNSTFIRSNGIHRSQDLSSPSVCSDNT

SEQ ID NO: 920152 - protein, 198 aa, Homo sapiens
RAAAGFLVGRAGTSGRAATFSLGSRSSGLPPRPGDTRGTPGLSRAVTLPMWTGVHPRGRFLGCHGARARRVTAGEGGRVPERLLRVVSPPAGTARSTSRAPQPPHPAEQSRAPRTPRAPAVLPTPWPRRRPARGGVNKRRARFDLARPGFLAGVPPEQSLEFRAKDNNCGSAFKAGISPATAECFVSPVSNFAERDQM

SEQ ID NO: 920153 - protein, 198 aa, Homo sapiens; identical to SEQ ID NO: 920152

SEQ ID NO: 920154 - protein, 173 aa, Homo sapiens
MRSPLGVMTRGSPWGGPGVLCGSGVLLEGLTDTHGGYTGADTQRPEHEIRFVSFVKEDLGCGAGKLEPPRAVRLPVASSPGGSREQSRVGKAIRPLSSGPLLQAPEDSPACIWSRISSVTSKLPLGAHGCPADPNSDPVPGKGRGHPHPVTRMEEEEEPTLPQRPPHAYTSPT

SEQ ID NO: 920155 - protein, 141 aa, Homo sapiens
MPVMPDDLRWNSFIPKPFPLLPQNQSLVPKRRTEEPRPCRWIGYGGSGKGEVKNHLQVSDLISEEIVVPFTQRDRERALEHNKSLFCLPASLAAPALYHKKLLSYSFIHLLTQSTNILEHLLCAVHCTEPGDTVVNSLHEI

SEQ ID NO: 920156 - protein, 151 aa, Homo sapiens
MRLICHHKNSMGNTLMIQFPPTESLLQHMGIMEVTIHDEIWMPGYFGLGTHVFSVPMGYSIYLIILSGKDAHVKFGLASRPALPVPTWNSVGWKAPAALPTHPLLGKVQRAAVSCMVGVRSNEREELVVKENSNDKQQPKNRYCWFAADSF

SEQ ID NO: 920157 - protein, 330 aa, Homo sapiens
MGQFRKAQSAPALKFSFTCYGSESEPWGLHIEQVPQGDSRDWANSGSSVQLGIWKWNWIKYSAVMELDFKKEITAKRANCSDFLESKGCFANTTPSGKSVSSSSSVETGPSVSEPPGLPRVSAYVDTTADLDRKLSFSHSDHSSEMSLPEVQKDKYPEEFSLLKLQTKDGHRPEWTFYPRFSSNIHTYHVGKQCFFNGVFLGNKRSLSERTVDKCFGRKKYDIDPRNGIPKLTPGDNPYMYPEQSKGFHKAGSMLPPVNFSIVPYEKKFDTFIPLEPLPQIPNLPFWVKEKANSLKNEIQEVEELDNWQPAVPLMHMLHLSGALDFPRQS

SEQ ID NO: 920158 - protein, 154 aa, Homo sapiens
QYNFHHFLFLVPYMQEKPFTGRLLREIWQFLDKEIGDLRPGTEAHACNPCTLGGRSGRITMSTDQDHPGQHEHASRTFIYYEKIMHQEQLVPAGGELCLCQLKLQEALWDPHPLQTPTRRRALFRVLPAWAHFHRRPFPYGGWGQVLTLPGHTA

SEQ ID NO: 920159 - protein, 179 aa, Homo sapiens
MLPTVEYGNVLGLHSHSHYSLTDSSKATSSPSNFIHMSSHLQTPVTAGEVPDQLPAQTKPARSHLNKKEYQSSRHVLQGGKVATDNTQRRGSSNLRVTGMRKNKQAVSFTEEEVSSKKNEIFVRRHHVDITKKLHPNQAGLDSKVLIGSQNDLVDEEKERSNRGATAIAETFKNEKHQK

SEQ ID NO: 920160 - protein, 139 aa, Homo sapiens
WTLVMTFKAHLDNLGHSCHLHILTHTCKVPFVIEGSIPEFQGLGHGHFVVGISWPAQLPRADISAAAGQKSEGAPGVEPMGPCFVLEPLALNLSLVQVHLYDSQGLRRQELPKEKMFEALDKKKAGRMFITVPKTLPHW

SEQ ID NO: 920161 - protein, 165 aa, Homo sapiens
WITIAFVVPGRCFSCNTNQSPAPSPQAMYPANIHDCHVTRTLRLVARPTWWKLRPTTNSQHQAVHVCSFTSEAGETTSPPGETNNSQRAAFKNCNTQVRAFILEEVRKDEENSEQGSHKLEYSGVQLEAVENANSWAHQLTPIQWNQGWAQESALKVLPQHSRCF

SEQ ID NO: 920162 - protein, 332 aa, Homo sapiens
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTESDIHPVCSAYSLYSGTGCDAAGEMQKKIVRSLKESAVLWGLRGEEDGKNETSFNLVCADSWKLDLFQSCLNAGFFFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYW

SEQ ID NO: 920163 - protein, 291 aa, Homo sapiens
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFFFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLS

SEQ ID NO: 920164 - protein, 67 aa, Homo sapiens
RALDKCLLSAHGVPRAWRDVAGMRLEESEPALPSRHSRSGPGRRPEQDGWAADRGGKSWGSAEVARK

SEQ ID NO: 920165 - protein, 42 aa, Homo sapiens
MRKLRLKYLREPAQSHTNAAALTQSSVVPDFSSTSVMRPSAT

SEQ ID NO: 920166 - protein, 67 aa, Homo sapiens; identical to SEQ ID NO: 920164

SEQ ID NO: 920167 - protein, 161 aa, Homo sapiens
REKFMITMRGHQHRPGRSTSENYITGTEWRGPNLLHFLLSTHLTKHKIPAGKALSTCLPGLVSTLPCRACTSPEIREQRTHASGSPGFSAMGKAAFTGTMAGLELKPVSNKSYPTLMEEFQGEDLGQLQDAWIGGHSQRGVTCALFNSVTAGLKTDQTSFR

SEQ ID NO: 920168 - protein, 161 aa, Homo sapiens; identical to SEQ ID NO: 920167

SEQ ID NO: 920169 - protein, 160 aa, Homo sapiens
MATSRGASRCPRDIANVMQRLQATGLLEFAGGPLQTLFAWVLPAEAGEQQILQKSKYCCLIVPLETSSPYRPAYMRCLLAPTGRCIPVRLHGELKRRAGRTTAVFSAVRQGHLSLQKLSAAFYSAMPCPQRWSLQRQYSLSRLPLAKKGKSPNPLHFRAT

SEQ ID NO: 920170 - protein, 136 aa, Homo sapiens
MPYKSDFVNADCIRQRGVDKGYTKVLSTQKWRRANGDPGKGGFLPKYPCEHEDSFQTEKEWARESSNASFPDTKCFVQCLASTCRSRGNVLRASPLGRHFVMENIDHIEQKWEQQGLMANALAESIGTRGKTNITV

SEQ ID NO: 920171 - protein, 136 aa, Homo sapiens; identical to SEQ ID NO: 920170

SEQ ID NO: 920172 - protein, 398 aa, Homo sapiens
MNEKVYYLFLSFPLFEITLDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRSEARHAPPPRPRGGNHCASRGRWRRPKQASPGGPPYAGRKGGGEKSVEPSGPDLGAGGAGDAEPDLRCFPQASSGATSLLPGARQSSIRPPPTQAARSAAGSIPATAEGAAYSHLFPLRAHLASPGKVPLRLLALPYLSE

SEQ ID NO: 920173 - protein, 217 aa, Homo sapiens
MSISGRLRLCTGERRQALSQKDGGLELQSAVADWKWGQEREKEASTPTPWGSASCSPLDVTGAHFSLSTWLLLTDCLVHGGCHGPQGGQVADVAAVHMKAAAGPEREAVTRCVRERESHGPAAGGASVAQSTGHRLWKLGAEHKSRKGDPKRPGQVQGASPLPGSFLVPTTVAIALGPWTALPGSLRSLSLPEDKGLSQGLSESTVAMFLGQFLEGT

SEQ ID NO: 920174 - protein, 151 aa, Homo sapiens
DPVFSLPLVLPLRMSHPALPVLHILPNISVINTQIHTLPFQFHEHCMKHQNFPFLRKLRICCPLQKYEVGLQEYELLSTCRDPRCLSSLFEIIATKGELSGQPGRSSPHSAETCLHLRPQSKSPWASGSSDIWRQLLSLPALRFTMSRLNG

SEQ ID NO: 920175 - protein, 161 aa, Homo sapiens
MSWREGSKERLAGEASQSWWKAKVEQRHVLPGGRQESCAGELPFIKAADLTESYSIEARVSQAFELTVNYTTGFPGSPACRQQITGLLGLVSNSHLPFTMSKSFLRPHKKQMQDPSVLYSLQNCPTAIQLNKKEGEAVNCRSKDFSNFFTYMESPWALIKM

SEQ ID NO: 920176 - protein, 144 aa, Homo sapiens
YTTMGQSPRFKSKKQDKMCLECYYLSKRKCDRKSLALRDRIRKQIPGEAKGSHLLMDSGKRPSTLDKNSVSGDHKEVECNQKENCGPTELRKKRSEFWNQKEQVGRVLHLRTLDPWFGTGPHTCNVRLLRLRRTAVRSGSEGIC

SEQ ID NO: 920177 - protein, 144 aa, Homo sapiens; identical to SEQ ID NO: 920176

SEQ ID NO: 920178 - protein, 136 aa, Homo sapiens
MSRVDKTARKAKEVGQTKVGDCYIKSSLFLLELCHQGFGHVCVTWNPSVIVFIQTFYQVETKSGGSVHSQAQSCGGAEVASAGEWKTALLEELKEPPLPSSVPGACMAGPWDHELTTPPRVTVVDIRITPRCSVFG

SEQ ID NO: 920179 - protein, 176 aa, Homo sapiens
HFLSSVLSKKLESVFGYLLTLLVFLCEGDLRKSMHGSRTKRNNLIIPKRFQELPGGKARSAGLQRLQPPLLLGAQAQGDPGSVPEPKAGVIGVPPAGKPCPMMMHGSGSGLKGHSGHRLLRPGAYCVRQLPVPVLAAAPPPRSSNSLESRQPQLQIWVTPSRRCLAVALGHSTGSV

SEQ ID NO: 920180 - protein, 141 aa, Homo sapiens
MTNSHINFDCKSKLHLDLFLSTSPGRLERKHGEIELQYGGKCRHSRESCENGPRHRHHLSSSSFLLPVLSTSSSEVLKKGKRKGVRVGQFSLNWPLANQEKAQKNQRIQETLVTHINQHLDLEYKANIRRLSMRKRKRQTS

SEQ ID NO: 920181 - protein, 170 aa, Homo sapiens
SLTARWGKEPPFTKMRVKRLLVMCILAHHGHDTSLVKGIIFMERSVEEEEDTGLENRGDSPLRVIGPEDSPVGQDVEVKDSDIDHPDPVMLWYSVGDTGFSPSWRGWAFAWENTGFLHVGFPLYDRAFAGTIIPTLPLINVLIAQRTCVEGLRPRGLTILHLASLSPRSS

SEQ ID NO: 920182 - protein, 148 aa, Homo sapiens
MQKENQERILIQDEEGFFYYLKTSNDFFWLTRCYIPTPHCGFKEDDSGEALDVGVKERTGVWIPLLTLVHGNNEIYRSCLVPLYDTLLTPADESIRSPLLLVGCWKGVEGQKEEAKWSRKCENVHVIYAYAAHPGTPASTRFIMRDQK

SEQ ID NO: 920183 - protein, 135 aa, Homo sapiens
MWLLEEGYSLQGNSAKVLRQERGYKVCEESRRTGHRSSLSQERVIGNEDEEITGQQRGQIVLGLLGHYVSADCFVLLRKDSCIIEENTRKKKFWHLLKPKYFYDTKHMREKLILYMVSDGVEFHCFHISSILKKR

SEQ ID NO: 920184 - protein, 126 aa, Homo sapiens
MVALFQHSPYWQADGYGHSHRLKCQHFKQHRQYNDKLEISSNLGPQFNALLNILLNIVHPTLSHDTRRSKGLKIEGLLQSRELGNSWTVTMCIWVLKALQSSAPNKPLDWLDPMPCFQNLLARGTP

SEQ ID NO: 920185 - protein, 132 aa, Homo sapiens
MAHGRSHSLQLYSFLLFIPTRMYHIENNELNLQKIMISKEPSRKCIISLIKVFCDICDVGSAIAYELMLAFLPPSEDIQHEGSSWVVNCENLGNSSAYYFITPDTLANTLKTENIASGDIEIQDKKEATGTC

SEQ ID NO: 920186 - protein, 157 aa, Homo sapiens
MDAELPVTLTVEDFTGDLWFCREDHMAHGRSHSLQLYSFLLFIPTRMYHIENNELNLQKIMISKEPSRKCIISLIKVFCDICDVGSAIAYELMLAFLPPSEDIQHEGSSWVVNCENLGNSSAYYFITPDTLANTLKTENIASGDIEIQDKKEATGTC

SEQ ID NO: 920187 - protein, 132 aa, Homo sapiens; identical to SEQ ID NO: 920185

SEQ ID NO: 920188 - protein, 247 aa, Homo sapiens
MWTVRTEGGHFPLHSPTFSWRNVAFLLLLSLALEWTSAMLTKKIKHKPGLCPKERLTCTTELPDSCNTDFDCKEYQKCCFFACQKKCMDPFQEPCMLPVRHGNCNHEAQRWHFDFKNYRCTPFKYRGCEGNANNFLNEDACRTACMLIVKDGQCPLFPFTERKECPPSCHSDIDCPQTDKCCESRCGFVCARAWTGKDWGYTSQIYWACAKDVMLSPWSGGCLEPQMLLGLIFEDLWEPLLMPNKLY

SEQ ID NO: 920189 - protein, 238 aa, Homo sapiens
SSHPYRHFPLHSPTFSWRNVAFLLLLSLALEWTSAMLTKKIKHKPGLCPKERLTCTTELPDSCNTDFDCKEYQKCCFFACQKKCMDPFQEPCMLPVRHGNCNHEAQRWHFDFKNYRCTPFKYRGCEGNANNFLNEDACRTACMLIVKDGQCPLFPFTERKECPPSCHSDIDCPQTDKCCESRCGFVCARAWTVKKGFCPRKPLLCTKIDKPKCLQDEECPLVEKCCSHCGLKCMDPRR

SEQ ID NO: 920190 - protein, 253 aa, Homo sapiens
RGSSGRRQLGARATAGAGKAGHFPLHSPTFSWRNVAFLLLLSLALEWTSAMLTKKIKHKPGLCPKERLTCTTELPDSCNTDFDCKEYQKCCFFACQKKCMDPFQEPCMLPVRHGNCNHEAQRWHFDFKNYRCTPFKYRGCEGNANNFLNEDACRTACMLIVKDGQCPLFPFTERKECPPSCHSDIDCPQTDKCCESRCGFVCARAWTVKKGFCPRKPLLCTKIDKPKCLQDEECPLVEKCCSHCGLKCMDPRR

SEQ ID NO: 920191 - protein, 241 aa, Homo sapiens
MWTVRTEGGHFPLHSPTFSWRNVAFLLLLSLALEWTSAMLTKKIKHKPGLCPKERLTCTTELPDSCNTDFDCKEYQKCCFFACQKKCMDPFQEPCMLPVRHGNCNHEAQRWHFDFKNYRCTPFKYRGCEGNANNFLNEDACRTACMLIVKDGQCPLFPFTERKECPPSCHSDIDCPQTDKCCESRCGFVCARAWTVKKGFCPRKPLLCTKIDKPKCLQDEECPLVEKCCSHCGLKCMDPRR

SEQ ID NO: 920192 - protein, 241 aa, Homo sapiens; identical to SEQ ID NO: 920191

SEQ ID NO: 920193 - protein, 247 aa, Homo sapiens; identical to SEQ ID NO: 920188

SEQ ID NO: 920194 - protein, 241 aa, Homo sapiens; identical to SEQ ID NO: 920191

SEQ ID NO: 920195 - protein, 244 aa, Homo sapiens
MQPDMAVGAQVGHFPLHSPTFSWRNVAFLLLLSLALEWTSAMLTKKIKHKPGLCPKERLTCTTELPDSCNTDFDCKEYQKCCFFACQKKCMDPFQEPCMLPVRHGNCNHEAQRWHFDFKNYRCTPFKYRGCEGNANNFLNEDACRTACMLIVKDGQCPLFPFTERKECPPSCHSDIDCPQTDKCCESRCGFVCARAWTVKKGFCPRKPLLCTKIDKPKCLQDEECPLVEKCCSHCGLKCMDPRR

SEQ ID NO: 920196 - protein, 241 aa, Homo sapiens; identical to SEQ ID NO: 920191

SEQ ID NO: 920197 - protein, 241 aa, Homo sapiens; identical to SEQ ID NO: 920191

SEQ ID NO: 920198 - protein, 164 aa, Homo sapiens
IRTGGELSCWQKGLLELPDQVLRMCTPVDCGRPAPGKQLRTNWRNFRDSFGLQSIDFSPPFSLFSNLTVFFAVPQTQQLDPTTTKELNALLYPLNNVAHLDGVLKILYPLNNLAHLDGVLKILCTFESPEDVPKRFQVFCVLGLSFKIEIEKNNFKPTNYLFFK

SEQ ID NO: 920199 - protein, 537 aa, Homo sapiens
TQHSIRMWLLGASTMQQRPIQPSFTKSLCRESHWKCLLLSLLMYGCLGAVAWCHVTTVTRLTFSSAYQGNSLMYHDSPCSNGYVYIPLAFLLMLYAVYLVECWHCQARHELQHRVDVSSVRERVGRMQQATPCIWWKAISYHYVRRTRQVTRYRNGDAYTTTQVYHERVNTHVAEAEFDYARCGVRDVSKTLVGLEGAPATRLRFTKCFSFASVEAENAYLCQRARFFAENEGLDDYMEAREGMHLKNVDFREFMVAFPDPARPPWYACSSAFWAAALLTLSWPLRVLAEYRTAYAHYHVEKLFGLEGPGSASSAGGGLSPSDELLPPLTHRLPRVNTVDSTELEWHIRSNQQLVPSYSEAVLMDLAGLGTRCGGAGGGYAPSCRYGGVGGPGAAGVAPYRRSCEHCQRAVSSSSIFSRSALSICASPRAGPGPGGGAGCGGSRFSLGRLYGSRRSCLWRSRSGSVNEASCPTEQTRLSSQASMGDDEDDDEEEAGPPPPYHDALYFPVLIVHRQEGCLGHSHRPLHRHGSCVETSL

SEQ ID NO: 920200 - protein, 150 aa, Homo sapiens
LGCEGHKMGTLPARRHIPPWVKVPEDLKDPEVFQVQTRLLKAIFGECAQYWRAAPARESQPARGSHLFSPTGPDGSRIPYIEQVSKAMLELKALESSDLTEVVVYGSYLYKLRTKWMLQSMAEWHRQRQERGMLKLAEAMNALELGPWMK

SEQ ID NO: 920201 - protein, 175 aa, Homo sapiens
MEPGGAAAARGGLEPRRASGGWKEPSWTFREARPACTWNRDHRSLAAVLCALPAPGAEIMGLWLLFCERVDLLVKATSQCHLSRRPWERNTVPFSFLEPPPLSLAYVLWHVLSCGHSEPQAPGLSAQLLLWPSMVDPPSRPIPDSPHPPNCPRSAAATAPRRTLCSLLGTEGCFI

SEQ ID NO: 920202 - protein, 801 aa, Homo sapiens
VPQLPPQPAPQWSAPVGCHSSLDAMEEPGATPQPYLGLVLEELGRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLSRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELKVNSQWENGANLDDPPKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISHATEELETYRKLAKDLEEELERTVHFYQKQVISYEKRGHDNWLAARTAERNLSDLRKENAHNKQKLTERELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGLIPPPLAPISGPLFPVDTRGPFMRRGPPFPPPPPGTMFGASRGYFPPRDFPGPPHAPFAMRNIYPPRGLPPYLHPRPGFYPNPTF

SEQ ID NO: 920203 - protein, 412 aa, Homo sapiens
MNDLADNICEMSKGEGENKSLKCGLGSCSPMELILEKPLTVMEENFLVLPEHDIKDSFQKVILRKYGSSDLNTLHLKKDYQSVGNCKGQKSRYNGLHQCLSTTRSKTSQCNKCGKAFGLCSIFTEHKEIFSKEKCYKCEECGKDCRLFSDFTLQKRIHTAERCYKCEDCAKVFKKFSNLTEHNRVHPGEKPYKCEECGKTFTCSSTLIKHKRNHSGDRPGKCEECNKAYRWFSHLAKHKRIHTGEKSYKCNECGKAFTWISVLSHHKKIHTREKPYICEGCGKAFTRSSTLISHKRIHMEERPYKCEECNKAYKCQHKRIHTGEKPYKCNECGKAFTCILALSQHKIIHVGEKPYICEECGKAFTRSSTLTNHKRIHMEERPYKCEECSKTFKCFSDLTNYKRIHTGEKPYK

SEQ ID NO: 920204 - protein, 151 aa, Homo sapiens
MVVSKCGFISLLANRELFVRCDYQNPLEGYQHHLTMNPVLLILTPIFPQDSVDGIFLNVLFMVQVNMRVTIARVSAFGRRPGTVSGNVRNLVFQMLTSLHSPCECPEPLQDVGVTGAAEPEQTAEIRADSVREAAHESAGVKKLLMKAAAE

SEQ ID NO: 920205 - protein, 146 aa, Homo sapiens
TVPDSRAYWEGMYIFSFRGCQILLEINKKKTENPIEKSVKELNGHIAKEDAQPYYCISISGYKEGQVEKDMEQPEVLYADGGSGNQCNHFGKLAISSLRYDKMLLLQLMAGNHDGTPILCQTLWKAIHKVIFYGLNVISPNLYFES

SEQ ID NO: 920206 - protein, 564 aa, Homo sapiens
TECAGTFWATLRASDTGTLCLGLRMVQAATPGASGLPCSPRQALALYQYLFWCPASPGQLRAALWQVQEGRGYPPGLELPPVLLQMEWSRRAQEQLLWDLELLTGVELGLFWPPQAQFFGPRGQAQQAWSQCCQPGGSTGGDPEQPPQIWVKPGVVQTKGGRALEDLQSPHADLAQREERSEAEPETQKRKLTPGTPGPGDLPSQNLPSQDALEGLGSDPHLGQERAELQRPPRMDTPESERRTLRIRKRRPLSVREPRPPGARSKMLLRVRRRRHTGARAQGLLRVRGRSRREFSPKCQGKASPQSPGKKMLRSWEGNISQAWEVAPGEATVQPPEEGDPHSHPRDSCGSLKAQTPKPVGRESPNLRRRTTTLTQSMIKGEPQRSAPAVAKLGAAREGAWAALTRPKPPARRRLPGRGAGAEMPATLRAEVSGQQGLLGALRGPQAWSAIRTGCRALEWAPHRGSRRWARLGFRVPSGVGWGGPERPKALKAAWPAPLSTAKAPAGLSAAQQVTALQRLLELHSAARRQRRRRDREQQRLRVCPHAGIGACLERAGHRGAAGR

SEQ ID NO: 920207 - protein, 652 aa, Homo sapiens
TECAGTFWATLRASDTGTLCLGLRMVQAATPGASGLPCSPRQALALYQYLFWCPASPGQLRAALWQVQEGRGYPPGLELPPVLLQMEWSRRAQEQLLWDLELLTGVELGLFWPPQAQFFGPRGQAQQAWSQCCQPGGSTGGDPEQPPQIWVKPGVVQTKGGRALEDLQSPHADLAQREERSEAEPETQKRKLTPGTPGPGDLPSQNLPSQDALEGLGSDPHLGQERAELQRPPRMDTPESERRTLRIRKRRPLSVREPRPPGARSKMLLRVRRRRHTGARAQGLLRVRGRSRREFSPKCQGKASPQSPGKKMLRSWEGNISQAWEVAPGEATVQPPEEGDPHSHPRDSCGSLKAQTPKPVGRESPNLRRRTTTLTQSMIKGEPQRSAPAVAKLGAAREGAWAALTRPKPPARRRLPGRGAGAEMPATLRAEVSGQQGLLGALRGPQAWSAIRTGCRALEWAPHRGSRRWARLGFRVPSGVGWGGPERPKALKAAWPAPLSTAKAPAGLSAAQQVTALQRLLELHSAARRQRRRRDREQQRLRVCPHAGIGACLERAGHRGAAGRCLPPLQVLERLHIARNRHCRVHPVGLPPSPAQLPPQEDAAGRRRALREQLEQMHRERTERLRALGARNTQNFLELLCSPGAEDPVPAK

SEQ ID NO: 920208 - protein, 152 aa, Homo sapiens
MAWHFRAAHCSSGAISVFIFLPQGTEAGIEEVLSFIALRVSRPQGRNGEHKWKGWRFLWRVRGDQTRVPRAADRRGESCMEKQLPRPAEEPSRVFRTALFSTECMKLKRLTIPNVDKDVQHLGLSYPDDENVEWCNHFGKQFGGFLERIFML

SEQ ID NO: 920209 - protein, 540 aa, Homo sapiens
MRQMMGSSGHYEAKDGPEEAIMGSTGHYEAEDGPEEAIMRKELAQLLPSDGISRPQMASGRWGPPGPAWASQRPLQTQVVLKSSPCLLAASRRQASTSTVGPPGPPLASPWRPRARLPASGLPPHTQLTKYSAHRTVSSEASRGVSVFVWRNVEPHSVAVFPWYSVPFLTPPWSHTRPSNLPVTQWPPTRANNLPSWQLLLMSIHQVGQGVLTLGGPLEPPALKAQGPEPHTLWGWWNLAQSLSALRKEQDSSSEKDGCSPNKWDKDHIPWPISGGHELQQAAPGPGRAHQGHPNQDNRTVCQILSERWYTLGPNEMQKYHDLAFQVKVAHLQQGPKEVQLRGQAHKPGASRSIQGLLGAEGVHSLDGREIDRQALQELTEVVSGTASYSGPKPSTQYGAPGHFAAPGGGGDNVIADDGFSTTDTDLKFKEWGAEPEEEKLGFGGWGRGNPTDMDPALDDPTTPKCKMRRCSICSPKPNTPKCAMCDGDSFPFACTGGEAKDGLREPETEKALSSSLHAPWTSAGPDRAAFPGPLLLPVH

SEQ ID NO: 920210 - protein, 262 aa, Homo sapiens
SLNISSGTLGAWSDMIAAAREAPRRRPAPPTPRPRPPRRPAPPLAPPTALPAQPGPGPANRGPLPRPPRPRPRPRRAPEAREPRAPCGTHHPAPATEGERRGAARPPVTPRASAASHGSGVAGAGSPLWPLRFRGRRSATRGPRGRGETSSPLGGAGVSRSRGGGELAGPSRRHMRLLGGGACARRRGGGALGPRVGAGAVLRPPRASWPWAEWDWVSRLFAVAASAAGPGVVPEPLWPSKARGPGLHRAGPGYAVTEFPRP

SEQ ID NO: 920211 - protein, 262 aa, Homo sapiens; identical to SEQ ID NO: 920210

SEQ ID NO: 920212 - protein, 262 aa, Homo sapiens; identical to SEQ ID NO: 920210

SEQ ID NO: 920213 - protein, 186 aa, Homo sapiens
MRPRCKLFFRCLETTTAMMISFPDKTISFLQGFKGFDLNMYYPNHEDSDGRVINDDDLGGNGLEIQADMAASPSYKGRDKTPRGKKCRVIGFGTEERTTENVHVLVADRGYGGGVFKSIKEKISNILIFDIKYQNLPWCPAWFKIISVKHIRARIFCSICNIFWQPCPFSVLDDYNNKQLLPRHCC

SEQ ID NO: 920214 - protein, 152 aa, Homo sapiens
MRPRCKLFFRCLETTTAMMISFPDKTISFLQGFKGFDLNMYYPNHEDSDGRVINDDDLGGNGLEIQADMAASPSYKGRDKTPRGKKCRVIGFGTEERTTENVHVLVADRGYGGGVFKSIKEKISNILIFDIKYQNLPWCPAWFKIISVKHIR

SEQ ID NO: 920215 - protein, 152 aa, Homo sapiens
MFLPGLWEPLSLPAGTFYCQVLRMLSSSPPCTVWPQHFLPLLLGSGGSPPVKLSKMPCTDSGAPQRSPFCQVPLPLPGSPAAWLPSASIPAAEAWNARDTRATLPSMLKKEDESDGGGSGPETNLRERIAVSPARQRSGCWVSSPFWLSLSR

SEQ ID NO: 920216 - protein, 169 aa, Homo sapiens
MSDLEAKPSTEHLGDKIKDEDIKLRVIGQDSSEIHFKVKMTTPLKKLKKSYCQRQGVPVNSLRFLFEGQRIADNHTPEELGMEEEDVIEVYQEQIGGHSTGVLVCPYPPSCGEALMQSVCGVSPGPLAGREPHVPPTFSCLAVTGASNHSNSVLTPGRLSYLNPRSVPL

SEQ ID NO: 920217 - protein, 191 aa, Homo sapiens
MCVCVCMYVLCVYWGRRPWLMQLDLFGGEKKATAGEKEEKETQFKSQNICDELRMQGSGGRKSEIRAASIGFWRGPSLWLQGVRLRPCQRLRAWEWVLPGHARVGVGQSAALGIQGTGDMGNRGPTNTTAAPAAAFAATVPAPTPAAANADAAAAATVYEAQAHLATRRRAKAPSRTPQLTITTADPQTRE

SEQ ID NO: 920218 - protein, 191 aa, Homo sapiens; identical to SEQ ID NO: 920217

SEQ ID NO: 920219 - protein, 148 aa, Homo sapiens
MGLVCDLRSLLFSGGDTGLRPSPTKPSSFLFNPSIPLGSCAGLGFQEPCLGVCVWLCDRQAGGHGCPTLRALTCWVPGSSSVRLPNAEQRAEAAWVAQPLPQPEVSQQHQVWKMRIPRNIKETLRITKKAALLRNKYINKNKKEKRSN

SEQ ID NO: 920220 - protein, 299 aa, Homo sapiens
WQGCRWQKPSSAMNLRSVTGFTLICETSTLTPRRSGPDHELTLDSGKVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCGTLMSLPTKISRCPHLLDFFKVRPDDLKLPTDNQTKKPETYLMPKDGKSTATDITGPIILQTYRAIANYEKTSGSEMALSTGDVVEVVEKSESGQTSHLTGLLPLVLRNPQPQAPCQGSGSLAPGRTPALLGALNV

SEQ ID NO: 920221 - protein, 455 aa, Homo sapiens
WQGCRWQKPSSAMNLRSVTGFTLICETSTLTPRRSGPDHELTLDSGKVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCGTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 920222 - protein, 159 aa, Homo sapiens
HQVPLAGAMHVNAESAVGNVLGRESSRKSGGKSYRDGEECSIHSEGTEGEKDQRGREPSLEKELEGSQCVWGPWNEDRIGTEEQEIKAGPCEDRGFDSQPARSAHQGGHPQTRPSPAQGPARGAYTGGCSEQERKRSNLNPDPSPTEPESLNHQLDRPV

SEQ ID NO: 920223 - protein, 159 aa, Homo sapiens; identical to SEQ ID NO: 920222

SEQ ID NO: 920224 - protein, 155 aa, Homo sapiens
MYDKKPEEAMNFQIDVKEIHSVPWKWYGVESGERSKGSGNAWLVSGGEDSSNSSCFQVMSLGNQSWRKGAVADKNHWTWMELESIILSKLTQEQKTKQMLHVLTYMWELNNDNAWAQGGEQHTLGPVGGKGEVSKDPEQQKQSRERRTNLETSHF

SEQ ID NO: 920225 - protein, 129 aa, Homo sapiens
MKTYKNKHQGSMCQSSVGLVCFFTPSFKSYAALRKFSSQCVYASRSLTRIRCAYDTSRPATAALACAVPGAEHRPWYKVDVQCLTGKCKEIVITWTSGEKNSTWKYQVFWGRPGRGKQELDYLLVIPGG

SEQ ID NO: 920226 - protein, 129 aa, Homo sapiens; identical to SEQ ID NO: 920225

SEQ ID NO: 920227 - protein, 129 aa, Homo sapiens; identical to SEQ ID NO: 920225

SEQ ID NO: 920228 - protein, 278 aa, Homo sapiens
RLVTAELRAPSEGRAPCGYTLHPLKLALFSLGVHGMAASSSTTRWGLSGAEQGKDRFWLDPGKPTCRCGLYLCSSQWESGPQDPACHPPGSRGDFRISPLRNGDNSSLFIRFMVRATLIAWPWEQLLMSLARSRALVKDLHVLHSTLPATSHSQHVTVAHPKCQALRSSSGSWLLNVGTIGIWSQGTLSRGAVRNQTCSSVSGLYLLGPSPASNTHSNTGSQFNMGFGWGHRAKPYQGTSIYCTEFLVPSSVLRTGNSGAKTQIQALPSTSCLVPGSL

SEQ ID NO: 920229 - protein, 305 aa, Homo sapiens
PREWPNIAELMQEHGKQKAAGVFVLGGMVTLTSQTPPLWILQSYKDGPSTTRQAHSTTMNPLLILAFVGAAVAVPFDDDDKIVGGYTCEENSVPYQVSLNSGSHFCGGSLISEQWVVSAGHCYKPHIQVRLGEHNIEVLEGNEQFINAAKIIRHPKYNRITLNNDIMLIKLSTPAVINAHVSTISLPTAPPAAGTECLISGWGNTLSSGADYPDELQCLDAPVLTQAKCKASYPLKITSKMFCVGFLEGGKDSCQGDSGGPVVCNGQLQGIVSWGYGCAQKRRPGVYTKVYNYVDWIKDTIAANS

SEQ ID NO: 920230 - protein, 70 aa, Homo sapiens
WWNSFFRNSEWNQEVWLVEKIFGEWTKKGQPPCGFFLPPIPTAHIFWLRSRAILTSSQCPLAVSSFHLAC

SEQ ID NO: 920231 - protein, 217 aa, Homo sapiens
MDAPRRFPTLVQLMQPKAMPVEVLGHLPKRFSWFHSEFLKNPKVVRLEVWLVEKIFGRGGERIPHVQGMSQILIHVNRLDPNGEAEILVFGRPSYQEDTIKMIMNLADYHRQLQAKGSGKALAQDVATQKAETQRSSIEVREAGTQRSVEVREAGTQRSVEVQEVGTQGSPVEVQEAGTQQSLQAANKSGTQRSPEAASKAVTQRFREDARDPVTRL

SEQ ID NO: 920232 - protein, 159 aa, Homo sapiens
MAQPPVYNLDCHNIAALRCICEGYLLYYLCCAFNSSCPGYNLALIHKSGHLEISLCDDFGSIPTPTTLICQGRCYLCCDSDITWDPWLLFDLFFLPFILFQPLLGRPMEIESKYLLPGKGKLIKCYLLLGPNPELLYQINLIVTRTPFKQNTGLLYLGQ

SEQ ID NO: 920233 - protein, 415 aa, Homo sapiens
MAKVGSLCPGKDRDGWEVCRLPCDSPLTTACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAAPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGCEYLGESYLSNQEFPDPREPCNLCTCLGG

SEQ ID NO: 920234 - protein, 471 aa, Homo sapiens
MAKVGSLCPGKDRDGWEVCRLPCDSPLTTACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPVTTAPRPTTLGPPPPYPPASKWALVWRLWTPGLEGLSGFALIPAPTIHCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAAPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGEGHGIGSCRGGMRETRGLGQNNLYCPRVDLKYLLQ

SEQ ID NO: 920235 - protein, 738 aa, Homo sapiens
MDVGADEFEESLPLLQELVQEADFVGEEPGIRGCAGQSPLPRASLRRGWRDGCQATGPQRGPREGQGGFLLQPRGGGTLSSKYTPSPTSLVGQSPVRPGAWLLLALVPPFSLPDLTWLLERRGLDIEFTGLRSNLSGPQQIRYIAHSCNFYLFPTTFGILDSEFSFQASSVQFLNQYGFNYNKFLKNGIPYMNEEQEKKIRHDILTGNWRVRSSPDKDQIKVVIDEVTRWLELAKEGDWMTLPGITGFQAFEVQLVLRQALPNIWTVLKDEGPLVGHNMMMDLLHLHEKFFRPLPESYDQFKQNIHSLFPVLIDTKSVTKDIWKEMNFPRVSNLSEVYEVLNRGTQSRQSVPSQQDEAREAIDPVPESSFPQYLDVLAPYVNQVNLIRAGVPKINFSGPDYPSIRPPILILSVKRWPGVSEQQVYHKFQNLCKFDVRRLTRSQFLLLTNKFKDARNILKEYRDHPTLCISLYRYWRHSPNVNCLLQLSSTCFPSFSPLLPGAQPVIRAPWLPSHSSMALGGAAPLDALPKSLVTLFSIALNSSPGPLDVGVQGPGTIRRDSAGPQHDSEDLFATATQFLAVYPEGVTRMLLVVVDERQEPALGPGGLQTLVLSCASSQVTNIPRIVALFLHLQQQQCGISLIDLSAVGTGHLWGAIILPATFSSDTLMKHLPRELPKPSSLLRPCPQPSGAAAVATACVTLLRPVLVVRWDVLNSWKPEVEGLSGFLHTPTAHSGYLL

SEQ ID NO: 920236 - protein, 893 aa, Homo sapiens
MEHFLLEVAAAPLRLIAAKNEKSRSELGRFLAKQVWTPQDRQCVLSTLAQLLLDKDCTVLVGRQLRPLLLDLLERNAEAIKAGGQINHDLHERLCVSMSKLIGNHPDVLPFALRYFKDTSPVFQRLFLESSDANPVRYGRRRMKLRDLMEAAFKFLQQEQSVFRELWDWSVCVPLLRSHDTLVRWYTANCLALVTCMNEEHKLSFLKKIFNSDELIHFRLRLLEEAQLQDLEKALVLANPEVSLWRKQKELQYLQGHLGGNRSSSREQELALRSYVLVESVCKSLQTLAMAVASQNAVLLEGPIGCGKTSLVEYLAAVTGRTKPPQLLKVQLGDQTDSKMLLGMYRCTDVPGEFVWQPGTLTQAATMGHWILLEDIDYAPLDVVSVLIPLLENGELLIPGRGDCLKVAPGFQFFATRRLLSCGGNWYRPLNSHATLLDKYWTKIHLDNLDKRELNEVLQSRYPSLLAVVDHLLDIYIQLTGEKHHSWSDSSVGCEQAPEEVSEARRENKRPTLEGRELSLRDLLNWCNRIAHSFDSSSLSASLNIFQEVKSYLLQAEFFCQLYKPEIVINELDLQVGRVRLLRKQSEAVHLQREKFTFAATRPSSVLIEQLAVCVSKGEPVLLGTLAQAVKKGEWILLDEINLAAPEILECLSGLLEGSSGSLVLLDRGDTEPLVRHPDFRLFACMNPATDVGKRNLPPGIRNRFTELYVEELESKEDLQVLIVDYLKGLSVNKNTVQGIINFYTALRKESGTKLVDGTGHRPHYSLRTLCRALRFAASNPCGNIQRSLYEGFCLGFLTQLDRASHPIVQKLICQHIVPGNVKSLLKQPIPEPKGGRLIQVEGYWIAVGDKEPTIDETYILTSSVKLNLRDIVRVVSAGCVGFFLAAPNLIQA

SEQ ID NO: 920237 - protein, 109 aa, Homo sapiens
SSSFNVESMQNKTACSTSGCFPTLCPSLKECTTVGYSLNFCVFQPIPEPKGGRLIQVEGYWIAVGDKEPTIDETYILTSSVKLNLRDIVRVVSAGCVGFFLAAPNLIQA

SEQ ID NO: 920238 - protein, 893 aa, Homo sapiens; identical to SEQ ID NO: 920236

SEQ ID NO: 920239 - protein, 287 aa, Homo sapiens
YEDKKRKDRKYLCSIVEGTLAQAVKKGEWILLDEINLAAPEILECLSGLLEGSSGSLVLLDRGDTEPLVRHPDFRLFACMNPATDVGKRNLPPGIRNRFTELYVEELESKEDLQVLIVDYLKGLSVNKNTVQGIINFYTALRKESGTKLVDGTGHRPHYSLRTLCRALRFAASNPCGNIQRSLYEGFCLGFLTQLDRASHPIVQKLICQHIVPGNVKSLLKQPIPEPKGGRLIQVEGYWIAVGDKEPTIDETYILTSSVKLNLRDIVRVVSAGCVGFFLAAPNLIQA

SEQ ID NO: 920240 - protein, 195 aa, Homo sapiens
MIGDTAGVGSIWKLSVLSARFFCRPKTILKKEDCSSSQSQIELNLEKASGGGNFGCGENFGGRGGYDGGAGSRDSCRGGDGEYNGFGSDGGNYGGGLGYSKIRGYGGGGPGHENQGGGYGGNGGGCDGCNEGGNFDSGNYDGGGKYSDFGNYSGQQQSNYGPMKGGFLGGRSSGSPYGGDYGSGGKSGGYNNRRF

SEQ ID NO: 920241 - protein, 166 aa, Homo sapiens
STLMHTLMTNVRVHGVALVPLSLTDHEAVVDVLRDSQLWPLRMHSPLLRHQSQPVAICSQQPAPHISTGRTAHCTSTTPWSKRTCPQQNNVVLSISTGKPASWCSQLLHDGRSHTSQPTESLLLVFGEGENCYDALPQPFLRPPQLLLHPPPPPPTTRRPLEALCL

SEQ ID NO: 920242 - protein, 166 aa, Homo sapiens; identical to SEQ ID NO: 920241

SEQ ID NO: 920243 - protein, 206 aa, Homo sapiens
MLFLTFVPKAILSDLQAGQMISVLSESNPTSPRVHWKEWEGDARKPGHAGEVVPAEVCLLGLYSVTAVKKSPSMEPLTVGPIVRFIQRNKVTRQYHFQGTDPEMSHTLFNIKKTVLLRTRIIDLDARKVRAGEQTYFYGKEAVPSSSNHRSCPPWQVQGLSRDFIVGNPKKTQLRVRSQRVACQDECLHHFPLTTMPMYKVYHRGK

SEQ ID NO: 920244 - protein, 364 aa, Homo sapiens
MRLQTYWGWQAMETVYDANPRLCEDVVITDEASGHSTARHGHATAAALSPVLCREPQWAGGWEIPSLLKAKSHLAEGRQVQTLGGGAGFEQGQAPGGAAVQPGRGCEAQRVFAALQARPSVSPQRPSGPADSLREGAWPGCGTGGSAAPLTMLFTPELNPQAAPYQALASCPSLAARAEAPERPVSFFLLSQCLPSWSFADARCEGSMCAQTDAGYEVSVCTDGRWVRGERVHGRTLGASVCARTDAGCEVSVCTDGRWVRGERVCTDGRWVRGERVCTDGRWVRGERVCTDGRWVRGERVCTDGRWVRGEPVCMDGRWLRGECVCMDTGCEGSVSMKVGMDVQGCECGSWGRAQQMPESRQSL

SEQ ID NO: 920245 - protein, 139 aa, Homo sapiens
MLRYCTSLPTFTLSLGSSSCVHFSFLPPYEEDSLLPLHLPPLFSRGTLSKEEQEAEVEEAENKRQETRGLERKKLPGPLTRMSARAQLTLDSTARCEGKQRSSYTVNKCPFCSLCIATFFIFLCFLLGISLFKMLPPAR

SEQ ID NO: 920246 - protein, 192 aa, Homo sapiens
EHRTPSSPAFGLLDLHQWFARGSRVFGHRLKAALPVSLLLRFWDSDWLPCSSVCRQPMVGLLLVIVSLYGMDVEGKFEASPNSFLLLEPGPFLGDLQEESVPGDCSSQPYLPFYFRAGTLVTFLGKSLDVTSMAGDRGLGLSLESFPASAFPLGALFPSWINGRGSITEVCGFNRHMRCCLQAKLRISSCSK

SEQ ID NO: 920247 - protein, 134 aa, Homo sapiens
MIIESSLWPLQMPHLSCVLVLVLLAGPFNERDIREENFLHQTRGCEPPLRHHRALGISGLSSPFSRASLGQGGLRKEIMINHQHRHHQMYSVGCKGMISKRPYLVFPWIASLTKHPLKPPPNMPTRHYRHILFY

SEQ ID NO: 920248 - protein, 118 aa, Homo sapiens
PQKFFRSPLELSRVDNPGIFVAIKGLSRLNANASRGLTQQFWNLSARTSLIYPRYQKREINDIFHSIGKNTRLVIVKGGGVIPAEALSHMTNDKARGKQKEEGLSCSAPTWPVEAVRS

SEQ ID NO: 920249 - protein, 562 aa, Homo sapiens
MVGLGVHVKVCFIDPKFISAHLISESDNPEDDKVYFFFRENAIDGEHSGKATHARIGQICKNDFGGHRSLVNKWTTFLKARLICSVPGPNGIDTHFDELQDVFLMNFKDPKNPVVYGVFTTSSNIFKGSAVCMYSMSDVRRVFLGPYAHRDGPNYQWVPYQGRVPYPRPGTCPSKTFGGFDSTKDLPDDVITFARSHPAMYNPVFPMNNRPIVIKTDVNYQFTQIVVDRVDAEDGQYDVMFIGTDVGTVLKVVSIPKETWYDLEEVLLEEMTVFREPTAISAMELSTKQQQLYIGSTAGVAQLPLHRCDIYGKACAECCLARDPYCAWDGSACSRYFPTAKRRTRRQDIRNGDPLTHCSDLHHDNHHGHSPEERIIYGVENSSTFLECSPKSQRALVYWQFQRRNEERKEEIRVDDHIIRTDQGLLLRSLQQKDSGNYLCHAVEHGFIQTLLKVTLEVIDTEHLEELLHKDDDGDGSKTKEMSNSMTPSQKVWYRDFMQLINHPNLNTMDEFCEQVWKRDRKQRRQRPGHTPGNSNKWKHLQENKKGRNRRTHEFERAPRSV

SEQ ID NO: 920250 - protein, 122 aa, Homo sapiens
QDNIFKLENSHFENGRGKSPYDPKLLTASLLIDGELYSGTAADFMGRDFAIFRTLGHHHPIRTEQHDSRWLNDPKFISAHLISESDNPEDDKVYFFFRENAIDGEHSGKATHARIGQICKVR

SEQ ID NO: 920251 - protein, 182 aa, Homo sapiens
MTATNSPLLGNDQPVPEEEEVPPGGLRALGQHHGAVKDRLSVLEGQAQLQGQLLEGHCGCQALPEGGGDGVGPAGGFAQRKCRRALLHGDLIFSPQNFTWEMIYNLPGISYPTLGWRWLGEPVVLPQQRSLQRQSASVHGEAQCLHGLPGSGSVWWVFTYLVCGRALPKILSSPAAGTEEQL

SEQ ID NO: 920252 - protein, 225 aa, Homo sapiens
MMHLRIKGSEKQKFYKLRQEERKMGPAELRNKAEEKNNSSTEMKGTLDKMKWKIDVDANKVRNMKDDLVRPRWFATAAVGDAVVVPKSMELCSQENYGCLCCVMQLVREVGESRQLQASTSSYATQKAGLTPTMPPRTPPNSKEFASRRWVSEAKNLPQATRVPAEKASKAFAPSCLLSLHTGFFFWQPSPRTPVRQIRNGFPGAQGADRAFPAASSTPVFHSAF

SEQ ID NO: 920253 - protein, 428 aa, Homo sapiens
DKVCPAASEEIDTSRLFEWHDGPLVQAMKEDGFFLLDEISLADDSVLERLNSVLEVEKSLVLAEKGSPEDKDSEIELLTAGKKFRILATMNPGGDFGKKELSPALRNRFTEIWCPQSTSREDLIQIISHNLRPGLCLGRIDPKGSDIPEVMLDFIDWLTHQEFGRKCVVSIRDILSWVNFMNKMGEEAALKRPEIISTVTSFVHAACLVYIDGIGSGVTSSGFGTALLARKECLKFLIKRLAKIVRLTEYQKNELKIYDRMKAKEFTGIDNLWGIHPFFIPRGPVLHRNNIADYALSAGTTAMNAQRLLRATKLKKPILLEGSPGVGKTSLVGALAKASGNTLVRINLSEQTDITDLFGADLPVEGGKGGEFAWRDGPLLAALKAGHWVVLDEVRGLFVMPKTVIMCVRSSHPFTAPFHNPFLSGRSR

SEQ ID NO: 920254 - protein, 189 aa, Homo sapiens
MGIIRLSWKSLYRQENYNLEKPSIEDFLAVLEERYMEVYGDFIGSIAGCIRRMVPASPSGESFRKFPLMVEGEGEQASHGKREEEGENMEEEEEEKRQKKGSSNVREARRIESINPKPQRMRTRTQYIVVNDSTGSVLHRDELDEATRGYVFLNEELNQERGRIGARQQERGKGNSQNDSRGSARTTAV

SEQ ID NO: 920255 - protein, 354 aa, Homo sapiens
SPGANGVMEPIGARLKAPPAEELPAPVVPCVQGGGDGGGASETPSPDAQLGDRPLSPKEEAAPQEQEELLECRRRCRARSFSLPADPILQAAKFLQQQQQQAVALGGEGAEDAQLGPGGCCAKCKKRVQFADTLGLSLASVKHFSEAEEPQVPPAVLSRLRSFPMRAEDLEQLGGLLAAAAVAAPLSAPPSRLRPLFQLPGPSAAAERLQRQRVCLERVQCSTASGAEVKGSGRVLSCPGPRAVTVRYTFTEWRSFLDVPAELQPEPLEPQQPEAPSGASEPGSGDAKKEPGAECFHFSLCLPPGLQPEDEEDADERGVAVHFAVCYRCAQGEYWDNNAGANYTLRYARPADAL

SEQ ID NO: 920256 - protein, 503 aa, Homo sapiens
YTSVFALPLYRLAVTQPFLAMRHSISHSLEDRKITCSSNGLTPMTLSGERAYVAFPDFFRNSTAAWWKKEIEELYANPREPEKSLKFDGLWIEITQHFPSDLESRDKGLSSKTLCMESQQILPDSSPVEHYNVHNLYGWSQTRPTYEAVQEVTGQRGVIITRSTFPSSGRWGGHRLGNNTAAWDQLGKSIIDFSESAPHEIPTSCSHYASSQTGADICGFFGDAEYEMCVRWMQLGAFYPFSRNHNNIGTRRQDPVAWNSTFEMLSRKVLETRYTLLPYLYTLMHKAHVEGSTVVRPLLHEFTDDRTTWDIDRQFMLGPAILISPVLETSTFEISAYFPRARWYDYSTGTSSTSTGQRKILKAPLDHINLHVRGGYILPWQEPAMNTHSSRQNFMGLIVALDDNGTAEGQVFWDDGQSIGAYTTRTLGFKHKTDGAWNTSETEPFTPLESQGAECPCSADPNPTEPSKLRSTGLKYSPPAQLSEVDVGSSSLVEGGASAITEA

SEQ ID NO: 920257 - protein, 439 aa, Homo sapiens
MAASWSLLVTLRPLAQSPLRGRCVGCGAWAAALAPLATAPGKPFWKAYTVQTSESMTPTATSETYLKALAVCHGPLDHYDFLIKAHELKDDEHQRRVIQCLQKLHEDLKGYNIEAEGLFSKAVNQRKDWLTYGPMQGCSCEHGSCSQKWTVSVVGTMSDQSSTMVIGIHRLKQSLPKRKPGFMAKSYDPIAPIAEEISEEACLLCFDEFQVTDIADAMILKQLFENLFKNGVVVVATSNRPPEDCYKSWQRVEAKLSGWRNDPFEVASGARVENLSPPLYLERMGVITCEMRLLKTTDGWVLFLYPTCHSLPWSVGYVLKCVFVVAGEWVLQMPGALPGHGAERVLLHYDLYPGSVGQLRLLNQMRGCSECLEICLVVRQRGPLHTRLSAQEEWGRSSCRSRLVTGESTIPAPTAEALSTVLDVEAPYPTLEQVFQSLA

SEQ ID NO: 920258 - protein, 196 aa, Homo sapiens
MRLSFIVLKPYHSVFLGTTLQVHFGFCMERSVLLPCPVERAASAYQPYRQTRYTLGPFWSYSGKSMGALLIPIKPLLTVSKFIDLVAMKYPGILCQLPTGQHTDAMLAADGYQTCASWQLQPQAIDQMEMEKTLLSILPAKPVLFSIQDWNSPNQVLVSRQPERNIILLWPHAVKLLRVTNFPKEPTVVFASIYLY

SEQ ID NO: 920259 - protein, 141 aa, Homo sapiens
MDELKLFTVSWNRRHLAGLALSCHSPKENFVSDSSFMLTFSMPGSLMDIIRVMVPHTMPSTQGKQQAFARGKGELENIHLSAHLAEENYRKDKQEANVIGYLQDMIGDGKEGRRKGGKEEERRKGRRKKGKKEGDREKGRK

SEQ ID NO: 920260 - protein, 369 aa, Homo sapiens
MSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKDGAKKARKPREASGTKEAKEKRSCTDSAARTKSRKASKEQGPTPVEKKKKGKRKSETTVESLELDQGLTNPSLRSPEESTESTDSQKRRSGRQVKRRKYNEDLDFKVVDDDGETIAVLGAGRTSALSASTLAWQAEEPPEDDANIIEKILASKTVQEVHPGEPPFDLELFYVKYRNFSYLHCKWATMEELEKDPRIAQKIKRFRNKQAQMKHIFTEVKQYLLTHLTAAFLAAVNTVFTFLSPS

SEQ ID NO: 920261 - protein, 316 aa, Homo sapiens
MSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKDGAKKARKPREASGTKEAKEKRSCTDSAARTKSRKASKEQGPTPVEKKKKGKRKSETTVESLELDQGLTNPSLRSPEESTESTDSQKRRSGRQVKRRKYNEDLDFKVVDDDGETIAVLGAGRTSALSASTLAWQAEEPPEDDANIIEKILASKTVQEVHPGEPPFDLELFYVKYRNLYVYLKYSLYLGFI

SEQ ID NO: 920262 - protein, 391 aa, Homo sapiens [sequence omitted]

SEQ ID NO: 920263 - protein, 110 aa, Homo sapiens
MRTWTSKWWMMMGKQLLFLELVEHLHSQPLHWPGRRRSLQKMMQTSLRRSWHLRLSRRFTQENLRSTWSCSTLSIEIFPTYIVNGPQWKSSKRILASHRRSSDLGINKPR

SEQ ID NO: 920264 - protein, 369 aa, Homo sapiens; identical to SEQ ID NO: 920260

SEQ ID NO: 920265 - protein, 365 aa, Homo sapiens
MSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKDGAKKARKPREASGTKEAKEKRSCTDSAARTKSRKASKEQGPTPVEKKKKGKRKSETTVESLELDQGLTNPSLRSPEESTESTDSQKRRSGRQVKRRKYNEDLDFKVVDDDGETIAVLGAGRTSALSASTLAWQAEEPPEDDANIIEKILASKTVQEVHPGEPPFDLELFYVKYRNFSYLHCKWATMEELEKDPRIAQKIKRFRNKQAQMKHIFTEPDEDLFNPDYVEVDRILEVAHTK

SEQ ID NO: 920266 - protein, 251 aa, Homo sapiens
RQVKRRKYNEDLDFKVVDDDGKQLLFLELVEHLHSQPLHWPGRRSKEQGPTPVEKKKKGKRKSETTVESLELDQGLTNPSLRSPEESTESTDSQKRRSGRQVKRRKYNEDLDFKVVDDDGETIAVLGAGRTSALSASTLAWQAEEPPEDDANIIEKILASKTVQEVHPGEPPFDLELFYVKYRNFSYLHCKWATMEELEKDPRIAQKIKRFRNKQAQMKHIFTEVKQYLLTHLTAAFLAAVNTVFTFLSPS

SEQ ID NO: 920267 - protein, 160 aa, Homo sapiens
MPATLLGWPREMMQPHPVGAQRSADAARGSFFPRTLPGSGFPELRTETLSSLPLGLWALSIQSNWGSCKLCDLRNNGCYNFCKGSFTGMRPGQRAQPAGTPGLPLHPPYQLREAWCPRCQGLTPTGTPCGAAVGGGSAGRVSGGPGLFCLTPLPPSGCLP

SEQ ID NO: 920268 - protein, 152 aa, Homo sapiens
MMTMAVLWNRKGGKEELMARGDVYRCYFSPSQIKPVELTTHINLPLPPVAVQMSSSFLYTNNCHFDVTTLAKNSSDGLTNIFGNFSLKQSMTTQHSQQVNVNFDIGPLIALSFPRNSGVTTQPIPLSMRGHLLTANGGPQERPSRAEESTVA

SEQ ID NO: 920269 - protein, 152 aa, Homo sapiens; identical to SEQ ID NO: 920268

SEQ ID NO: 920270 - protein, 180 aa, Homo sapiens
MAVWPQPLCCTLLSSAQSKLSSLFSTVREKLTTEASVMVDTPSLTKLNHPRLTSDCCAGNDHSPLMTLLKIALFSQAGIGLTANTFLLFFCICTLPLDCRPKPTDLITCHLALVHLVMLLTVSFLASLDLFESQYFQNDFKCKVFFYMHRGMRALHLHHLPPECAPGCHHYPRHLLVGKN

SEQ ID NO: 920271 - protein, 180 aa, Homo sapiens; identical to SEQ ID NO: 920270

SEQ ID NO: 920272 - protein, 156 aa, Homo sapiens
EKPRMFFHICSWIRSVSFCPDPGPAPKEGSPSCRDSLALQQCGYVMGPHPKSTQPTPPAGQGQPLEEETGSGHEPTPGQPPGNVVRCDLFTDSGVLGSEQKRPGGPPGCLRGPGSMGQGEWLLPGLRLSGCPVSEAWQAIPDPTHRVYLWNSDCHD

SEQ ID NO: 920273 - protein, 146 aa, Homo sapiens [sequence omitted]

SEQ ID NO: 920274 - protein, 144 aa, Homo sapiens
MAEPGTLGPLAAAGRPGGRRRLAPSRAARLQAHSCTQLPRAALRCLPRTADSLARPPRLPGAGCVTSPIHGARLPRSAGAGRAVALTTQTPARTMTSSWSSPASLRAHSLACAGLQGARISCFKTAAFLEESPQLTTKQNPPGG

SEQ ID NO: 920275 - protein, 137 aa, Homo sapiens
MGKVLCKIFGNKEMWILMLRLDAAGKTTILTRSALSRHNYTGTQGLIFVVDCADCHRTDEACQELHHIINDREMRDAIILIFTNKQDLPDAMKPHKIQEKLGLTWIQDRNWYGQPSCATSGDGLCEGLTWLTSNYKS

SEQ ID NO: 920276 - protein, 266 aa, Homo sapiens
MRTEPLCGASPLLVPGDPYSVVVLLQGYAEPEGVGDAVRADGSVTLVLPQTRGPASSHRESPRGSGGAEAALEEAARGPILVDTGGPWAREALLGALAGQGVAPGDVTLVVGTHGHSDHIGNLGLFPGAALLVSHDFCLPGGRYLPHGLGEGQPLRLGPGLEVWATPGHGGQRDVSVVVAGTALGTVVVAGDVFERDGDEDSWQALSEDPAAQERSRKRVLVVADVVVPGHGPPFRVLREASQPETEGGGNSQQEPVVGDEEPALH

SEQ ID NO: 920277 - protein, 454 aa, Homo sapiens
MFTFLSSVTAAVSGLLVGYELGIISGALLQIKTLLALSCHEQEMVVSSLVIGALLASLTGGVLIDRYGRRTAIILSSCLLGLGSLVLILSLSYTVLIVGRIAIGVSISLSSIATCVYIAEIAPQHRRGLLVSLNELMIVIGILSAYISNYAFANVFHGWKYMFGLVIPLGVLQAIAMYFLPPSPRFLVMKGQEGAASKVLGRLRALSDTTEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGSSVMAASLVTMGIVNLNIHMNFTHICRSHNSINQSLDESVIYGPGNLSTNNNTLRDHFKGISSHSRSSLMPLRNDVDKRGETTSASLLNAGLSHTEYQIVTDPGDVPAFLKWLSLASLLVYVAAFSIGLGPRSRRQTNWLK

SEQ ID NO: 920278 - protein, 142 aa, Homo sapiens
MLGVQLSPTESRLEGTRLQACRSCISGWPRARPGPTAAPRTGFMPHAWLLTTTECLSRDWMEAEEVSLEASPTQTHGFLVEAVCTPALTWLCEESGEGLQGNILAPSQDPLRVPGPRGLHLSEAPSILPPASPRTLCMSLGR

SEQ ID NO: 920279 - protein, 156 aa, Homo sapiens
SHAVPSLAPPYPSEMGSQSASSAPDNLNLIQFPPPGSLPSPCCRPPMGPTESSAPTERPAFREVPAQGGASIKSQKLSIYGSQTEVLSKNPDSLSKKPPRNLDSAVLDAWYQHLLLMMAYGCFHSQQKVKQGDQADPALVLVKAETLSLGCSSLIT

SEQ ID NO: 920280 - protein, 137 aa, Homo sapiens
VNWEILNMDCRLDYIEIASLLGVTRALRTRRRMLIHRQKYVQGASWHLQLTNVPTAKKKVTGSAFGKTPTIGESGSSLLESKISSINSPWYKSRQEWKNGETPVCKKSEVTAIRNTYSKQQRGALTPQVLQVPQSCC

SEQ ID NO: 920281 - protein, 147 aa, Homo sapiens
WSRGTKGQAMKFPAGARVPPFHSQALWKADSQGHKQVFVCQEGPLLGLSVHTITHRLCPISEHNEEAMTTPTWAWAFTQEFGSHGKTPWKMPWGSTTTRIHIHSIALVGPPEHSCKRHVVSQIPGRGRASVTTTTSEEMKAQRSCET

SEQ ID NO: 920282 - protein, 173 aa, Homo sapiens [sequence omitted]

SEQ ID NO: 920283 - protein, 463 aa, Homo sapiens
MLKEHPEMAEAPQQQLGIPVVKLEKELPWGRGREDPSPETFRLRFRQFRYQEAAGPQEALRELQELCRRWLRPELHTKEQILELLVLEQFLTILPREFYAWIREHGPESGKALAAMVEDLTERALEAKAVGEEGIQLGPVEVKPEWGMPPGEGVQGPDPGTEEQLSQDPGDETRAFQEQGGGSKEKEAKPPQEDLKGALVALTSERFGEASLQGPGLGRVCEQEPGGPAGSAPGLPPPQHGAIPLPDEVKTHSSFWKPFQCPECGKGFSRSSNLVRHQRTHEEKSYGCVECGKGFTLREYLMKHQRTHLGKRPYVCSECWKTFSQRHHLEVHQRSHTGEKPYKCGDCWKSFSRRQHLQVHRRTHTGEKPYTCECGKSFSRNANLAVHRRAHTGEKPYGCQVCGKRFSKGERLVRHQRIHTGEKPYHCPACGRSFNQRSILNRHQKTQHRQEPLVQSNGYLVNS

SEQ ID NO: 920284 - protein, 289 aa, Homo sapiens
NASSVTICTSERSMESGLCCATVQCVEGAVQQLCSVETEYCYTMQGAEPTVCTGLITDIWYSMAELARAMMHHGSATSIMGMTQSCTRHTAPLQCIYWYTELRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTEKPSTREIATTDTPLSLHCPTGSSSSILASTNRPLLSIPPQSPDQINGESFQNVSKNASSAANAQPHKLSETPGNKAEFHPCL

SEQ ID NO: 920285 - protein, 1704 aa, Homo sapiens
MKKMETEETFEIDGSSVQLVSLSAITLETGNTSRKTKKPLGPNGYHFVKQVKEGGPAFEAGLCTGDQIIKVNGESVIGKTYSQVISLIQNSDTTLELSVMPQYEDILQVAYSQDAYLKGNEAYSGNARNIPEPPPICYPWLPSAPSAMAQPVEIAPPDSSLSKQQTSTPVLTQPGRAYRMEIQVPPSPTDVAKSNTAVCVCNESVRTVIVPSEKVVDLLSNRNNHTGPSHRIEEVRYGVNEQTSLKTVSRTTSPPLSIPTTHLIHQPAGSRSLEPSGILLKSGNYSGHSDGISSSRSQAVEAPSVSVNHYLPNSHQHIDWKNYKTYKEYIDNRRLHIGCRTIQERLDSLRAASQSTMDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGIYERPRQQEIHKSFRGSNFTVAPSVVNSDNRRMSGRGVGSVSQFKKIPPDLKTLQSNRNFQTACGMSLPRGISQDRSPLVKVRSNSLKAPSTHVTKPSFNQKSFVSIKDQRPVNHLHQNSLLNQQTWSSENAGTSDLELPVSQRNQDLSLQEAEIEQSDTLDNKEAVILREKPPSGHQTPQPLRHQSYILAVNDQETRSDTTCWLPMMHLSHDHESVGPHSLNAQPNSKTERSKSYDEGLDDYREDVKLSFKHVSSLKGIKVADSQKSSEDSGSRKDSSSEAFSDAAKEGWLHFRSLVTDNGNETKRKNVFRLTTSDCECLFQAEDRDDMLAWIKTIQESSNLNEEDTGVTNRDLISRTIKEYNNLMSKAEQLPKTPRQSLSIRQTLPGAKSEPKTQSPHSPKEESERKLLSKDDTSPPKDESTWRKGIPSIMRKTFERKPTATGTFGVRLDDCPPAHTNRYIPLIVDICCKLVEERGLEYTRIYRVPGNNAAISSMQEELNKGMADIDIQDDKCSLLKCFSRKLPESLFTNDKYADFIEANRKEEPLDRLKTLKRLIHDLPEHHYETLKFLSAHLKTVAENSEKNKMEPGNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSSPHNSEHNKSPTLSCRFAILKDSPRSLLAQKSSHLEETGSDSGTLLSTEFLANVSTITSDYSTTSSAAYLTSLDSSRLSPEVQSAAESKGDEADDERSELISKGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKTADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTEKPSTREIATTDTPLSLHCPTGSSSSILASTNRPLLSIPPQSPDQINGESFQNVSKNASSAANAQPHKLSETPGNKAEFHPCL

SEQ ID NO: 920286 - protein, 205 aa, Homo sapiens
MAVCTINHVMKHPGPTRWLLKTAERQNLVLSGQGHLVGHPAAILAKWVLLGRKLVVEHHEGINISGNFWRNKLKYLAFLCKQMSTNPSQGPPAPPFLGPQRIFWWPCRTKKKKQLMRLQKQATKNVEKTNDKYTEVLRPRDSLFETRKDCLFLMLGLAYPSAIATLGYGGAYPSCITALGCGGSKGSNIGAMGSLGLKLGAREGP

SEQ ID NO: 920287 - protein, 174 aa, Homo sapiens
MGYTTTMPLLQRQFPDPSPRDIVKIYRLFFTFTSLLRAVTLTVKVRGFLKLEKARTRRQLHNRLQGSVAGTGASAAFAGQLKLPVCVGLGPTGSRRPALPTGSAVPRHSTDPKALRSISPGALAATPGTRARDPHPAMPASQPTPCRGLLCGRSLPNERRPLLSGARSHRPPKG

SEQ ID NO: 920288 - protein, 335 aa, Homo sapiens
MCHNHDAQLRFFLVVQVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEGNCLCSNANYLPGTLARRNSEQGGRACRGGMSTVHSKAATRCIFGPSSPPLENANPHVAGLPVGVWAFHWVRMHHFPFSADLHYPAAPDVIVEPVYQYISIFSAQSPAQAALEEVILDLHQAWRREIHLLSLSLK

SEQ ID NO: 920289 - protein, 172 aa, Homo sapiens
PIRPSWLHPLEKSSMQKNSKCILPLLKCGLTMVTSFKERYIDDSFSSLIKRILSFLLLHYDKKRNKLMLPCFKIIEVYSTFKKYFTRKIWRIHFIIDKLTKNTGKKKDNQGHYKGALCQKLGLKNKYRTNYSSSTPTARILRTLSQDKDLRVTRCTLLASAGFSQGQVPIPT

SEQ ID NO: 920290 - protein, 172 aa, Homo sapiens; identical to SEQ ID NO: 920289

SEQ ID NO: 920291 - protein, 727 aa, Homo sapiens
MRGLFGVMDVTDDMRGLFGVMDVTDDMRDLFGVTDAVDDMRDLFGVMDVTDMRDLFGVMDVTDMRDLFGVMDVTDDMRDLFGVMDVTDDMRGLFGVMDVTDDMRDLFGVMDVTDDMRGLFGVTDVTDDLRGLFGVMDVTDDMRGLFGVMDVTDVRDLFGVWMLQILHPPPSMPSTLLTNSPSTFSQLAQLKGQPPASKAVRASSSGTTWEKVTVASGKASWLRLLGPGTLIPGGQHSNVRWASDLEDRAPRHSPWLRVKKRRPHGGPSTKRPVNEVCLYGRASSRRDPHHRETILWAHRRTHCAHSGALWGGSSEHSGEPLAAVVTGGQPIAKRLALCPHPASTRLDSPQRLHGGLGSCDGRGPHRRGPKSAPGSALDRLWVLERLAQPCAALSHADPVGRTPYCRSLTESYKKEPQRTEPLAPQPLWKDMVCVPGKRCKAVVPVTSSDSHPNAGDCTFVFSPVHRLKALPPVQLCLDLGLWEVMMVCVLLVAAAAALRHWPHLVSPQPLQPRGEGHPLAFKHRCTHRGTTATVELWNVPVTHSPPLSHCRHPQPCPDPQPASQSLPITHSPASQSLPVTHSPASQSLPSPTALPLSHCPSPTALPLSHCPSPTALPLSHCPSPTALPLSPCRHPQPCLSVTARHPQPCLSVPAVTLAAPGVAQKWNCVLGCLRAQPLSLRDSSLLLCGAVVGRSQLGRARPGNRPLLLRWFPRWWTGLSAHFSCHQ

SEQ ID NO: 920292 - protein, 208 aa, Homo sapiens
MIFSAAASTYRCSLPQSLQTDNDDLTHPLPPPGSPGFSGPQCATDACFKGVPRCYAGESGFTVATTNYSTFNTICECWVWPGKISEPPGTQTRKLQCQRRSHLPMRANASNVCRIPESSQELRLNIPEPAVETLESDPGRGTHQDDNWQPSEMTEMQDFESKDAFRLLGPGDEVNTSHPGSPSASWGRFWRPEAQNQGAGRVGSSCKL

SEQ ID NO: 920293 - protein, 208 aa, Homo sapiens; identical to SEQ ID NO: 920292

SEQ ID NO: 920294 - protein, 208 aa, Homo sapiens; identical to SEQ ID NO: 920292

SEQ ID NO: 920295 - protein, 185 aa, Homo sapiens
MDQYTKLVSEEWGVAEKIPENVETILELGNRQRLERFGGSQNGRSTDSLHHVPGKATDTQCQPVKAAGRKAVPCKATGEELPNTMGTHLLHQHDLDEVTAPKFITTFPHLDLQKAKLMFVKSGQYPRGVYVNPKPHDFRQLMDQNSIGLPELWPECSSPVHFPVRTLMNSGTFLDSTEICTLPEA

SEQ ID NO: 920296 - protein, 160 aa, Homo sapiens
LTKYLLSFSPEITSSCKVSWAQVGMQAFSIPRDRKWLFWTSPAIKPLSHDFPNSKPQLGYQGMALSVFNGLQLKQVQKCEDCKLESNSADAAHRGRMIQGAKLCLIKSENFLQMNFSRIMPKHWQTHAQKCTEKEYPNIEHQRPSDFGASILKWFATITN

SEQ ID NO: 920297 - protein, 209 aa, Homo sapiens
RNLTLLPRLECSVVPGVKAERFEEGMTVKHCALSLVGEPIMYPEINRFLKLLHQCKISSFLVTNAQFPAEIRRLPSVIDGGRWPSSTDPMWNLEPVTQLYVSVDASTKDSLKKIDRPLFKDFWQQFLDSLKALAVKPISDLVLPKEEDGMTQEVPKEGKEGACGNKSVEDFNVKHIESESGKNLIKILVQFHATQGNSEFPERLPSKGF

SEQ ID NO: 920298 - protein, 134 aa, Homo sapiens
MAMNGGRGVLGNHYWLQPDEIPSYPLLYGTCSSWVFLGMGLGQVGIHVLGLHGLHCLQPGCLGLGKSPRLKDGWRLCPPFWENNLQEFQRDGGWHNEMKAAASEKQKEESGLNAHLAFPPWGSHPSPAKCATVW

SEQ ID NO: 920299 - protein, 848 aa, Homo sapiens
METKDMLYIVTEFAKNGEMFDYLTSNGHLSENEARKKFWQILSAVEYCHDHHIVHRDLKTENLLLDGNMDIKLAGTEDFGFGNFYKSGEPLSTWCGSPPYAAPEVFEGKEYEGPQLDIWSLGVVLYVLVCGSLPFDGPNLPTLRQRVLEGRFRIPFFMSQDCESLIRRMLVVDPARRITIAQIRQHRWMRAEPCLPGPACPAFSAHSYTSNLGDYDEQALGIMQTLGVDRQRTVESLQNSSYNHFAAIYYLLLERLKEYRNAQCARPGPARQPRPRSSDLSGLEVPQEGLSTDPFRPALLCPQPQTLVQSVLQAEMDCELQSSLQWVSAHSGCAEGSPQPSPGAPGVPGCSGVFRPRPVSPSSLLDTAISEEARQGPGLEEEQDTQESLPSSTGRRHTLAEVSTRLSPLTAPCIVVSPSTTASPAEGTSSDSCLTFSASKSPAGLSGTPATQGLLGACSPVRLASPFLGSQSATPVLQAQGGLGGAVLLPVSFQEGRRASDTSLTQVRDFVRDGRWHPLFSTGPGWDPQCSGQAGVLSALVARGVTACWDRHTWVPEHAASMAGSESTGDDSVLAAPPDLEEGGPLAAGCLHAILGLRCQTPVQTCLCHPSFPYPQPEAWKPLKPRAVDAGLRAGWPLTSCFILPAGLKAFRQQLRKTTRTKGFLGLNKIKGLARQVCQAPASRASRGGLSPFHAPAQSPGLHGGAAGSREGWSLLEEVLEQQRLLQLQHHPAAAPGCSQAPQPAPAPFVIAPCDGPGAAPLPSTLLTSGLPLLPPPLLQTGASPVASAAQLLDTHLHIGTGPTALPAVPPPRLARLAPGCEPLGLLQGDCEMEDLMPCSLGTFVLVQ

SEQ ID NO: 920300 - protein, 536 aa, Homo sapiens
SVEPGERGVTITTVMQAMGSGINTDEASLGHLPLTFCCVAWFLTGHGPVLAHGLGVNFVVCQLVALFAAFWFRIYLRPGTTSSDVRHAVATIFGIYFVIFCFGCNGISYNMPHQPNIHLPLWNSHYGFFWDWMIVFHTDEGGSSLFSPWIQMLISFGNPHRPLMIVTQKITTLAFQVHDGKNSSPPFGSQRLGRRAEDLSAEQHRLAIKNSGLVAKADNRLLLRFFCVASFSGNCVIAGPCNNFKDYIAFIEGKHIHMKLLEVNWKRKGFHSLPEPSPTGAVIHKLGITLVSLLLFLTLTKTFPVTCLVDDWFVHKASFPARLCYLYVVMQASKPKYYFAWTLADAVNNAAGFGFSGVDKNGNFCWDLLSNLNIWKIETATSFKMYLENWNIQTATWLKCVCYQRVPWYPTVLTFILSALWHGVYPGYYFTFLTGILVTLAARAVRNNYRHYFLSSRALKAVYDAGTWAVTQLAVSYTVAPFVMLAVEPTISLYKSMYFYLHIISLLIILFLPMKPQAHTQRRPQTLNSINKRKTD

SEQ ID NO: 920301 - protein, 143 aa, Homo sapiens
MIEPCPWEEAVCFDSELDEHIKWFQQEYVKTEKDWREIDKRMSQTLEIRRKMIGSRTPLKDILKLFPFLKCPYQNKGCGIFEVSSLLADLAGTGPDVCDLCSSATASRLGNTVTHPACPTGYCPESSSICSALNNGCISTFWV

SEQ ID NO: 920302 - protein, 122 aa, Homo sapiens
PTLMDLFKGPVSKYSHILRYWELGLQDTNFREAHSSPSQRHKGPEREASLLMRKNRHSQRTRSTCQAATAQHTLESEVGVSCEEREEGRKRIRCAPTTGQGTKKRGKENSWALRLIPVIPAL

SEQ ID NO: 920303 - protein, 129 aa, Homo sapiens
PTLMDLFKGPVSKYSHILRYWELGLQDTNFREAHSSPSQRHKGPEREASLLMRKNRHSQRTRSTCQAATAQHTLESEVGVSCEEREEGRKRIRCAPTTGQGQKTVFTKSLPKILANAHNLKVFLRALPI

SEQ ID NO: 920304 - protein, 139 aa, Homo sapiens
MDRKITVFSLLSTLSHSVQHFCHQLYRGFPHMKQFLPHMKQFHVLSVSSRHLHVFTYVEAPQTQLQNVLDGGCSFSKDPSQDDRDTKQSSWLTSKGHLADIMAKTLGNFPETDSFVLGNLPALSAMALAGFYTSLVQRK

SEQ ID NO: 920305 - protein, 357 aa, Homo sapiens
MSGKTKARRAAMFFRRCSEDASGSASGNALLSEDENPDANGVTRSWKIILSTMLTLTFLLVGLLNHQWLKETDVPQKSRQLYAIIAEYGSRLYKYQARLRMPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 920306 - protein, 416 aa, Homo sapiens
SGWEPQLLNFMVRGLMFKSFIYFKDDATEESEAFQNSVFKKKHPWRKKTLYKTNLETGIMSGKTKARRAAMFFRRCSEDASGSASGNALLSEDENPDANGVTRSWKIILSTMLTLTFLLVGLLNHQWLKETDVPQKSRQLYAIIAEYGSRLYKYQARLRMPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 920307 - protein, 407 aa, Homo sapiens
SGWEPQLLNFMVRGLMFKSFIYFKDDATEESEAFQNSVFKKKHPWRKKTLYKTNLETGIMSGKTKARRAAMFFRRCSEDASGSASGNALLSEDENPDANGVTRSWKIILSTMLTLTFLLVGLLNHQWLKETDVPQKSRQLYAIIAEYGSRLYKYQARLRMPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQGPWHTRQAHLEELVQKAMPHVQNIQECLFS

SEQ ID NO: 920308 - protein, 197 aa, Homo sapiens
PFQLSTHHFHSVESRMQVRPRPVVEILECSCQMKRKTRDKRGGAGKRKEKTCLPAHRYDPGALGEKRKQALSHHYGCTTAAIPTGLQGAPLTLGQTSCSTKFLSKLKGKNEWAACSQPPGTGKRGSFSFRSIPSTKKGVEGAENVPHSEALLPRGPPFGEEHGWNESEVRRSQPNVTVAEGEGKVGKGEGDGGQETC

SEQ ID NO: 920309 - protein, 132 aa, Homo sapiens
MLIGLGEQEVAGTLDVIVKHMKVKHKSFTVSKSCHIGEDFRSPMVCSILRAFSEDFSAHLAQDQHSPEVQGHYHARGNPPAVGDTSLWMKVPTSHHSDEKHQEASCTFLRGHSRINPPLHTAAISIMHHSIS

SEQ ID NO: 920310 - protein, 138 aa, Homo sapiens
MESFHTRFSAWTPFSNKSLNRQLFQERVALISHWFDLWTNKQRQEFLFAIFLRCTKSQLRRKHRMKLAEDSKADVTENLGDSYRDCCMGSRERDWAQLQMQHGRIAKEQDGAQWMENYSRKHQGEERGVFKVKVYTCI

SEQ ID NO: 920311 - protein, 137 aa, Homo sapiens
MRPSSFGIQYSIVNHGHLGQRSPETEFASTLIVDFQPPEQREESLLDTKPVTWGRCHLKACVAGSVTVDTKPVTWGRCHLKACVAGSLYKRRQNFLPQSRCWCVAGPKQAPTDSSATGPPGGTAGVGSSPGLEEQRF

SEQ ID NO: 920312 - protein, 137 aa, Homo sapiens; identical to SEQ ID NO: 920311

SEQ ID NO: 920313 - protein, 153 aa, Homo sapiens
SPPLPQGNGSMEHATPSLLERLDLKKISSSFWNLQGLGNLKDSGELVRLPKLVGFSDPFFFPAAVHIHVHIFVWTPVFSSTGSTQESDGYMVTQSSGQAQEQNHRTVTRSLGSTEESNGHMATRSLGNGSFSSSSTRSQATLPLSSKCLPAFS

SEQ ID NO: 920314 - protein, 158 aa, Homo sapiens
MTEIEFRIWIRMKIIELQEYVETQCKEVKNHDKTMPELTDNNGQYRKDSRLIKKKREKIQMKTIRNDERDIITDLTEIQTTTRDYYEHFYAHKLENLEVDKFLDPFTLPKLNQEEIERYTKKRKLQTNIFDEHQCKNSQQNTGKPNPATSESLSTTIK

SEQ ID NO: 920315 - protein, 66 aa, Homo sapiens
MVEKTLNDLMELKTMARTSCLRFLTSSGIPRGLETQNLKSLQSDFSLTIPAHCLLWTNTEHETLLT

SEQ ID NO: 920316 - protein, 139 aa, Homo sapiens
MRSHSSTLGRSMGLGAMKQGAALVWEAQAAQEPMEGVGGSGMAGCRSRALPCGKAAKAQVRNRAQRQWAGTAGGPSTPSAATGQGAKPLTARGRQGRPAAPSAGPAKPTPTQNSSWPASAERSPQNWRRKSQGSQRTAR

SEQ ID NO: 920317 - protein, 174 aa, Homo sapiens
IHGYSKYMHAICMYMFYTQILRERLRESIHNVQYVEPPFDDSIADIGKEWKSALAKLKFANSYRMEPLKKFQAHSVETKVQQILTESLKDVKYDDKVFSHLSLELADRILLAVKEFGYHRYKFIIKVLFIQKTGQAINIASRWIWDIAWDSWVAAKHEAESYVALVLVFALYYE

SEQ ID NO: 920318 - protein, 142 aa, Homo sapiens
MGRVDSHEDYDYSQHEWHPQALCLQTYSELGNASTSDTQENRVWSGPPANSSRPAEQGPDCEKKTNKHKAIASTSTKRTTMQKLHLKVPTAKTKAAREQNWMENEFDELTEVGFRRWVIINYSELKEQVLTQCKEAKNLEKG

SEQ ID NO: 920319 - protein, 178 aa, Homo sapiens
YKDTPSPMSPSGESQSLKVKGPQEFHKSQCKEVGKAPKCFCGGSGFLWQGQAQEEEAGERQRQHLLPAVTSEPYQPALLPACFWNECIPGWWNRRRLPLSSQKLPTTSRASQSPSLFLPNHYHLQTRRGPLPGFQAYSQTSEMSSLPPDPFMVRGAALTVSIPCIEKGVIAIRTLALI

SEQ ID NO: 920320 - protein, 985 aa, Homo sapiens
MAASVAAAARRLRRAIRRSPAWRGLSHRPLSSEPPAAKASAVRAAFLNFFRDRHGHRLVPSASVRPRGDPSLLFVNAGMNQFKPIFLGTVDPRSEMAGFRRVANSQKCVRAGGHHNDLEDVGRDLSHHTFFEMLGNWAFGGEYFKEEACNMAWELLTQVYGIPEERLWISYFDGDPKAGLDPDLETRDIWLSLGVPASRVLSFGPQENFWEMGDTGPCGPCTEIHYDLAGGVGAPQLVELWNLVFMQHNREADGSLQPLPQRHVDTGMGLERLVAVLQGKHSTYDTDLFSPLLNAIQQGCRAPPYLGRVGVADEGRTDTAYRVVADHIRTLSVCISDGVFPGMSGPPLVLRRILRRAVRFSMEILKAPPGFLGSLVPVVVETLGDAYPELQRNSAQIANLVSEDEAAFLASLERGRRIIDRTLRTLGPSDMFPAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYLVRAGQEDVLFPVARAQVCGGFILHEAVAPECLRLGDQVQLHVDEAWRLGCMAKHTATHLLNWALRQTLGPGTEQQGSHLNPEQLRLDVTTQTPLTPEQLRAVENTVQEAVGQDEAVYMEEVPLALTAQVPGLRSLDEVYPDPVRVVSVGVPVAHALDPASQAALQTSVELCCGTHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQGAMPTFTAEAWALAVCSHMGGKAWGSRVVAQGTGSTTDLEAALSIAQTYALSQL

SEQ ID NO: 920321 - protein, 985 aa, Homo sapiens; identical to SEQ ID NO: 920320

SEQ ID NO: 920322 - protein, 951 aa, Homo sapiens
MAASVAAAARRLRRAIRRSPAWRGLSHRPLSSEPPAAKASAVRAAFLNFFRDRHGHRLVPSASVRPRGDPSLLFVNAGMNQFKPIFLGTVDPRSEMAGFRRVANSQKCVRAGGHHNDLEDVGRDLSHHTFFEMLGNWAFGGEYFKEEACNMAWELLTQVYGIPEERLWISYFDGDPKAGLDPDLETRDIWLSLGVPASRVLSFGPQENFWEMGDTGPCGPCTEIHYDLAGGVGAPQLVELWNLVFMQHNREADGSLQPLPQRHVDTGMGLERLVAVLQGKHSTYDTDLFSPLLNAIQQGCRAPPYLGRVGVADEGRTDTAYRVVADHIRTLSVCISDGVFPGMSGPPLVLRRILRRAVRFSMEILKAPPGFLGSLVPVVVETLGDAYPELQRNSAQIANLVSEDEAAFLASLERGRRIIDRTLRTLGPSDMFPAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYLVRAGQEDVLFPVARAQVCGGFILHEAVAPECLRLGDQVQLHVDEAWRLGCMAKHTATHLLNWALRQTLGPGTEQQGSHLNPEQLRLDVTTQTPLTPEQLRAVENTVQEAVGQDEAVYMEEVPLALTAQVPGLRSLDEVYPDPVRVVSVGVPVAHALDPASQAALQTSVELCCGTHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQVREVGEQPTAPINTHPGPAL

SEQ ID NO: 920323 - protein, 519 aa, Homo sapiens
MAASVAAAARRLRRAIRRSPAWRGLSHRPLSSEPPAAKASAVRAAFLNFFRDRHGHRLVPSASVRPRGDPSLLFVNAGMNQFKPIFLGTVDPRSEMAGFRRVANSQKCVRAGGHHNDLEDVGRDLSHHTFFEMLGNWAFGGEYFKEEACNMAWELLTQVYGIPEERLWISYFDGDPKAGLDPDLETRDIWLSLGVPASRVLSFGPQENFWEMGDTGPCGPCTEIHYDLAGGVGAPQLVELWNLVFMQHNREADGSLQPLPQRHVDTGMGLERLVAVLQGKHSTYDTDLFSPLLNAIQQGCRAPPYLGRVGVADEGRTDTAYRVVADHIRTLSVCISDGVFPGMSGPPLVLRRILRRAVRFSMEILKAPPGFLGSLVPVVVETLGDAYPELQRNSAQIANLVSEDEAAFLASLERGRRIIDRTLRTLGPSDMFPAEVAWSLSLCGDLGLPLDMVELMLEEKGVQLDSAGLERHSKGPLIVDTVSAESLSGCGNCCDAPVAAAGAAGHSEDAAAACQHCHP

SEQ ID NO: 920324 - protein, 223 aa, Homo sapiens
GDARWLLPSLLSCPDFLFTPSSHRHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQVREVGEQPTAPINTHPGPAL

SEQ ID NO: 920325 - protein, 625 aa, Homo sapiens
MAASVAAAARRLRRAIRRSPAWRGLSHRPLSSEPPAAKASAVRAAFLNFFRDRHGHRLVPSASVRPRGDPSLLFVNAGMNQFKPIFLGTVDPRSEMAGFRRVANSQKCVRAGGHHNDLEDVGRDLSHHTFFEMLGNWAFGGEYFKEEACNMAWELLTQVYGIPEERLWISYFDGDPKAGLDPDLETRDIWLSLGVPASRVLSFGPQENFWEMGDTGPCGPCTEIHYDLAGGVGAPQLVELWNLVFMQHNREADGSLQPLPQRHVDTGMGLERLVAVLQGKHSTYDTDLFSPLLNAIQQGCRAPPYLGRVGVADEGRTDTAYRVVADHIRTLSVCISDGVFPGMSGPPLVLRRILRRAVRFSMEILKAPPGFLGSLVPVVVETLGDAYPELQRNSAQIANLVSEDEAAFLASLERGRRIIDRTLRTLGPSDMFPAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYPPSSTLSHSLTAGMGALSFPGAHVLGPDSPVSRKGQKQHREVRHHPKY

SEQ ID NO: 920326 - protein, 985 aa, Homo sapiens; identical to SEQ ID NO: 920320

SEQ ID NO: 920327 - protein, 670 aa, Homo sapiens
GVNRHRRVVADHIRTLSVCISDGVFPGMSGPPLVLRRILRRAVRFSMEILKAPPGFLGSLVPVVVETLGDAYPELQRNSAQIANLVSEDEAAFLASLERGRRIIDRTLRTLGPSDMFPAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYLVRAGQEDVLFPVARAQVCGGFILHEAVAPECLRLGDQVQLHVDEAWRLGCMAKHTATHLLNWALRQTLGPGTEQQGSHLNPEQLRLDVTTQTPLTPEQLRAVENTVQEAVGQDEAVYMEEVPLALTAQVPGLRSLDEVYPDPVRVVSVGVPVAHALDPASQAALQTSVELCCGTHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQGAMPTFTAEAWALAVCSHMGGKAWGSRVVAQGTGSTTDLEAALSIAQTYALSQL

SEQ ID NO: 920328 - protein, 257 aa, Homo sapiens
GDARWLLPSLLSCPDFLFTPSSHRHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQGAMPTFTAEAWALAVCSHMGGKAWGSRVVAQGTGSTTDLEAALSIAQTYALSQL

SEQ ID NO: 920329 - protein, 81 aa, Homo sapiens
YLAGSLEVPYTSLNSHCLKGHPGSKSGHLHCHECSDRLCVPGNSGQTKGSLATGKIQNHPVKIISALETFFAITSFINNDL

SEQ ID NO: 920330 - protein, 389 aa, Homo sapiens
GYGFHDFSSRYHYLENCGVNELKVNLLQSLPFHLHQQGLVEGEHPLLGSHHTAFQHDKVIGHFTIVDKATQRIGALVRQVRVSGGIVLDQLAILDKVALANLIDLLVDLSAVTVAFLPSTCHREGHTSRMPCPNTGHLAQASVGLAGQLLGVPTTGDPFVAFALGHPNDVDHLILPKHLVHIYLLLEPLADPVQLLSHGASVHLDLHQVGLLLAQRKQAHLGVGNDADDVAVFLHAAEVLLQLLLDILILPFLAVLRKGLLFRFMPVLIETPLAFITDVLSEDSLEGPEASRGFHIAHNAHNHHGWRLHNGHSLHHLLLVHLGCWAVDFPHDVGHASFVSQEGCEVDRLGRIILREALHLPTMPAAALLRQEAEGPMSGSRKLSPLRLA

SEQ ID NO: 920331 - protein, 431 aa, Homo sapiens
ESALASGHNHLPRTAQMNLKSTGFCASEKETEAGHLNPWSHECFLLLHGLEAAMAKLGGGVNELKVNLLQSLPFHLHQQGLVEGEHPLLGSHHTAFQHDKVIGHFTIVDKATQRIGALVRQVRVSGGIVLDQLAILDKVALANLIDLLVDLSAVTVAFLPSTCHREGHTSRMPCPNTGHLAQASVGLAGQLLGVPTTGDPFVAFALGHPNDVDHLILPKHLVHIYLLLEPLADPVQLLSHGASVHLDLHQVGLLLAQRKQAHLGVGNDADDVAVFLHAAEVLLQLLLDILILPFLAVLRKGLLFRFMPVLIETPLAFITDVLSEDSLEGPEASRGFHIAHNAHNHHGWRLHNGHSLHHLLLVHLGCWAVDFPHDVGHASFVSQEGCEVDRLGRIILREALHLPTMPAAALLRQEAEGPMSGSRKLSPLRLA

SEQ ID NO: 920332 - protein, 481 aa, Homo sapiens
MCFSSHWYKDAISISRLQNPRYKVLASGGLRIQKLRPEDSGIFQCFASNEGGEIQTHTYLDVTSEYTQAHSYLTWTYPLPDLDVSSEYTQLHGYLDVTTGYTQAHSYLTWTYPLPDLDVSSEYTQPHGYLDVTSGYTQAHSYLIWTYPLPDLDVSSEYIQPHGYLDVTSGYTQAHSYLTWTYPLPDLDVSSEHTQADGYPDVSSGYTHAHGYPDVSSGYTLAHSYLDVSSGTPEAFVGPVGKLLRPTSSTDGCHSPALVPSSSQGQRVCREEKGSEGRDDSSQPGVLQKRGADIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVM

SEQ ID NO: 920333 - protein, 401 aa, Homo sapiens
MSVCSSDLSYSSRVCLPGSCDSCSDSWQVDDCPESCCEPPCCAPSCCAPAPCLSLVCTPVSRVSSPCCPVTCEPSPCQSGCTSSCTPSCCQQSSCQLACCASSPCQQACCVPVCCKTVCCKPVCCVPVCCGDSSCCQQSSCQSACCTSSPCQQACCVPICCKPVCSGISSSCCQQSSCVSCVSSPCCQAVCEPSPCQSGCISSCTPSCCQQSSCQPACCTSSSCQQACCVPVCCKTVCCKPVCSEDSSSCCQQSSCQPACCTSSPCQQACCVPVCCKPVCCKPVCSVPICSGASSLCCQQSSCQPACCTSSQSQQGCCVPVCCKPVSCVPVCSGASSSCCQQSSCQPACCTTSCCRPSSSVSLLCRPVCRPACCVPVPSCCAPTSSCQPSCCRPASCVSLL

SEQ ID NO: 920334 - protein, 219 aa, Homo sapiens
DKQTSAMGNAHGLCGNKKSKHQTLQGLWVCHKCHCRGGGCSPELKATKGGGKSCGSKEGQLKRRFSKPGTHPTVKKIFVGAIKEHTEEHYLRDYLEQCGKIKLIKIITDRGSETDSVEVHVLLPQGMEQEGQENGAGRMQSMRVAAALGGSGARPWVQITSLSSGQDCFYYHEDFKAAFNICINTEDGEDIVSLAAQNLVLCMVTRSATRAGSAGFQYV

SEQ ID NO: 920335 - protein, 443 aa, Homo sapiens
RQPGGGRLWAAARGARGRAHKPKTEWAEHSGHAFRGQVIMAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEVKPFLDLKLHGILVEAAVQVTPSVTNSRICYKQAFYYSYKIYAGNNMHSLL

SEQ ID NO: 920336 - protein, 179 aa, Homo sapiens
MRWWEAVVMFTRLGATPKNNIFTKASNRELLFEALFPVRLYADSLDHAEKGVPEPCPKYNSTVQCAKILRSPLSHTAHKHPVHMREVQAPPVGGKQYSEDDGCQGGLTCQSGPPTVQRHKDTVRSKMTGSRSSCCSCHLEYVTCLHGASLIGLTTACARQPGGTEGWLTVPRVHKINTD

SEQ ID NO: 920337 - protein, 166 aa, Homo sapiens
FEGALNGVQQMVPSPSSRRVSKVEMSLPQYQTEGDLTPGYFANLPPKVISYWGRSNTQQLRDLIRSSPDRLVSQSYAERPKAPLENCAFSSEKPFILPSLPSEWITGWVGKGVALLEHRSKGPELNTVQEQTFPHQPWGKASNAELLLDPIRWNFQQVLSSHFLGG

SEQ ID NO: 920338 - protein, 615 aa, Homo sapiens
WQGCRWQKPSSAMNLRSVTGFTLICEEAVASVDTTAPSFFFWPAEDELQSHGGDKVVLLHDGALRCLCAWVTPHRESHVYRSHLSAVHLRRSLEVPGSTGGHPVMGDTFIRHIALLGFEKRFVPSQHYDNRKDGPHPNPLGFLQWVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGQTSHLTGLLPLVLRNPQPQAPCQGSGSLAPGRTPALLGALNVLPTLWVAFCLSVHPVVAVGICAWQAGAGHVCVFCLDGVVKVTFPNLSIGHQCVCVPVSSPSLMAAGSRWALPLSHIPAPLAQPLDSPDETEDPEPNYAGEPYVAIKAYTAVEGDEVSLLEGEAVEVIHKLLDGWWVIRKDDVTGYFPSMYLQKSGQDVSQAQRQIKRGAPRRSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 920339 - protein, 215 aa, Homo sapiens
LTLQMKLQLHMMVVFLVVVALAVPAVLVVVVVLVMLLFVVLLFVLLLVALAVLVLVLVVALAVLVVLMLVALAVPAVLVSVVVFVMLASVVLLFVLLGVALAVLVVLMGVALAVLVVLMVVVVFVMLVFVVVLFVLWVVVLVMFMWLLLMVVVVALVVVVMVVTCGSTGPTERQGSAWLQTELASDSVACSWPGASGVSDPFTAIHESLPAGMTA

SEQ ID NO: 920340 - protein, 126 aa, Homo sapiens
MLSGRRSKFLPVETLALPQTLEEDLPWTVGIYRKFSSFPSDPFTPRYRRRIFCGLLESTRQSQMFRSHWGFPLRCRCGECVWCRVSVMHLCDLLPLLSSQQDSVTFALSKCTAAENTVVRKAGKVD

SEQ ID NO: 920341 - protein, 1393 aa, Homo sapiens
ETFAGSARNTAISWGDQAIDSLCNMAVFVQHYKRLLSLSNPSVCKKLWELFCILTTTNSGMYGLLCGRVLCQDCKVPPHVKASKQTSHIFPLDIMIECVKNSLVSSSPFLCSFDVPATKNSVGFHIAWSRLSSQEVKEELTQETTVQAFSLLELDGINLRLGDRNPHVQSVAIESQEFFAGFKLQPELSTISEDGKEYYLRIESTVPIICSEFSELDQECKISLKLKTIGQGNILTLFYLIIRLQTIMLFFPVGKVTGVYSYNKSCCMLTSNFSPIILLILGQTDDCQSNSHFFFLAESIHFKKRKKIVNNLLFIWFSSGAFIRADLGEWGMSLTIRAPSVDYRNTLGLCGTFDENPENDFHDKNGMQIDQNFNNYVAFINEWRKQMFMYKITILSCFPSGRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKVETQFVNQFTTQTVVLTRSDKSVNKEEDDKNAQGRKRHVKPTSGNAFTICKYPCGKSRECVAPNICKCKPGYIGSNCQTALCDPDCKNHGKCIKPNICQCLPGHGGATCDEEHCNPPCQHGGTCLAGNLCTCPYGFVGPRCETMVCNRHCENGGQCLTPDICQCKPGWYGPTCSTALCDPVCLNGGSCNKPNTCLCPNGFFGEHCQNAFCHPPCKNGGHCMRNNVCVCREGYTGRRFQKSICDPTCMNGGKCVGPSTCSCPSGWSGKRCNTPICLQKCKNGGECIAPSICHCPSSWEGVRCQIPICNPKCLYGGRCIFPNVCSCRTEYSGVKCEKKIQIRRH

SEQ ID NO: 920342 - protein, 148 aa, Homo sapiens
MASPGIRRRHMVPALLRLACSSQALEQLSPAALSLAGHGCFFTISEDGSFTQQLCLFTDLEMNAGHIRLIQRNSQDTVIAKRTSAGCTSASHGGLNIKPTIKIPSSNILLSPGEELREYGQKINMLIRHIMGTGKTLKMRGHTLRHAH

SEQ ID NO: 920343 - protein, 163 aa, Homo sapiens
TEWGTGTGKIHSLQMGEIGQNEGATGLKQVQNPVRQSNHKGPNDLLYLHVSHPGHADAKGAQGKLSVGLPFWGLEDSDPLLTAPLGSVPVETLCGGSNPTFPFCTALAKVCHEGSTPAANFCLDIQAFPYVLSNLGGGSQTSVLYFYAPTGSKPRGSCQGLEL

SEQ ID NO: 920344 - protein, 238 aa, Homo sapiens
ILGVMSSSPNLDVSNEITEGVYTPCDIGSNMILSPTGYWERYHSAGVLYNYFDIGRNIILYFPGYWAQKHKRVYNPCDVSKTHRATESHRCLRIPPPGTLRGSRTAAGPRFALPVPVHVSGHGAEEPAQHPGCQLCLSPPHPHLCWADIGFTLATVPKMIVDMQSHSRVISHAGCLTQMSFFILFACIEGMLLTVMAYDCFVAICRPLHYPVIVNPHLCVFFVLVSFFLSLLDSQLHS

SEQ ID NO: 920345 - protein, 161 aa, Homo sapiens
HCPASPSEMNKVYLMLYYALALNILSQLSVQYASLDLVSTYFGSSMIFVPIHILNSISVISAISAWFRTPAREVMQLFGAAVVGQLQQSASGCRGSCLSVGVHHGSRGNTAWGPLLVIVCVVFLEAMLAPVGCGTGRCRSECLLCASQERVVTQDGYLAKY

SEQ ID NO: 920346 - protein, 161 aa, Homo sapiens; identical to SEQ ID NO: 920345

SEQ ID NO: 920347 - protein, 181 aa, Homo sapiens [sequence omitted]

SEQ ID NO: 920348 - protein, 179 aa, Homo sapiens
FVASRMLYAMLCPQNAYPKGKTLSSNIKVQDEATSADGEAAANCPEDPGPPVNTKIHRCSSRWYTMESCNNIYCIPTLYEGARLQLVSAQRYDLNPFSFALLPKEEGYWRWALCSCKSQNNNPPTGRGNERRCFLSDWNCCCPDWHKPVVQELLDAGEDIISTYIFSAYVVNGLIYADD

SEQ ID NO: 920349 - protein, 161 aa, Homo sapiens
FLICSTRERNGLRLAMVLSGTGVGASVGKFSLNSEVFGTGAGHLDPRKHWQTHAQKCTEKEYPNIEHQRPSDFGASILKQVTENPDDCSLQSKDISLPLQEAWRKHVVEAQCCHRGPRTLPPSYAAISVLGDDFPHGCKKVTETPSIMSLPHVAPRFTVRG

SEQ ID NO: 920350 - protein, 131 aa, Homo sapiens
MKRKPGKGIPDLGRAGTKVQREEIAVRVQLAIAAAKTVTREALRDRTGKKHDTWRSAPEGTVILYDLPAFSEVLKMTERFSTRILNQGAENRLTHNPGQSLTLNPDLRPLILTTDWPNPAEIVHDPDHRLT

SEQ ID NO: 920351 - protein, 131 aa, Homo sapiens; identical to SEQ ID NO: 920350

SEQ ID NO: 920352 - protein, 173 aa, Homo sapiens
MECSVPGTEVAIAESPGVTRTPVWGPRVAVTHVTQVQKTSSHSQSETAGNEAGAERYLYKDTYQHRYQQTSVSREMARPGPASWASDPCSHTGPDTQNQGLVRGPFKDGTLTISGDIFGFTTECGDVSLASGGQKPGLLPNALLCPGWPLTPENEPPPKVTTAEARKPKPCLK

SEQ ID NO: 920353 - protein, 149 aa, Homo sapiens
SKSTCRIMCQDCPLPYKPFQDLAGCAGCRHRNKLYAGPIARLGMSPQGECGSDHARVTVTLKPQKGVLRCSFSSAVHGWWRLWTVKRHAAPRQGRGECYKQTLATEKQDKAKASLSPPDVSLGDKSLRGQLKRKIGIFIYNSSSSIEQH

SEQ ID NO: 920354 - protein, 161 aa, Homo sapiens
MSARPALLNDPRRGYSDRRPARRPCGPRCCCCCCCSRPPRSPPPKPLPTRMLTPRKAFRTCSKESGLAETESCGQTHTWPRALAVLMGLWWPRDQKAGEEDLRFRERRPGLQATATGSGEHGAFPVHSQGVWASTHWQGTAVCPLQTPPPDAFIRNNKVLS

SEQ ID NO: 920355 - protein, 151 aa, Homo sapiens
MLENYSHLVSVGYDTTKPNVIIKLEQGEEPWIMGGEFPCQHSPEAWRVDDLIERIQENEDKHSEPPCPQAMWPPLLLLLLLLPAAPVPTAKAAPHPDANTQEGLQNLLQGVGAGGDGELRADSHLAPGSGCIDGAVVATRPESRGGRPAVP

SEQ ID NO: 920356 - protein, 151 aa, Homo sapiens
MLENYSHLVSVGYDTTKPNVIIKLEQGEEPWIMGGEFPCQHSPEAWRVDDLIERIQENEDKHFKPPCPQAMWPPLLLLLLLLPAAPVPTAKAAPHPDANTQEGLQNLLQGVGAGGDGELRADSHLAPGSGCIDGAVVATRPESRGGRPAVP

SEQ ID NO: 920357 - protein, 115 aa, Homo sapiens
HPSSLVGESSLRRRRARMQARLGGPLYGEPPGPSSAAPGVPLWFFLSLVGRGRCTRAVRLREVTPGQGRKECSGCHGARSCSFGGVSGVVAKVAEPAWLAGELSGDSFETDGHHV

SEQ ID NO: 920358 - protein, 115 aa, Homo sapiens; identical to SEQ ID NO: 920357

SEQ ID NO: 920359 - protein, 115 aa, Homo sapiens; identical to SEQ ID NO: 920357

SEQ ID NO: 920360 - protein, 115 aa, Homo sapiens; identical to SEQ ID NO: 920357

SEQ ID NO: 920361 - protein, 115 aa, Homo sapiens; identical to SEQ ID NO: 920357

SEQ ID NO: 920362 - protein, 115 aa, Homo sapiens; identical to SEQ ID NO: 920357

SEQ ID NO: 920363 - protein, 207 aa, Homo sapiens
MLENYSHLVSVGYDTTKPNVIIKLEQGEEPWIMGGEFPCQHSPEAWRVDDLIERIQENEDKHSSRPARRPCGPRCCCCCCCSRPPRSPPPKPLPTRMLTPRKAFRTCSKESGLAETESCGQTHTWPRALAVLMGLWWPRDQKAGEEDLRFRERRPGLQATATGSGEHGAFPVHSQGVWASTHWQGTAVCPLQTPPPDAFIRNNKVLS

SEQ ID NO: 920364 - protein, 646 aa, Homo sapiens
MGGEFPCQHSPEAWRVDDLIERIQENEDKHSRQAACINSKTLTEEKENTFSQIYMETSLVPSSIIAHNCVSCGKNLESISQLISSDGSYARTKPDECNECGKTYHGEKMCEFNQNGDTYSHNEENILQKISILEKPFEYNECMEALDNEAVFIAHKRAYIGEKPYEWNDSGPDFIQMSNFNAYQRSQMEMKPFECSECGKSFCKKSKFIIHQRAHTGEKPYECNVCGKSFSQKGTLTVHRRSHLEEKPYKCNECGKTFCQKLHLTQHLRTHSGEKPYECSECGKTFCQKTHLTLHQRNHSGERPYPCNECGKSFSRKSALSDHQRTHTGEKLYKCNECGKSYYRKSTLITHQRTHTGEKPYQCSECGKFFSRVSYLTIHYRSHLEEKPYECNECGKTFNLNSAFIRHRKVHTEEKSHECSECGKFSQLYLTDHHTAHLEEKPYECNECGKTFLVNSAFDGHQPLPKGEKSYECNVCGKLFNELSYYTEHYRSHSEEKPYGCSECGKTFSHNSSLFRHQRVHTGEKPYECYECGKFFSQKSYLTIHHRIHSGEKPYECSKCGKVFSRMSNLTVHYRSHSGEKPYECNECGKVFSQKSYLTVHYRTHSGEKPYECNECGKKFHHRSAFNSHQRIHRRGNMNVLDVENL

SEQ ID NO: 920365 - protein, 115 aa, Homo sapiens; identical to SEQ ID NO: 920357

SEQ ID NO: 920366 - protein, 111 aa, Homo sapiens
MLTPRKAFRTCSKESGLAETESCGQTHTWPRALAVLMGLWWPRDQKAGEEDLRFRERRPGLQATATGSGEHGAFPVHSQGVWASTHWQGTAVCPLQTPPPDAFIRNNKVLS

SEQ ID NO: 920367 - protein, 678 aa, Homo sapiens
MLENYSHLVSVGYDTTKPNVIIKLEQGEEPWIMGGEFPCQHSPEAWRVDDLIERIQENEDKHSRQAACINSKTLTEEKENTFSQIYMETSLVPSSIIAHNCVSCGKNLESISQLISSDGSYARTKPDECNECGKTYHGEKMCEFNQNGDTYSHNEENILQKISILEKPFEYNECMEALDNEAVFIAHKRAYIGEKPYEWNDSGPDFIQMSNFNAYQRSQMEMKPFECSECGKSFCKKSKFIIHQRAHTGEKPYECNVCGKSFSQKGTLTVHRRSHLEEKPYKCNECGKTFCQKLHLTQHLRTHSGEKPYECSECGKTFCQKTHLTLHQRNHSGERPYPCNECGKSFSRKSALSDHQRTHTGEKLYKCNECGKSYYRKSTLITHQRTHTGEKPYQCSECGKFFSRVSYLTIHYRSHLEEKPYECNECGKTFNLNSAFIRHRKVHTEEKSHECSECGKFSQLYLTDHHTAHLEEKPYECNECGKTFLVNSAFDGHQPLPKGEKSYECNVCGKLFNELSYYTEHYRSHSEEKPYGCSECGKTFSHNSSLFRHQRVHTGEKPYECYECGKFFSQKSYLTIHHRIHSGEKPYECSKCGKVFSRMSNLTVHYRSHSGEKPYECNECGKVFSQKSYLTVHYRTHSGEKPYECNECGKKFHHRSAFNSHQRIHRRGNMNVLDVENL

SEQ ID NO: 920368 - protein, 115 aa, Homo sapiens; identical to SEQ ID NO: 920357

SEQ ID NO: 920369 - protein, 115 aa, Homo sapiens; identical to SEQ ID NO: 920357

SEQ ID NO: 920370 - protein, 151 aa, Homo sapiens; identical to SEQ ID NO: 920355

SEQ ID NO: 920371 - protein, 105 aa, Homo sapiens
MSARPALLNDPRRGYSDLPPCPQAMWPPLLLLLLLLPAAPVPTAKAAPHPDANTQEGLQNLLQGVGAGGDGELRADSHLAPGSGCIDGAVVATRPESRGGRPAVP

SEQ ID NO: 920372 - protein, 115 aa, Homo sapiens; identical to SEQ ID NO: 920357

SEQ ID NO: 920373 - protein, 115 aa, Homo sapiens; identical to SEQ ID NO: 920357

SEQ ID NO: 920374 - protein, 115 aa, Homo sapiens; identical to SEQ ID NO: 920357

SEQ ID NO: 920375 - protein, 172 aa, Homo sapiens
MPPRYSRLQYSVQSHAARVFRYTNATPLQIILPNERCQMKKSTQYNPVYPESYSKLTNSGRKQTCACCRCRTGSCEDSRLVVDRCLHLLGTHLEGALLGHRVDIRLALLEIVKMIFKVIVPFTLPQQHTELPTAPRPRRLTLGIVSLFNVRHPGGGVVVSHCGVNLHSSDEC

SEQ ID NO: 920376 - protein, 172 aa, Homo sapiens; identical to SEQ ID NO: 920375

SEQ ID NO: 920377 - protein, 144 aa, Homo sapiens
MQTGKSSAAVLSSDCPLPNPPWRPCYSIIDGLPASVSVFFCQCVPLDVQLLVCAGHETVGQEIFCVAALVDYEYRILPLTTKAIEEKPCGKESKSENSNCEKADLELYQLLTLNCVLIFEKKLGKSPFNRIYYLKIVGKPSLIP

SEQ ID NO: 920378 - protein, 720 aa, Homo sapiens
RALLKPRSTRRQLLLANHAPSTPTATSTSPSVPPCGSEALCRRPLLTSSSLGMDPSYCPAHGFPSQDALWPLSSQQWSSAHYSEPAAGGCDGTEAMNGAGPGPAAAAPVPVPVPVPDWRQFCELHAQAAAVDFAHKFCRFLRDNPAYDTPDAGASFSRHFAANFLDVFGEERRGHGAGARGHLCTQGGAYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPGRCEGEPHLVEFSSWQGPRHLMSQIGRETFPPSEGLHGIPGGAQPLKDSGQGSWALSGDCPLSGEQGAETDPEAEPELELSDYPWFHGTLSRVKAAQLVLAGGPRNHGLFVIRQSETRPGEYVLTFNFQGKAKASVPSPGPAPDHTHLYPQHLRLSLNGHGQCHVQHLWFQSVLDMLRHFHTHPIPLESGGSADITLRSYVRAQDPPPGCGQPRSPLTPCRRLVAEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 920379 - protein, 661 aa, Homo sapiens
GPGSPAAVRAALSRRPSPLGRSCAPVAAGGCDGTEAMNGAGPGPAAAAPVPVPVPVPDWRQFCELHAQAAAVDFAHKFCRFLRDNPAYDTPDAGASFSRHFAANFLDVFGEERRGHGAGARGHLCTQGGAYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPGRCEGEPHLVEFSSWQGPRHLMSQIGRETFPPSEGLHGIPGGAQPLKDSGQGSWALSGDCPLSGEQGAETDPEAEPELELSDYPWFHGTLSRVKAAQLVLAGGPRNHGLFVIRQSETRPGEYVLTFNFQGKAKASVPSPGPAPDHTHLYPQHLRLSLNGHGQCHVQHLWFQSVLDMLRHFHTHPIPLESGGSADITLRSYVRAQDPPPGCGQPRSPLTPCRRLVAEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 920380 - protein, 162 aa, Homo sapiens
MGGWDLPQGLSKETRPLCNASASDHLRPRPKTPNHSPSSPASQTAGFSKPSGVPRGAPLGTLLILGVQLTAGRDLSRNLSPLTEPSLRSVHGLLLDTARIQKSMLSILKPRRSQEWRTALRRYCCPTDLQAPRSPVPPIRKVGISDVIVHANLATSLKKKHM

SEQ ID NO: 920381 - protein, 146 aa, Homo sapiens
ILLGSLMQQQSAVGSLGVTSLGQLAGLGLPLHVAFYPGLLHSTMVSGFQEDRPQHTGAYQTSAFVTLADVLLAKAHLLMSHWPESVWEGMTQGRGYRKVWFTGHCHHSNLPCSLDPENKAQGAQLTHTQRWHLNPTHHKASGPVSK

SEQ ID NO: 920382 - protein, 146 aa, Homo sapiens; identical to SEQ ID NO: 920381

SEQ ID NO: 920383 - protein, 171 aa, Homo sapiens
MRNPLHFLACLASGVSYMRSSHQGKTPDPGLSLLQTPAPTHCGQYTLEQWFPTPRPMDLHRSAAVSDSHRSTNPIVNCSCEGSGLHSPYKNLMPDDQRWNSSIPKPSFSRTTGPWENCLPQNRSLVPKRIDLRAEHFHCVFKPCTDGRVHVQPSLAAPEAANSSPGPSHLS

SEQ ID NO: 920384 - protein, 857 aa, Homo sapiens
KTILSPSDMFLNEVLVEFCLCEEIGMEYGACYCRFISSSSLAGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVPPQSHHPKASLLLQGPPHEAGNGCQAL

SEQ ID NO: 920385 - protein, 150 aa, Homo sapiens
MSRGGTRRRPAPAASPASGSGTTACPQGDADQGGPPAAPTSASGAPRTLACPSRDQKHPRNSPGEEGHHARTRQRSGRSHGPGAPDAKQAEPAGGGVQAPALRGVCGGAVLVHHGCPAEEPADVSGTHSGSRLGVASVPRVVVSQDKIIS

SEQ ID NO: 920386 - protein, 99 aa, Homo sapiens
KLRLETLNVFPLLSPGHHARTRQRSGRSHGPGAPDAKQAEPAGGGVQAPALRGVCGGAVLVHHGCPAEEPADVSGTHSGSRLGVASVPRVVVSQDKIIS

SEQ ID NO: 920387 - protein, 146 aa, Homo sapiens
LLSCQSTMWHPDRGSWHRNEQEGKDGYRGTNLERDGGLHFLCSVINRCPFPACSRPGSGPALINHFLPNVVKATKDLCELSHPSFLQMLASPQGRGIRCLTVPARGGGRKSHAAPEVWDGLSFPLSRTQCPGEPIFPDSAPVPPPL

SEQ ID NO: 920388 - protein, 284 aa, Homo sapiens
MHRRSQLQHRPMLRVPALVPAHPRPGSAFLGQERVCGADAGDGQWSGAAARCREHQGLATSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVES

SEQ ID NO: 920389 - protein, 942 aa, Homo sapiens
CQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 920390 - protein, 928 aa, Homo sapiens
CQLTLNKKCTHLIVPEPKGEKYECALKRASIKIVTPDWVLDCVSEKTKKDEAFYHPRLIIYEEEEEEEEEEEEVENEEQDSQNKGLLQVTSSSSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 920391 - protein, 473 aa, Homo sapiens
CQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVES

SEQ ID NO: 920392 - protein, 942 aa, Homo sapiens; identical to SEQ ID NO: 920389

SEQ ID NO: 920393 - protein, 818 aa, Homo sapiens
CQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 920394 - protein, 657 aa, Homo sapiens
SPVLNVRSPAGEAGQEAGVAGGGGSQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 920395 - protein, 932 aa, Homo sapiens
CQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSVGRVESASESVIALYHIQRSVTEKLIFFSLEFVGNNFNIL

SEQ ID NO: 920396 - protein, 189 aa, Homo sapiens
MKCDQVMTGDGGTETAAQKGGPQDPQSKEARFPRYLPGFSKESRKSITADVRGRDKEGHDDSAGDPQDGITEGGMPELRFGYTAQEAGQGIPGRGTTCAKAEGQASLNPYQYHSLLLMDAIVSLSVLARKMGLTTTTSKKDHDAEMTQNSAWSGRAAGKIITAISTSVMPVLFDLRNSSAFNTIKLGYW

SEQ ID NO: 920397 - protein, 99 aa, Homo sapiens
GAVAQRGRLALELAEDVPGAARQGCYEAQRNGCCEKTCFAIYEALDKHQERYKSMLLTQEILVECLCVGHWLEIRVSYGQKCGQGALFLPDVTLPQPTC

SEQ ID NO: 920398 - protein, 163 aa, Homo sapiens
MNGIQSLNSRSTSSESQRAGGSVWEKKENSAPNGKTLKVCIVLLVGKNTGRRREERWQAAPTLAEIPRVLQTDRPEVSKTVTTICPNLYSPLAFPTGYLPVTVFPRTWLSSVYSAPGSPKQTDTDRQKEQTRGLSNSHPPRPANFVFLVEMDFTMLARLVLNS

SEQ ID NO: 920399 - protein, 254 aa, Homo sapiens
MVSETHTVWLEDSTVTSQAQPSASPPLAALGCWPSSDGSRAQSAVSQEKPASSLRGLEEPFSLSLVFDASAPAHCGVRVGLSAQPCPNKSSKALFHLQSLESFVACVIEHLSSPQLFTLKFPPKHFAKPNLNQQKVMVPVWWSAAGLIHYSFLNPGETITSEKYAQQIDEMHKNLQHRQPALVNRKGPILLHNNAPLHITQPTLQNMPESSMQNDGLQPWDRVIELVTNQPPKLYSSILSIKVLGFVVFVCMLG

SEQ ID NO: 920400 - protein, 163 aa, Homo sapiens; identical to SEQ ID NO: 920398

SEQ ID NO: 920401 - protein, 172 aa, Homo sapiens; identical to SEQ ID NO: 844543

SEQ ID NO: 920402 - protein, 142 aa, Homo sapiens
MGTPAHRPSVLGGSFIDHGQSLAAEQNPHPGANHNSGLLPGIAKKGFGSGRTEGAGRFSSRSSARPPRSGKWRNRPSLPFTERHWLLVPLPRPQSRSRKIQSQNCSYTEDSSAPYPPWVARPAVPHPILSLTPSLCTFAFGF

SEQ ID NO: 920403 - protein, 573 aa, Homo sapiens
MTPESRDTTDLSPGGTQEMEGIVIVKVEEEDEEDHFQKERNKVESSPQVLSRSTTMNERALLSSYLVAYRVAKEKMAHTAAEKIILPACMDMVRTIFDDKSADKLRTIPLSDNTISRRICTIAKHLEAMLITRLQSGIDFAIQLDESTDIASCPTLLVYVRYVWQDDFVEDLLCCLNLNSHITGLDLFTELENCLLGQYKLNWKHCKGISSDGTANMTGKHSRLTEKLLEATHNNAVWNHCFIHREALVSKEISPSLMDVLKNAVKTVNFIKGSSLNSRLLEIFCSEIGVNHTHLLFHTEVRWLSQGKVLSRVYELRNEIYIFLVEKQSHLANIFEDDIWVTKLAYLSDIFGILNELSLKMQGKNNDIFQYLEHILGFQKTLLLWQARLKSNRPSYYMFPTLLQHIEENIINEDCLKEIKLEILLHLTSLSQTFNYYFPEEKFESLKENIWMKDPFAFQNPESIIELNLEPEEENELLQLSSSFTLKNYYKILSLSAFWIKIKDDFPLLSRKSILLLLPFTTTYLCELGFSILTRLKTKKRNRLNSAPDMRVALSSCVPDWKELMNRQAHPSH

SEQ ID NO: 920404 - protein, 138 aa, Homo sapiens
MYTLEISLWQQLKYSWKWEKLEMITLTCSSLDPRMAQGKLRMEIGTKLRCLIWTVHKGVHWVTFWWVERSQTGNLEVRRLWLGLLTHLHSGVNCEFALLDHSADRYIKNAPPVPRAPSELSLKTRLKCSPQLNLRRPP

SEQ ID NO: 920405 - protein, 151 aa, Homo sapiens
MSDPADACKWCQQRRRFLPWEKRGNPREACGSATGIWWVEARDTAKHPTTNRTAHNKHWGQSRAVVLSIEQHQNTPEGSCATRASLTCRVLSCMSQQSGLEELGRSMQGRCGGLPPCAKGESERRDVLYITLMVVDGPEPRVPGQRPFHAH

SEQ ID NO: 920406 - protein, 501 aa, Homo sapiens
MQDTVTTSALLDPSHSSVSTQDNSSTGGHTSSTSPQLSKPSITPVPAKSRNPHPRANIRRMRRIIAEDPEWSLAIVPLLTELCIQHIIRNFQKNPILKQMLPEHQQKVLNHLSPDLPLAVTANLIDSENYWLRCCMHRWPVCHVAHHGGSWKRMFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKIFKLTRSKVDDDKARIIIRSLLDHPVLEELDLSQNLIGDRGARGAAKLLSHSRLRVLNLANNQVRAPGAQSLAHALAHNTNLISLNLRLNCIEDEGGQALAHALQTNKCLTTLHLGGNELSEPTATLLSQVLAINTTLTSINLSCNHIGLDGGKQLLEGMSDNKTLLEFDLRLSDVAQESEYLIGQALYANREAARQRALNPSHFMSTITANGPENSVG

SEQ ID NO: 920407 - protein, 501 aa, Homo sapiens; identical to SEQ ID NO: 920406

SEQ ID NO: 920408 - protein, 351 aa, Homo sapiens
MQDTVTTSALLDPSHSSVSTQDNSSTGGHTSSTSPQLSKPSITPVPAKSRNPHPRANIRRMRRIIAEDPEWSLAIVPLLTELCIQHIIRNFQKNPILKQMLPEHQQKVLNHLSPDLPLAVTANLIDSENYWLRCCMHRWPVCHVAHHGGSWKRMFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKDGGKQLLEGMSDNKTLLEFDLRLSDVAQESEYLIGQALYANREAARQRALNPSHFMSTITANGPENSVG

SEQ ID NO: 920409 - protein, 134 aa, Homo sapiens
MNTLQGPVSFKDVAVDFTQEEWQQLDPDEKIAYGDVMLENYSHLVSVGYDYHQAKHHHGVEVKEVEQGEEPWIMEGEFPCQHSPECLMINCAHSKIMNSVYLPHLPVFDCLIKSQYSCEKVPFSLNITTLIPSI

SEQ ID NO: 920410 - protein, 213 aa, Homo sapiens
MFLFQQHNWSLSPSWSLSLPLASRTSVFCLQPAPPLLDPTAYSVFPPGGAMGISNFPGPDQAPLALHRCLHSPLYLRKWQHHPSSHSDQKLGAILDPFLKLPINNRFIAAFRMDLSTSHTTPEGPCAISSLTWASTRSLETLCLVLTAGRLLSSLQLLVTADGTRHTVLLDEERQAMAKSRRLERSTNSFSYSSYHTLEERVIFKEIWKPEFR

SEQ ID NO: 920411 - protein, 177 aa, Homo sapiens
LAAFVKVLDMMNKVLSTYVFVWKYVLFGQRYLLMTRKILQLGMENAMIMMMMMMIMIVSNLDSISCDLHAENLVGPWSTHGSLVNVPKTRRTFCKKCGKHQPHKVTQYKKGKDYLYAHGKRRYDRKQSGYGGQTKLIFQKKAKATKKIVLRLEKRNNSFKGKDSLKRINAFNTAAGQ

SEQ ID NO: 920412 - protein, 303 aa, Homo sapiens
FNPKQGPCLLANMHMLLLAAAAAAAAVAGFSMWCVFKPHSLILSFPNIQHPCTLLTSRFFKRLEISSGGPQSDWQTWYKQPMGVADPPQYFWTNSLLTQSPCELRGLYWRLSMGEKMDECVPPPDGRFVDMGMRPLRPQNYLFSCELKANKDYHFKVDNNENEHQLPLTTINLGAGAMDELDIVEAEAMNYEGSPIKVILATLKMSVQPTVSLGGFEITPPVVLQLKCGSGPVHTSGQHLVAVEEEAESEDEDKEVVKLLSISGKQSAPGGGSKLPQKKVKLAADEDDDGDDFDDKETEEKHQ

SEQ ID NO: 920413 - protein, 137 aa, Homo sapiens
MDQGLKTTGGDATSEEGQGQSERMTFELRSEQSWKKALLGMGTASANKGPEVGQRTFCIISLCTCVAGINFELSRYPRYLYGLPDDISHGYGWSMFCAWGGLGLTLISGFFCTLAPSVQPVPRTNYPKSRPENGTVC

SEQ ID NO: 920414 - protein, 373 aa, Homo sapiens
AKLMIRHEHEEAIFLAHGPSFKEKTEVEPFENIEVYNLMCEYSAGTSESDAKSHPRRKTLQNKLTEVPEHKDFIANIQKGTAEERGPLSPLPQGICQWIWKSYEDAHVEFIHSPPVDKGCYRCYTGAKEEHIVFYLEKMENVYRPIGQLGDTSPLPPTVPDCLRADVRVPPSESQKCSFYLADKNITHGFLYPPASNRTSDSQYDALITSNLVPMYEEFRKMWDYFHSVLLIKHATERNGVNVVSGPIFDYNYDGHFDAPDEITKHLANTDVPIPTHYFVVLTSCKNKSHTPENCPGWLDVLPFIIPHRPTNVESCPEGKPEALWVEERFTAHIARVRDVELLTGLDFYQDKVQPVSEILQLKTYLPTFETTI

SEQ ID NO: 920415 - protein, 373 aa, Homo sapiens; identical to SEQ ID NO: 920414

SEQ ID NO: 920416 - protein, 1580 aa, Homo sapiens
MPSTAKEVLAFEGRGPKEKEGATCVDVYGRSISGHGNSKCKGPEARVCMEGTRRPKTPASSDFSDLNTQTNWTKSLPLPTPEEKMRQQAQTVQADVVPINITGENFDRQASLRRSLIYTDTLVRRPKKVKRRKTITGVPDNIQKELGSHSDPDGIQVFALFYHGLVYYKQRQDCSSSRGIVKSVFGNKPLSALSPASGTGQDDADGHSVYTPDHYSTLGRFNSCRSAGQRSETRDSSCQTEDVKVVPPSMRRIRAQKGQGIAAQMGHFSGSSGNMSVLSDSAGIVFPSRLDSDAGFHSLPRSGARANIQSLEPRLGALGPAGDMNGTFLYQRGHPQADENLGHLGGASGTGTLLRPKSQELRHFESENIMSPACVVSPHATYSTSIIPNATLSSSSEVIAIPTAQSAGQRESKSSGSSHARIKSRDHLISRHAVKGDPQSPGRHWNEGHATILSQDLDPHSPGEPALLSLCDSAVPLNAPANRENGSQAMPYNCRNNLAFPAHPQDVDGKSESSYSGGGGHSSSEPWEYKSSGNGRASPLKPHLATPGYSTPTSNMSSCSLDQTSNKEDAGSLYSEDHDGYCASVHTDSGHGSGNLCNSSDGFGNPRHSVINVFVGRAQKNQGDRSNYQDKSLSRNISLKKAKKPPLPPSRTDSLRRIPKKSSQCNGQVLNESLIATLQHSLQLSLPGKSGSSPSQSPCSDLEEPWLPRSRSQSTVSAGSSMTSATTPNVYSLCGATPSQSDTSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 920417 - protein, 270 aa, Homo sapiens
LLFSPLLFLSQGCWMATHRDSEATQDNNRSLKMTKDRKERHDTAKCQEHQEEEFDGVLREEAVAKALHHLGRSGSGTEQVYLNLTLSGCNLIDVSILCGYVHLQKLDLSANKIEELNASQNNLTTFFNFKPPKNLKKADFSHNQISEICDLSAYHALTKLILDGNEIEEISGLEMCNNLIHLSLANNKITTINGLNKLPIKILCLSNNQIEMITGLEDLKALQNLDLSHNQISSLQGLENHDLLEVINLEDNKKQDISLGVTSKNAVLLL

SEQ ID NO: 920418 - protein, 117 aa, Homo sapiens [sequence omitted]

SEQ ID NO: 920419 - protein, 130 aa, Homo sapiens
PLTPTRWVMCLCEMLEMVHLPNTCTRTHSNAQFDAKVTVNCNVVWAKSVFTLQLGMNEFPLKRRGGSKNATNGSPCRVLDAQGSKKPQARGSQCYDQAREKMHGIGNFWQDWEMSPDFSPLYSAWSLQLH

SEQ ID NO: 920420 - protein, 157 aa, Homo sapiens
APGVSLLDLLSPRMQSALQIPDLFSNYLFIVSKSAVTADATFVRSPTECAAPCNLNYCNSPFHLKLHSLTFKASFDSSLLLQPTSDTANIPKHPTTYKALDACRMHFYVTVTIAMITFVHPTHIECLLCVRPPSSLQGDSREQSLCSCGLTLGRRLL

SEQ ID NO: 920421 - protein, 479 aa, Homo sapiens
RAPHPHRYVASHWSPNHPTPLLLTIGNAGGAGAPGQSSLVLVAGLEWGCLEPVLGWKCPQQQCQGNSHWGLPWEPRGTLVSSALTLSHPWASGHIVMTLESDGCREAVGTGARRLQAGRLQSTEARFEEVTVDRPVNIPLLLEPGEAAGGVLGCSIPGAGACLPACWRENDFLAATITTAMTITITITTTATIAITITTTATTITITTTTTAVTITITITTTATTAITITTTVTTITITITITTTAMTITITTTTTAMTITITITTTTAMTITITITTTAMTITITITTTAMTITITITTTAMTITITITTTAMTITITITTTAMTITITITTTAITIAITITTTATIAITTTITVTITITITTIAITITITTTTTAITITITTTTTAITITITITAITITITITTTATTAITITITITTTAMTITITTTATTAITITITITTTTMTIIITTTTTATTAITITTITDHHHHHLHCHHHY

SEQ ID NO: 920422 - protein, 277 aa, Homo sapiens
QRRQGMRMAVGSVKMQPPCESPALAAAAAVVAADGPLRRSPSAREPEREQPPASLRPRLRDLPALLRSGLTLRRKRSAAGGRTLSRRISNPYLEHTPSQIYGENSSCAGRALRNIIIVQAADLIKDRVNLKGFYRRSCVGSELVDWLLEHCPFVQCRSMAIGVWQLLLDMGIMLSVDQHLYFQDTYVFYQFSSDECSYLYCEFEREEEWQNGVKLLLQLVPLIPARGGICELSHQKIEDSEESSDEILVRLTSAVQRELAAVIALKARKSAIEQDEE

SEQ ID NO: 920423 - protein, 180 aa, Homo sapiens
QRRQGMRMAVGSVKMQPPCESPALAAAAAVVAADGPLRRSPSAREPEREQPPASLRPRLRDLPALLRSGLTLRRKRSAAGGRAAPDLTPGPPDSGCGTGHRLKTSCLPLLGGEAAGVQRPTASQPCPNRKLQAPRAASLFAGRMRRVCLFWRCCCKLWASRLVLVVSTAEGQTQESEALG

SEQ ID NO: 920424 - protein, 132 aa, Homo sapiens
QRRQGMRMAVGSVKMQPPCESPALAAAAAVVAADGPLRRSPSAREPEREQPPASLRPRLRDLPALLRSGLTLRRKRSAAGGRTLSRRISNPYLEHTPSQIYGENSSCAGRALRNIIIAQAILLPQPPKALGL

SEQ ID NO: 920425 - protein, 101 aa, Homo sapiens
RSHGAALPAQPRLAQLSHTCAMKYPLMPLVNDLTFSFLVFWFCLPVGLLLLLIIWLRFLLSQDSEENDSSVCLDWEPWSKGPAEFCWKGTLHGQEKERPCW

SEQ ID NO: 920426 - protein, 80 aa, Homo sapiens
RSHGAALPAQPRLAQLSHTCAMKYPLMPLVNDLTFSFLVFWFCLPVGLLLLLIIWLRFLLSQDILQVRRYRYDANILTAS

SEQ ID NO: 920427 - protein, 218 aa, Homo sapiens
RSHGAALPAQPRLAQLSHTCAMKYPLMPLVNDLTFSFLVFWFCLPVGLLLLLIIWLRFLLSQDSEENDSSVCLDWEPWSKGPAEFCWKGTLHGQEKERPCCLVFLESAGQWQWQKWMGETCQGGKRTLATVVPPWNPQLISSSDRHVKASRGPSPSPASQMTSSPAGSRSSLGGHGSSEQAHGEKLANLIQRGLKAGLGRRVWVHIKEARVFPYPGDP

SEQ ID NO: 920428 - protein, 208 aa, Homo sapiens
EVLGFGSCFFGFQSLAPVKKLPHKMVRKDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRAVCVLSTESYQQGVLSATILYEILLGKATLYAVLVSALVLMAMGKQHSLGHLK

SEQ ID NO: 920429 - protein, 106 aa, Homo sapiens [sequence omitted]

SEQ ID NO: 920430 - protein, 138 aa, Homo sapiens
KGNGWALENQQDEDREEGTQQTIKPLPSAGQRMLLSPVHPDGSPQTPFPYPGILGPHWRVSLKGNGWALENQQDEDREEGTQQTISPYPVQDRGCGQTYGLQCLVISQFQIKLSPVLPLVLLVCSLNTSSFSCFRIWA

SEQ ID NO: 920431 - protein, 631 aa, Homo sapiens
GGGADQEQELESEPVVAAEAVMSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 920432 - protein, 631 aa, Homo sapiens; identical to SEQ ID NO: 920431

SEQ ID NO: 920433 - protein, 509 aa, Homo sapiens
MEKWDGNEGTSAFHMPELDEIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 920434 - protein, 474 aa, Homo sapiens [sequence omitted]

SEQ ID NO: 920435 - protein, 283 aa, Homo sapiens
MSWCFLFLASLILRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 920436 - protein, 631 aa, Homo sapiens; identical to SEQ ID NO: 920431

SEQ ID NO: 920437 - protein, 631 aa, Homo sapiens; identical to SEQ ID NO: 920431

SEQ ID NO: 920438 - protein, 401 aa, Homo sapiens
GGGADQEQELESEPVVAAEAVMSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDG

SEQ ID NO: 920439 - protein, 117 aa, Homo sapiens
HRVSWSLPLPMASPNTCLLRILKRFCRAQFENHWLKSFPLYFLIVKYINFISLTSCLAQACSYPALSLIQVLMETLGALGAQCRWAACNIYSTLNEVAAALAESEVVRAYSLCLWLK

SEQ ID NO: 920440 - protein, 283 aa, Homo sapiens; identical to SEQ ID NO: 920435

SEQ ID NO: 920441 - protein, 509 aa, Homo sapiens; identical to SEQ ID NO: 920433

SEQ ID NO: 920442 - protein, 404 aa, Homo sapiens
MPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 920443 - protein, 631 aa, Homo sapiens; identical to SEQ ID NO: 920431

SEQ ID NO: 920444 - protein, 631 aa, Homo sapiens; identical to SEQ ID NO: 920431

SEQ ID NO: 920445 - protein, 233 aa, Homo sapiens
MGSRWYQQPAYCRTRPPGEAREPRPPTSFIPGLMRISGSLEHKTQTPPVEENVTQKISDLEICADEFPGSSATYRILETNSEYDPSRCFAFVHDLCDEEKSYPVPKGSLDIIILIFVLSAIVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 920446 - protein, 162 aa, Homo sapiens
TAIELVQTNSEYDPSRCFAFVHDLCDEEKSYPVPKGSLDIIILIFVLSAIVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 920447 - protein, 162 aa, Homo sapiens; identical to SEQ ID NO: 920446

SEQ ID NO: 920448 - protein, 162 aa, Homo sapiens; identical to SEQ ID NO: 920446

SEQ ID NO: 920449 - protein, 223 aa, Homo sapiens
GAQDLTLEMSAVESEKTSPSVGHLTALLKSSVALVPMIHGTEAAPAVSAGLCTARHEPRGTGPVEHHSRKPFPWGQMASTMDSSSPAFAEPPPERQGEDTREARRGYGRTLGRPREATGGCLGGHERLWEDAQDKESRKWETVLASASREPQSPHKVSIALDAGVTGNTFAPIGNSTCSSRAQSPGSPSIHRDIHGWKDVVLRTMGGSSATFAGTCPKDIFNF

SEQ ID NO: 920450 - protein, 131 aa, Homo sapiens
MGQHLFSNPAPGQQVAIPPKPDFQFLLRSTPMQKIPGLMDLFFRHKRFPHHAVGKSKPIRVCDELYEDVHGIQYVCQDTVFAIITDNLQERVRRDGRPYWVSWEVAQDIFTASGCRKGWHETPEGGMETAP

SEQ ID NO: 920451 - protein, 159 aa, Homo sapiens
FPGLSVTMLLPSASFCINTHIMQVLGPVPAPLTSGLHYYTTLEELWKSFDLCEDYFKPPFGPYPEKSGKDSLVSMKCSLFRFCPWSKELPFQPPEGSISSHLGSGASDSETEETRKALPIQSFSHEKESHQHRQHSVPVISRPGSNVKPTLPPIPQGRR

SEQ ID NO: 920452 - protein, 253 aa, Homo sapiens
MSFSVHNQKGSKRPLPLEPLLFLQVPRSNYLHFQEEKQRLHLKKFLLDRMFLVAKIQANVERKDVADYYEQMFQSVLKHHLGEAVTGLLLIYPTSILHILESSSDTLYKVLLDYIGHVKDETVFFIQQMKIIVISHNIPMRLFMQWHVSVIKVPVMYLDDVTQSQSLKEVITDFLTQTHKLSLYLCQTMKVGTKGPGDNLHQVAPDLLLPEQIIKYLCKSEEFMDPATFINMYNRPIHITLDSEVVWPAPSRF

SEQ ID NO: 920453 - protein, 136 aa, Homo sapiens
MHFPGFSNIMDITEELGLDIKSSGSGCVEVQSIEGDNCKIETEHGTSILQSVKGQKLHVQTKGGKVICLGTVYGNIDIHASDKSAVTIDKLQGSSVTVSTEDGLLKAKYLYTESSFLSSAAGDITLGSVHGKLTKA

SEQ ID NO: 920454 - protein, 142 aa, Homo sapiens
MHFPGFSNIMDITEELGLDIKSSGSGCVEVQSIEGDNCKIETEHGTSILQSVKGQKLHVQTKGGKVICLGTVYGNIDIHASDKSAVTIDKLQGSSVTVSTEDGLLKAKYLYTESSFLSSAAGDITLGSVHGGISRRRGRQFN

SEQ ID NO: 920455 - protein, 876 aa, Homo sapiens
FYNFLFPFVSLALGIVTASCSKYLKMMRKTSHISGERVFLAEKTASIKALRQEHACCVQEMKECQDPDLLHNWPDAFTLRGNNASKVANPFWNQLSASNPFLDDITQLRNNRKRNNISILKEDPFLFCREIENGNSFDSSGDELDVHQLLRQTSSRNSGRSKSVSELLDILDDTAHAHQSIHNSDQILLHDLEWLKNDREAYKMAWLSQRQLARSCLDLNTISQSPGWAQTQLAEVTIACKVNHQGGSVQLPESDITVHVPQGHVAVGEFQEVSLRAFLDPPHMLNHDLSCTVSPLLEIMLGNLNTMEALLLEMKIGAEVRKDPFSQVMTEMVCLHSLGKEGPFKVLSNCYIYKDTIQVKLIDLSQVMYLVVAAQAKALPSPAATIWDYIHKTTSIGIYGPKYIHPSFTVVLTVCGHNYMPGQLTISDIKKGGKNISPVVFQLWGKQSFLLDKPQDLSISIFSCDPDFEVKTEGERKEIKQKQLEAGEVVHQQFLFSLVEHREMHLFDFCVQVEPPNGEPVAQFSITTPDPTPNLKRLSNLPGYLQKKEEIKSAPLSPKILVKYPTFQDKTLNFSNYGVTLKAVLRQSKIDYFLEYFKGDTIALLGEGKVKAIGQSKVKEWYVGVLRGKIGLVHCKNVKVISKEQVMFMSDSVFTTRNLLEQIVLPLKKLTYIYSVVLTLVSEKVYDWKVLADVLGYSHLSLEDFDQIQADKESEKVSYVIKKLKEDCHTERNTRKFLYELIVALLKMDCQELVARLIQEAAVLTSAVKLGKGWRELAEKLVRLTKQQMEAYEIPHRGNTGDVAVEMMWKPAYDFLYTWSAHYGNNYRDVLQDLQSALDRMKNPVTKHWRELTGVLILVNSLEVLRVTAFSTSEEV

SEQ ID NO: 920456 - protein, 686 aa, Homo sapiens
FYNFLFPFVSLALGIVTASCSKYLKMMRKTSHISGERVFLAEKTASIKALRQEHACCVQEMKECQDPDLLHNWPDAFTLRGNNASKVANPFWNQLSASNPFLDDITQLRNNRKRNNISILKEDPFLFCREIENGNSFDSSGDELDVHQLLRQTSSRNSGRSKSVSELLDILDDTAHAHQSIHNSDQILLHDLEWLKNDREAYKMAWLSQRQLARSCLDLNTISQSPGWAQTQLAEVTIACKVNHQGGSVQLPESDITVHVPQGHVAVGEFQEVSLRAFLDPPHMLNHDLSCTVSPLLEIMLGNLNTMEALLLEMKIGAEVRKDPFSQVMTEMVCLHSLGKEGPFKVLSNCYIYKDTIQVKLIDLSQVMYLVVAAQAKALPSPAATIWDYIHKTTSIGIYGPKYIHPSFTVVLTVCGHNYMPGQLTISDIKKGGKNISPVVFQLWGKQSFLLDKPQDLSISIFSCDPDFEVKTEGERKEIKQKQLEAGEVVHQQFLFSLVEHREMHLFDFCVQVEPPNGEPVAQFSITTPDPTPNLKRLSNLPGYLQKKEEIKSAPLSPKILVKYPTFQDKTLNFSNYGVTLKAVLRQSKIDYFLEYFKGDTIALLGEGKVKAIGQSKVKEWYVGVLRGKIGLVHCKNVKVISKEQVMFMSDSVFTTRNLLEQIVLPLKKLTYIYQEAEAGEWREPG

SEQ ID NO: 920457 - protein, 151 aa, Homo sapiens
CLGYESYDSDRVRDRYRDGYRDGPRRDMDRYGGRDRYDDRGSRDYDRGYDSRIGSGRRAFGSGYRRDDDYREGRDCYEDQYDRRDDRPKLNLKPRSTPKEDDSSASNSQSTRAASIFGGAKPVDTAAREREVEERLRRNKRSCSVSWMGQN

SEQ ID NO: 920458 - protein, 424 aa, Homo sapiens
SLLKLPLACCDGLASAMWKMASSAPVCAPTDWFLEHKHRAIMTVDLITEIPTKWLRAGSIYGMDQLDKGMIPNPDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLSNRRIRVDVADQALDKDRDDPPFGRDRNRDSDKTDTDWRARPATDTFDDYPPRRGDDSFGDKYRDRYDSDRYRDGYRDGPRRDMDRYGGRDRYDDRGSRDYDRGYDSRIGSGRRAFGSGYRRDDDYREGRDCYEDQYDRRDDRPKLNLKPRSTPKEDDSSASNSQSTRAASIFGGAKPVDTAAREREVEERLRRNKRSCSVSWMGQN

SEQ ID NO: 920459 - protein, 114 aa, Homo sapiens
MCKQRQRRFRGEANAIKRGTGVSQSRWCECVSPEAYGAMAKPTMVSRHVSGGRADQVTFPSMLRKIKEHLGTRRGPVPESKPHFEMPAGGLKRFLQNSPHPQPSTAKVALTQPS

SEQ ID NO: 920460 - protein, 231 aa, Homo sapiens
MKGLVTRQWWLHCDKKAACSNPLQHANSLEHRAFMSHLRGRVSQEKEEFQDCEVGSGDCSSDSIPKRGCVHELGLLGMGIKSESSSTNWETFSVEDFEPDPEKPQVHEEHGSQTEPDLGNSRPTRNMEVRKRGGQCGGHIQPSINPSHSHVAPGMKAQFWSWPEGLQFAIQLFPARLSHPTWAPGHAVDCAMKGIRGCSWKQLLCHLSAPFLQVKVRDPIHTSTDSILTPI

SEQ ID NO: 920461 - protein, 504 aa, Homo sapiens
NSWLRMRMNHIKSISPESGGRVGPTESHNDVGGQRSLINKWTTFLKARLICSIPGSDGADTYFDELQDIYLLPTRDERNPVVYGVFTTTSSIFKGSAVCVYSMADIRAVFNGPYAHKESADHRWVQYDGRIPYPRPGTCPSKTYDPLIKSTRDFPDDVISFIKRHSVMYKSVYPVAGGPTFKRINVDYRLTQIVVDHVIAEDGQYDVMFLGTDIGTVLKVVSISKEKWNMEEVVLEELQIFKQQLYIGSRDGLVQLSLHRCDTYGKACADCCLARDPYCAWDGNACSRYAPTSKRRARRQDVKYGDPITQCWDIEDSISHETADEKVIFGIEFNSTFLECIPKSQQATIKWYIQRSGDEHREELKPDERIIKTEYGLLIRSLQKKDSGMYYCKAQEHTFIHTIVKLTLNVIENEQMENTQRAEHEEGKVKDLLAESRLRYKDYIQILSSPNFSLDQYCEQMWHREKRRQRNKGGPKWKHMQEMKKKRNRRHHRDLDELPRAVAT

SEQ ID NO: 920462 - protein, 416 aa, Homo sapiens
MPSQWSSAWHNHPCQLAPKRAPELAPPGHTAAGPKGQVCRSPPCSSHQHWGLSSVPREQRPGAEEASEEVMQAGPGRIPQSPHGRRHQVCVQWKSHCNGPSRYAFAWSRGSQSRADPQQARKAPENHKALSGSSYSETTPPQTRPLHPTHPSILAHQGVGALVTAGALCGQLPCCPNHGVWPLSLTSTSRKQLRLPGTGREHPMAGIFDSRYARIYSDVVYTRKTRQAVPDKGGQLGCEEEFEKNLKKGVGGDQGSCRQPLAGSTWQPSGASAGLKHLSKKRAACGPPYASLEPRLGWEVRGTRAMADEEMLPTVLCRSLSAKFSGMHHADMVFCESTAKTLSHRRLESSAQIMWVACFGGSSHHARRMLKQPQGEGHAERTEAASDNLPDTGCAPLEMDSPAPIGPLDDVASADI

SEQ ID NO: 920463 - protein, 243 aa, Homo sapiens
MRIGGSRRQGIMRFQGTGLEGTPKMMKLQSCLLAKPSEVLPELDSDSPSDGANGRIVNLGLSKGRQLPISGASVKLSNQVRSYRGRGGLFNMAGPLSPSFRALILDYTKSDPKPAQDWLSHKAHSDHYLATTDVHSRPKFSSESLHMAAAAWIALYWVSPAEGLQQVTAYWLLLMFIQGPRALYSAGDECCQNWYLPFKAVCSLLAQAMLFELSATYEAKVSPGSITSAFRYIHERHILKKQV

SEQ ID NO: 920464 - protein, 1107 aa, Homo sapiens
MLQILGHILSTQTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSPPGGHSPLQYCPPLYAHFSAALRIGTGIQVSFERLHKMKLLGPPCQQSCALPLSSPVSSLSVVLGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLPAIVSIAVAGGLLIIFIVAVLIAYKRKSRESDLTLKRLQMQMDNLESRVALECKEERNMVTALVLCNSLRLYCMLTFLGVLATLFIWRPELPPHTAVPTCRLLFVPAFAELQTDIHELTSDLDGAGIPFLDYRTYTMRVLFPGIEDHPVLRDLEVPGYRQERVEKGLKLFAQLINNKVFLLSFIRTLESQRSFSMRDRGNVASLIMTVLQSKLEYATDVLKQLLADLIDKNLESKNHPKLLLRSPRALTSCFFLCLVPLVPSVTADRTESVAEKMLTNWFTFLLYKFLKECAGEPLFSLFCAIKQQMEKGPIDAITGEARYSLSEDKLIRQQIDYKTLVLSCVSPDNANSPEVPVKILNCDTITQVKEKILDAIFKNVPCSHRPKAADMDLEWRQGSGARMILQDEDITTKIENDWKRLNTLAHYQVPDGSVVALVSKQVTAYNAVNNSTVSRTSASKYENMIRYTGSPDSLRSRTPMITPDLESGVKMWHLVKNHEHGDQKEGDRGSKMVSEIYLTRLLATKNYVSRAVSGRILPLQGTLQKFVDDLFETIFSTAHRGSALPLAIKYMFDFLDEQADKHGIHDPHVRHTWKSNCLPLRFWVNMIKNPQFVFDIHKNSITDACLSVVAQTFMDSCSTSEHRLGKDSPSNKLLYAKDIPSYKNWVERYYSDIGKMPAISDQDMNAYLAEQSRMHMNEFNTMSALSEIFSYVGKYSEEILGPLDHDDQCGKQKLAYKLEQVITLMSLDS

SEQ ID NO: 920465 - protein, 189 aa, Homo sapiens
MALEHLVVWHVHSEDQSFVVLKTDLGRRGCRPLRKTAPKAKEAPAPPKAEAKVKALKAKKAVLKGVRSHTQKRRSACHSPSGGPRHCDSGGSPDILGRAPPGETSLATMLSMGRKKIEENNMLVFFVDVKANKHQIKQAVKKLYDSDVAKVTTLIFPDKENKAYVRLAPDYEALDVATKLGSSKLSPAG

SEQ ID NO: 920466 - protein, 384 aa, Homo sapiens
MGGRLRSISGRRGTPRRQEGGCRACDIRGDQQTPGVEDAAGRELRGWVWPQKAEGTHPSGPRLRRIRFRVNKKRRARGGARTCREGRQRKRRGRAGAGSRAGAGSLPTSRPRCARFWPCQCLRRLKARVCVGFCWSAFGVPWVRAASTQLPVRVSLLSQWHGLASLRPLLPGFKDSPASVSQVAGITGPTRGRVTMALEHLVVWHVHSEDQSFVVLKTDLGRRGCRPLRKTAPKAKEAPAPPKAEAKVKALKAKKAVLKGVRSHTQKRRSACHSPSGGPRHCDSGGSPDILGRAPPGETSLATMLSMGRKKIEENNMLVFFVDVKANKHQIKQAVKKLYDSDVAKVTTLIFPDKENKAYVRLAPDYEALDVATKLGSSKLSPAG

SEQ ID NO: 920467 - protein, 159 aa, Homo sapiens
MSAGGNLKDCFSVLECKHKAVQLDLGVCLLEVAPEGCFLAHLKASPGEEACGVVSQSQGMAAQLLMQPRACLPGAAHSFSCKRGFPIRPPPPLSPHSRRSRNLIVNCACKGSRLHAPYGPHCPAPPPPPSPPLSMEKLSSTKSVPGAKRFRITVVRYAC

SEQ ID NO: 920468 - protein, 170 aa, Homo sapiens
MPRVLGFLLQGAPHPPCSPLKPASSEGNPEIPQISYASTAPDLSDNSRYDFFSRVVPSDTYQAQAMVDIVRALKWNYVSTVASEGSYGESGVEAFIQKSREDGVPSDKWLSDNKGYPLGSSSNVPGTSSPQGLCTGWSSCGKASPACPHGLHSWCLQLYRQHAANTSGDL

SEQ ID NO: 920469 - protein, 374 aa, Homo sapiens
EGWGMGGRPLQPPCLQQQLGWSWELKSWELSASSWLWGWVWLDLPYHWVKPVPTSAHYCAWPRDRQTDRQTDRQTDKPGKPPAQGLGVELRNRMVPAAGVDPPESAGTEQAAMGPCLSFWTQQYEHTALSAFAHCGLLGLEGVEAYHEYLYVGPFLQTPPEIRSEQGAASVQGQPWEAARNQAKIPWALLGKGGMAVPLGAPCWASALPAWAPPGLPHRSLLTRLLSQHVKPAKIPQISYASTAPDLSDNSRYDFFSRVVPSDTYQAQAMVDIVRALKWNYVSTVASEGSYGESGVEAFIQKSREDGVPSDKWLSDNKGYPLGSSSNVPGTSSPQGLCTGWSSCGKASPACPHGLHSWCLQLYRQHAANTSGDL

SEQ ID NO: 920470 - protein, 777 aa, Homo sapiens
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKLSRATEQLETYRKLAKDLEEELERTVHFYQKQVISYEKRGHDNWLAARTAERNLSDLRKENAHNKQKLTETELKFELLEKDPNALDVSNTAFGREHAPNGPAPLGQRSSETRAFLSPQTLLEDPLGLSPVLPEGGGRGPRGPGNPLDHQITNERGEPSCDRLTDPHRAPSDTGSLSSPVEQDCKMMFPPPGQSYPDSALPPQREDRFYSNSERLSGSAEPRSFKMTSLDKMDGSMPSEMESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYFHPRPGFYPNPAF

SEQ ID NO: 920471 - protein, 142 aa, Homo sapiens
MNMSTKKKTKKCLKMYEIIVVADDKVEYCLICYFSRMIACIPGTGWYPLFPECPCDIRIIWIYNCIISVQLHALNRYLLHYASIPGEGGEGVISNSAGGCVAAVSPPSPQWNTKKHPDPAWIEARAAEARGYDKSRWKETVI

SEQ ID NO: 920472 - protein, 126 aa, Homo sapiens
MTLFLVFILFGGVWVVTIRHSKALSLGVAQCSWLLKQQVISDDKTKYKQQSSPCCCSAYGVAILYFFTFLITYLLSLYSMDLPQILSCGRSKNTLLGSGSGPLSYNTTTCFLGSPACRWQIVGLTS

SEQ ID NO: 920473 - protein, 262 aa, Homo sapiens
VKWFNVRNGYGFINRNDTKEDVFVHQTAIKKNNPRKYLRSVGDEETVEFDVVKEKRVRRQQMLQILVVFEFKAQNYQNSESGEKTEGSENAPEGQAQQCRPYRRQRFPPYYMRRPYGCRPQYSSPPVQGEVMEGADNQGAGEQGRPVRQNMYRGYRPRFRRGPPCQRQPREYGNEEDKIKEMRPRVSSHLNACHVTAPGRGRQSRTAETPGSRLATAGRGAMETSSRELQAAEYLEKHQIKEVVSYLTSALLFFRPVFYSII

SEQ ID NO: 920474 - protein, 291 aa, Homo sapiens
EPRASGGLKVSSDSKPVIYNCPHQAQQKLLVNPGEASAMLACMVLPSMCGKRSEDELNPFLCGRLHQAPPQETVPCAAAQPIPGGGGPKLHAHRAQRQPKQKFAGRAPPAPAIAMWLPQGFRSSAVFAEGFRSSAVFAEGFRSSPVFAEGFRSSPVFAEGFHSSAVFAEGFRWSAVFAEGFRWSPVFAEGFRSSPVFAEGFRSSPVFAEGFRSSAVFAEGSCSSAGSTVLSSRATLCQGPWARHLPGMLLQQQEHWLGPSERSCEDVPWGITWKCFQLSLHSPADLSEAQA

SEQ ID NO: 920475 - protein, 138 aa, Homo sapiens
MFTIWVTGSLEAQTSASCNMPVLGHGRTDGGVIHRKSARTAERSSPVDAFSDLSFLHAVGKTGPKSNGKDIRDHRHRKSRNGHGRSSRDKATPQTTEGTSHTVSLKELVVVVRKNRECSFQDSQQKYCKCECVPFACV

SEQ ID NO: 920476 - protein, 189 aa, Homo sapiens
MALPQGIPEAFFSPGLGSGSAQSDFISQETQCQGVNQGPTSPVGFARGEERQGYSDTGSSLAAAVITSYSWRLEGESARCWGTLQASRAPFLHLQSQHCTSQCCSHSSIPLAPSDPASLLPSAYENHGDHGGPTWVTEYNLNFQDGILSTQVWSPHTTSPEPELATGTMEKLRVKLMLKKLRTGSRRKS

SEQ ID NO: 920477 - protein, 148 aa, Homo sapiens
NSQRNMNGWQQKMILEHWESAVLHRKRWEILFTVVCLKLGQKNKQDEFGALESVKAASELYSPLSGEVQSYPGGLQALLQLRPHSLTRHWSDVVAIGVHVICELYAVGCASVADGRGQKMTPATSRRQVEDIITYCWAQNQGDVKSSD

SEQ ID NO: 920478 - protein, 164 aa, Homo sapiens
RAKPAAGERQRGPSGVWVILDTGKMYLLQNCLVGSLSLILQHEWAGVRPLLAVAAAGLFLGAESRSRRAMLRPFVMLGETTHTHPDPRSRKTPGKKTKITMKAHVDATGGRYPKQINAGTENEILYVPTNSCAFPAGTEQGQCVHMWECQKHQRNPDVPRPICA

SEQ ID NO: 920479 - protein, 141 aa, Homo sapiens
MRLWGSRRVICGPFGIFHPGPVSLLFFPSGSRRLKSSKKCSCFRDKRELSSSDSGDILWPRLPGQQQALLNGQALGGRPEVWLLESHSCCCVLQLQPVLLLSPIPGWGETEGRCRGERQRRGKERGEEKGRGEYCSKIWQP

SEQ ID NO: 920480 - protein, 141 aa, Homo sapiens; identical to SEQ ID NO: 920479

SEQ ID NO: 920481 - protein, 459 aa, Homo sapiens
MVTNALTLPVLQADGGVLRVTCLPLTLGAQVKMSTPTGLGSKQHRSPRDIVEAMEWVLVIHEEHFCRPSGIPGFKSITHWAEGAAGGRRSLAKRFISLSATWMPEAHVPARPLQYPKCLRAKTFKLLAVTSLGWDTNRKVVSNMSSDFEPRYQSLLCENLHITIEVCNTPNPTTLLLVSESPVEHNCVEVLDSVYSSRPDLRDHLWTSVDWELYVDGSSFINPQGERCAGYAVVILDAVIEAKSLPQGTSAQKAELIALIWALELSEGKTVNIYTDSRQGPTVLSGIQAYGEAPFEDLNIDFTKMPKCGSNKYLLVPVCTYSGWVEAYPTRTKKARVLLRDLIARFGLPLWIGSENGPAFVADLVQKTAKVMSVDQRLERSPLAATVERTPDCHLDHSHSCEGRGNPSLGPPQLRKTCSTGDLVGETKPRQPLQSDSEEVDKPCSSHTRKPTGPLMAEA

SEQ ID NO: 920482 - protein, 106 aa, Homo sapiens
MAEKGPGVLGERALGAAAPVDAKGFGIRESPPRLPARLRIAMPAKGKKGKGQGKSHGKKQKKPEVDILSPAAMLNLYYIAHNVADCLHLRGFHWPGAPKGKKGRSK

SEQ ID NO: 920483 - protein, 139 aa, Homo sapiens
MGGWDLPQGLSKETRPLCAPLETLLILGVRLTAGRDLSRNLSPLTEPSLRSVHGLLLDTARIQKSMLSILKPRRSQEWRTALRRYCCPTDLQAPRSPVPPIRKVGISDVIVHANLATSLKKNTCNCQADLLSWRSWVND

SEQ ID NO: 920484 - protein, 134 aa, Homo sapiens
MVKHQTVCLKSQTKWEGAETSEAPRGHSCDRHKDVPQGQGRTCSPALGSVVSRQPLAVRNFKVSLSCRELLPRWRCLSQSEPWPCSDPQPQSNMKMVQETLDQGSAFQSQIQEHERSCVVMDRTHPSHSVFSLS

SEQ ID NO: 920485 - protein, 142 aa, Homo sapiens
MLKGSCFQFALIKQTFQTTSSQSDHCSSFHGTRSPGNHSSLSGAGGRPLTVLASPRIFRHVLLGAEGPPRAELSQHHPAHSSVKCPWHDAPREPKDAPRMLPATTEGALLGDPQNCQCLVGQQPHAPSVLESRPGADGPDGL

SEQ ID NO: 920486 - protein, 187 aa, Homo sapiens
GYPGKLKMHLSSSAVTDRPCRPALPSTNLLQPVLLQHEAAESVVKIEAFYRLLKLVSYGGLDLNSDCLAPFEISVLGGDQLRCTTNSKRSEWDSSEVFESNSRMAVALHRMANPAHCTETIDAALEGSKLALPWYVDAGGMELQFVSLKQIKHCLPQPVLTIFSLVNSPWKNKQSTQALRKQKFHDS

SEQ ID NO: 920487 - protein, 132 aa, Homo sapiens
MFPFDATSDSTYSPPNSVIACSGPMRLAQAFFSSYMTHYDLNLQVCISVVQPGCLCCKNSKAETLDAISPQRVPAGHQCSSVLVMCQPPSLCHRILPTPSCEAGISIPVYSTYLVVTERFFYTGSIIYVMFN

SEQ ID NO: 920488 - protein, 686 aa, Homo sapiens
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQAEPREEPCVWEQRHPEEREIPMDPEAGDGSRRECGVQGRAREDSRLSAHCCREAPLCVHHGARVLGGSQGPVLPESKFGGAEPLVPAQDASSQVKREDTLCVRGQRGLEERAIPTESITDSPISAQDLLSRIKQEEHQCVWDQQDLADRDIPTDPNSGDSLLMVKNPPPAPPQPQPQPQPPQPQLQSQPQPQSLPPIAVAENPGGPPSRGLLDDGFQVLPGERGSGEAPPGGDRSTGGGGGDGGGGGGGAEAGTGAGGGCGSCCPGGLRRSLLLHGARSKPYSCPECGKSFGVRKSLIIHHRSHTKERPYECAECEKSFNCHSGLIRHQMTHRGERPYKCSECEKTYSRKEHLQNHQRLHTGERPFQCALCGKSFIRKQNLLKHQRIHTGERPYTCGECGKSFRYKESLKDHLRVHSGGPGPGAPRQLPPPPERD

SEQ ID NO: 920489 - protein, 686 aa, Homo sapiens; identical to SEQ ID NO: 920488

SEQ ID NO: 920490 - protein, 408 aa, Homo sapiens
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQADPTLCPECGKSFGVRKSLIIHHRSHTKERPYECAECEKSFNCHSGLIRHQMTHRGERPYKCSECEKTYSRKEHLQNHQRLHTGERPFQCALCGKSFIRKQNLLKHQRIHTGERPYTCGECGKSFRYKESLKDHLRVHSGGPGPGAPRQLPPPPERD

SEQ ID NO: 920491 - protein, 686 aa, Homo sapiens; identical to SEQ ID NO: 920488

SEQ ID NO: 920492 - protein, 145 aa, Homo sapiens
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKKKEKGKW

SEQ ID NO: 920493 - protein, 53 aa, Homo sapiens
MDARRPMPFQFPPFPDRAPVFPDRMMREPQLPTAEISLWTVVAAIQAVERKVD

SEQ ID NO: 920494 - protein, 671 aa, Homo sapiens
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQAEPREEPCVWEQRHPEEREIPMDPEAGAEPLVPAQDASSQVKREDTLCVRGQRGLEERAIPTESITDSPISAQDLLSRIKQEEHQCVWDQQDLADRDIPTDPNSESLISAHDILSWIKQEEQPYPWGPRDSMDGELGLDSGPSDSLLMVKNPPPAPPQPQPQPQPPQPQLQSQPQPQSLPPIAVAENPGGPPSRGLLDDGFQVLPGERGSGEAPPGGDRSTGGGGGDGGGGGGGAEAGTGAGGGCGSCCPGGLRRSLLLHGARSKPYSCPECGKSFGVRKSLIIHHRSHTKERPYECAECEKSFNCHSGLIRHQMTHRGERPYKCSECEKTYSRKEHLQNHQRLHTGERPFQCALCGKSFIRKQNLLKHQRIHTGERPYTCGECGKSFRYKESLKDHLRVHSGGPGPGAPRQLPPPPERD

SEQ ID NO: 920495 - protein, 496 aa, Homo sapiens
RGGGGEEQAGGARLTACWLQVPVTFVDIAVYFSEDEWKNLDEWQKELYNNLVKENYKTLMSLDAEGSVPKPDAPVQAEPREEPCVWEQRHPEEREIPMDPEAGAEPLVPAQDASSQVKREDTLCVRGQRGLEERAIPTESITDSPISAQDLLSRIKQEEHQCVWDQQDLADRDIPTDPNSESLISAHDILSWIKQEEQPYPWGPRDSMDGELGLDSGPSDSLLMVKNPPPAPPQPQPQPQPPQPQLQSQPQPQSLPPIAVAENPGGPPSRGLLDDGFQVLPGERGSGEAPPGGDRSTGGGGGDGGGGGGGAEAGTGAGGGCGSCCPGGLRRSLLLHGARSKPYSCPECGKSFGVRKSLIIHHRSHTKERPYECAECEKSFNCHSGLIRHQMTHRGERPYKCSECEKTYSRKEHLQNHQRLHTGERPFQCALCGKSFIRKQNLLKHQRIHTGERPYTCGECGKSFRYKESLKDHLRVHSGGPGPGAPRQLPPPPERD

SEQ ID NO: 920496 - protein, 686 aa, Homo sapiens; identical to SEQ ID NO: 920488

SEQ ID NO: 920497 - protein, 466 aa, Homo sapiens
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQAEPREEPCVWEQRHPEEREIPMDPEAGAEPLVPAQDASSQVKREDTLCVRGQRGLEERAIPTESITDSPISAQDLLSRIKQEEHQCVWDQQDLADRDIPTDPNSPREAPKGFPFTLVHLLHSSGRCVPRGHSLHFSVLHGLAPGGVVCPRTLVCVKNDFPCPCRGSGVPPSRDHSGQPAPGTTLASVLLPPSPSSTLLRFPQTPFCRAKGILDIK

SEQ ID NO: 920498 - protein, 676 aa, Homo sapiens
VQESASVEALKMSTQEELQELRERYHFLNEEYRALQESNSSLTGQLADLEKPDPEMQLLRQQLRDAEEQMHGMKNKVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEVTTVREAGFPLAAPGAIEVMATS

SEQ ID NO: 920499 - protein, 392 aa, Homo sapiens
MIPIAEGWGHCRDSLSGNPLISYSPRSHPSSSPLPWVCILRPDTDADGDGDAADGGDGDAAADDDGGDNDGDAADGDGGDDDGDAADGVDGDAADGDDGGDYDGDAAAAAGGDPADGFDGYDDGDAADGDDGDDDDGNDDDGEGNNGNDGDGDDGDNNDDADGDDNDGDATAVATDDGDDAKSLTSLIFTIIQYLSLGNDGDDGSSRVATSVHQCPLYLPWSTYKPFGPPSKIYSNPSTSLLCSYYHPNPNYYHLDALDNSDHDGGGGSGVDDGDGNGDDGGGGDGNDDVSCGVDDGNDNDCDGGVGGAGDDNDGGGGGGDDGGGGDGNDDDVSCGVDDGNDNDCDDGGGGGDDGDDDYDGGVGGAADDNHGGSGGDDGGGGGGDDGGGGGD

SEQ ID NO: 920500 - protein, 98 aa, Homo sapiens
ARALVFSTSVSVSHRPWASQGKGGVTFLARHLPSAELSSPAKEVAVSCSSQDAYSQGTVHCLVKGSVQGNSISYSLPLNLLHPFFPQMSIAWTQMPTS

SEQ ID NO: 920501 - protein, 392 aa, Homo sapiens; identical to SEQ ID NO: 920499

SEQ ID NO: 920502 - protein, 152 aa, Homo sapiens
MHYTHTFDNLEDMNKFLDIYKLIVGLAILPSMTFPLIISYLSNFKLTHMRPSILWYFTCISRASQQLILPWKPFMNLNYQVEIKLVLDLELCSVKVFSLGKLAFIMIKFLGILHNDYSSLPNRAMRSSLDLHCEKPVVFLEDIHPWNQDTIL

SEQ ID NO: 920503 - protein, 170 aa, Homo sapiens
LSLLQSLNINCEDFMDTYHFPSQYSCDFLCLKNNHSPLFALTWHAINHILIYSCIPPGSANDLVFVVLISVSLEPIDIHVISCWEQFLMNESLNEPFKTPSASKFICVALKVNQKQEAKDLSPLMHPDLGYFMSGSVQSKPRQPTCLEDTSCSGTYSSFQKAMKIELHGM

SEQ ID NO: 920504 - protein, 111 aa, Homo sapiens
MILFSACCICGLIGGILNFQFLRAVTKKTSSLYPLHLASMSLACIGIGGCTLSSWLTCRLASYEQRRMFSEREHSLHHSHEMAEKRLRAIEITDLPSCPVVPPTPELPTRK

SEQ ID NO: 920505 - protein, 137 aa, Homo sapiens
AHIHSLPHHTHTSMNTLGIFVEYCRAKKKSGLVMILFSACCICGLIGGILNFQFLRAVTKKTSSLYPLHLASMSLACIGIGGCTLSSWLTCRLASYEQRRMFSEREHSLHHSHEMAEKEITDNMSNGGPQLIFNGRV

SEQ ID NO: 920506 - protein, 182 aa, Homo sapiens
MKENQLERKEEEEDDDEGEETQTERGHQTRSLFLATKQLQGATLDSAWGARLGAPWAPPGFPLLKSPGTGRSFYDPYLNVPGGGAAPLPLAQPGKVFVSGNPALVDNASLLKKEKFWDLVGGGRGKEDSGRKKGRWLISLSDLKEDDRGRMCTSGQIIGSLLVLSVLEIGLGVSSVAVGAPQ

SEQ ID NO: 920507 - protein, 137 aa, Homo sapiens; identical to SEQ ID NO: 920505

SEQ ID NO: 920508 - protein, 169 aa, Homo sapiens
MSACVRSRFRGRGDGQEESDLVAFMASQKHQLHFNVAAIGHLWLLGAWNVAGLNCDVVERALGGGALNIIQSGTRGWDPSNQARSWSGQDGFRDLAGPLSLAAAGAPGLVFTALTTWKPRNGESAVRHPERGGGAGWNRSEVAVAGLQAPSTGLQNPRPELSLAQLGPQ

SEQ ID NO: 920509 - protein, 263 aa, Homo sapiens
VPSHLYPFKHGLFSEQGVIMGDLFSLFWEVDPPPIPVNCAIPNQDYECWKDDSCGTIGSFLLWYFVIVFVLMFFSRASVWMSEDKKDEGSGTSTSVRKASKETSCKRQSKDSAWDPSQTMKKPKQNQLTPVTNSEVALVNAYPEQRRARRQSQFNEVNQNQHDSDTTEYGSEESNSEASSWKESESEHHPSPDSIKRRKMAQRQRNLGSYQMSERHCLHCKALRTNEWLAHHSRQKPSVTPPMKRDSQEESSISDINKKFSKF

SEQ ID NO: 920510 - protein, 900 aa, Homo sapiens
AGCWLRRKVRIGMVDCPGTGSGGRSTSQWWTVQVVAQEGGPRHNGGLSRCWLGREVHVTMVDCPGSGSGGRSTSQWWTVRVVAREGGPRHNGGLSRCWLGREVHVTMVDCPGSGSGGRSTSQWWTVQVLAQEGGPRHNGGLSGYWLGREVHVTMVDCPGAGSGGRSTSQWWTVRVVAQGGGPRHNGGAVQVLAQEGGPRHNGGLSRCWLRREVHVTMVDCPGTGSGGRSTSQWWTVQVVAQEGGPRHNGGLSRCWLGREVHVTMVDCPGSGSGGRSTSQWWTVQVLAREGGPRHNGGLSRCWLRGKVHIGMVDCLGERSTSEWWTVLRGRSTSEWTVQDGACAGCVLAPLCVYSESLSVTWPLVTRCTYNMHLAAARCSLWTQIKRVCPEVESALEWSRLPWSGVICPGAESALKRSLPWSGVVCPGVESSALEWSRLPWSGVVCPGAESALEWSPLPWSGVVCPGVESSALEQSLPWSGVICPGAESALEWSRLPWSGVVCPGVESSALEWSLPWSGVVCPGVESSTLEWSLPWSGVVCPGVESALEWSRLPWSGVVYPGVESSTLEWSLPWSGVICPGAESALVWSRLPWSGVGPGVESALEWSRLPWSGVVCPGVESALEWSRLPWSGVIYPRSGVVYPGVESALEWSRLPWSGVCPGVESSTLEWSRLPWSGVCPGVESSALERSLPWCGVVCPGVESALEWSLPWSGVVYPGVESSALEWSLPWSGVVCPGVESSTLEWSRLPWSGVCPGVESSALEWSLPWSGVVYPGVESSTLEWSRLPWSGVCPGVESSALERSLPWCGVVCPGVESALEWSLPWSGVVYPGVESSALEWSLPWSGVVCPGAESALEWSRLPWSGVCPGAESALERSLPWSGVVCPGVESALEWSLPWSGGK

SEQ ID NO: 920511 - protein, 340 aa, Homo sapiens
MVCFSRACTFIAADSYRPGVPNFSICQQGNNDNETALHCAAQYGHTEVVKVLLEELTDPTMRNNKFETPLDLAALYGRLEVVKMLLNAHPNLLSCNTKKHTPLHLAARNGHKAVVQVLLDAGMDSNYQTEMGSALHEAALFGKTDVVQILLAAGTDVNIKDNHGLTALDTVRELPSQKSQQIAALIEDHMTGKRSTKEVDKTPPPQPPLISSMDSISQKSQGDVEKAVTELIIDFDANAEEEGPYEALYNAISCHSLDSMASGRSSDQDSTNKEAEAAGVKPAGVRPRERPPPPAKPPPDEEEEDHIDKKYFPLTASEVLSMRPRIHGSAAREEDEHPYE

SEQ ID NO: 920512 - protein, 352 aa, Homo sapiens
MVCFSRACTFIAADSYRPGVPNFSICQQGNNDNETALHCAAQYGHTEVVKVLLEELTDPTMRNNKFETPLDLAALYGRLEVVKMLLNAHPNLLSCNTKKHTPLHLAARNGHKAVVQVLLDAGMDSNYQTEMGSALHEAALFGKTDVVQILLAAGTDVNIKDNHGLTALDTVRELPSQKSQQIAALIEDHMTGKRSTKEVDKTPPPQPPLISSMDSISQKSQGDVEKAVTELIIDFDANAEEEGPYEALYNAISCHSLDSMASGRSSDQDSTNKEAEAAGVKPAGVRPVCDPGLTPPGGCVGWLAPEVMGHGEGKCDPWCQLMFPGPGAHLFSSSWGSAGSLLLSVLKLYRSH

SEQ ID NO: 920513 - protein, 214 aa, Homo sapiens
FVFLQFRFADGLDITLMILGILASLVNGACLPLMPLVLGEMSDNLISGCLVQTNTTNYQNCTQSQEKLNEDMTLLTLYYVGIGVAALIFGYIQISLWIITAARQTKRIRKQFFHSVLAQDIGWFDSCDIGELNTRMTEYTQNLKDAKDFGIKRTIASKVSLGAVYFFMNGTYGLAFWYGTSLILNGEPGYTIGTVLALADFSGHTSQHVITTRL

SEQ ID NO: 920514 - protein, 214 aa, Homo sapiens; identical to SEQ ID NO: 920513

SEQ ID NO: 920515 - protein, 255 aa, Homo sapiens
KGRRHRQPGDYCTTAICNAALGNPGNLKGQQRDRHSRLFRAHSADRTMATIAAAAFEALMDGVTCWDVPRGPIPSELLLIGEAAFPVMVNDKGQVLIAASSYGRGRLVVVSHEGYLSHAGLASFLLNAVSWLCPCPGAPVGVRPSLAPLVNILQDAGLEAQVKPEPGEPLGVYCINAYNDTLTATLIQFVKHGGGLLIGGQAWYWASQHGPDKVLSRFPGNKVTSVAGVYFTDTYGDRDRFKVSKKVPKIPLHVR

SEQ ID NO: 920516 - protein, 259 aa, Homo sapiens
MATIAAAAFEALMDGVTCWDVPRGPIPSELLLIGEAAFPVMVNDKGQVLIAASSYGRGRLVVVSHEGYLSHAGLASFLLNAVSWLCPCPGAPVGVRPSLAPLVNILQDAGLEAQVKPEPGEPLGVYCINAYNDTLTATLIQFVKHGGGLLIGGQAWYWASQHGPDKVLSRFPGNKVTSVAGVYFTDTYGDRDRFKVSKKVPKIPLHVRRIPWEHPPAEICTSATILSGRRKGKGSAASLATACIISSQRRSTGSGSFRA

SEQ ID NO: 920517 - protein, 48 aa, Homo sapiens
MATIAAAAFEALMDGVTCWDVPRGPIPSELLLIGEAAFPVMVNDKGQV

SEQ ID NO: 920518 - protein, 86 aa, Homo sapiens
AGTVRSVGIASPPTRPPGATAEPVRQSLGIRTAQGRIPWEHPPAEICTSATILSGRRKGKGSAASLATACIISSQRRSTGSGSFRA

SEQ ID NO: 920519 - protein, 259 aa, Homo sapiens; identical to SEQ ID NO: 920516

SEQ ID NO: 920520 - protein, 381 aa, Homo sapiens
SVREAGTARRAPESSRRRAVAAGHPETMGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 920521 - protein, 76 aa, Homo sapiens
PRAAGFGTSMKLLNYNPEDPPGSEVLRIQNVLSEKPRVSTVYANNGSVLQGTSVASVYHGKILIGTVFHKTLYCEL

SEQ ID NO: 920522 - protein, 95 aa, Homo sapiens
YTRDSISGLKYPGMPNFAPDEPGKIFLMDLNEQNPRAQALEISGGFDKELFNPHGISIFIDKVGRSKMGLLAESAELLRWGLTASHAFCAPGRPS

SEQ ID NO: 920523 - protein, 349 aa, Homo sapiens
MTNTLQKHISSFEVGFFFYRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 920524 - protein, 198 aa, Homo sapiens
SVREAGTARRAPESSRRRAVAAGHPETMGKLVALVLLGVGLSLVGEMFLAFRERVNASREVEPVEPENCHLIEELESGSEDIDILPSGLAFISSLQVCWSLLEVHSRPCLPGYHQWRLQNGKYCCLIFLLEASSQRGIRLYEGLKYPGMPNFAPDEPGKIFLMDLNEQNPRAQALEISGGFDKELFNPHGISIFIDKV

SEQ ID NO: 920525 - protein, 413 aa, Homo sapiens
SVREAGTARRAPESSRRRAVAAGHPETMGKLVALVLLGVGLSLVGEMFLAFRERVNASREVEPVEPENCHLIEELESGSEDIDILPSGLAFISSLQVCWSLLEVHSRPCLPGYHQWRLQNGKYCCLIFLLEASSQRGIRLYEGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 920526 - protein, 426 aa, Homo sapiens
SVREAGTARRAPESSRRRAVAAGHPETMGKLVALVLLGVGLSLVGEMFLAFRERVNASREVEPVEPENCHLIEELESGSEDIDILPSGLAFISSLQVCWSLLEVHSRPCLPGYHQWRLQNGKYCCLIFLLEASSQRGIRLYEGLKYPGMPNFAPDEPGKIFLMDLNEQNPRAQALEISGGFDKELFNPHGISIFIDKGVTFLEIIPFFHVDNTVYLYVVNHPHMKSTVEIFKFEEQQRSLVYLKTIKHELLKRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 920527 - protein, 296 aa, Homo sapiens
SVREAGTARRAPESSRRRAVAAGHPETMGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVRVPCLAHTI

SEQ ID NO: 920528 - protein, 263 aa, Homo sapiens
SVREAGTARRAPESSRRRAVAAGHPETMGKLVALVLLGVGLSLVGEMFLAFRLPLWEVHQTCAELVEIAAAGTSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 920529 - protein, 429 aa, Homo sapiens
SVREAGTARRAPESSRRRAVAAGHPETMGKLVALVLLGVGLSLVGEMFLAFRERVNASREVEPVEPENCHLIEELESGSEDIDILPSGLAFISSLQVCWSLLEVHSRPCLPGYHQWRLQNGKYCCLIFLLEASSQRGIRLYEGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 920530 - protein, 363 aa, Homo sapiens
SVREAGTARRAPESSRRRAVAAGHPETMGKLVALVLLGVGLSLVGEMFLAFRERVNASREVEPVEPENCHLIEELESGSEDIDILPSGLAFISSGLKYPGMPNFAPDEPGKIFLMDLNELNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 920531 - protein, 162 aa, Homo sapiens
SAVCMRCFCHGGRDSGERVNASREVEPVEPENCHLIEELESGSEDIDILPSGLAFISSLQVCWSLLEVHSRPCLPGYHQWRLQNGKYCCLIFLLEASSQRGIRLYEGLKYPGMPNFAPDEPGKIFLMDLNEQNPRAQALEISGGFDKELFNPHGISIFIDKV

SEQ ID NO: 920532 - protein, 365 aa, Homo sapiens
SVREAGTARRAPESSRRRAVAAGHPETMGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 920533 - protein, 150 aa, Homo sapiens
MFRNEGKKKEKTKMVSGFPVWAIWRGWVPLRDLERVGTIKRMRQDTFDTGRSVKWGKIDTCIQFTGPGISPFEMQKIQLLVPYESFSSPMWRGSGAHLCECVCVCGGKMLSRVKNVSLINQWKFITAVKSPGSGAKLLRFEAPFCCSLAT

SEQ ID NO: 920534 - protein, 150 aa, Homo sapiens; identical to SEQ ID NO: 920533

SEQ ID NO: 920535 - protein, 178 aa, Homo sapiens
MIFPEVLDSVIQARVQWGKTRLTAASISWLKLSSCLSLLFIWDHRNYSFAGGAKDQHGSFDLLRFRPGSVHPSLGNLAVPRSREVTLLMLNLARTPDGHSALQPRAPELKPSSCLSLQVARTTGTHPEEEEIPGAHAPRKSHLRTRQEGRHLQAKERGLRQKSNLSHLASWTSSPSEL

SEQ ID NO: 920536 - protein, 154 aa, Homo sapiens
MGVVILLMVQTSALSLKGSTSCETQHIHKHLKPTARHPSLSEKSRKVPIQMAELLRLGPDLYHHRVTEMEPSPSHLLMAVSCDPLNPGHHAFQFHLREHFQVRLKPSGSSRGLNPFGMLSGRQNQGPMIHDLVLVPMSVCQRPSEQIVFSLAGA

SEQ ID NO: 920537 - protein, 149 aa, Homo sapiens
MTATVSTTMLPNFTESSRYTNEFLIPKVIVKSDPIETTPGKDVLNIVEMTTKDLEYYVKLVDKAATGLERINSNLKRSSTLGKNAIKKHCMLQRNLSWKKESINAANFIIVSFYEIATVTPAFSNHHPDQSAAFNTEIRTSISKKIMPC

SEQ ID NO: 920538 - protein, 285 aa, Homo sapiens
MLQSGRGSREWEMATIPVIGTLASLDKPPFWNPFPYACGGGMVLYPAWALGSGLCSVLPLALPTLFLRGLDASRSGQMSSTKMTSQSVRETLPGDPCHSFPPSTGTYLDNTVCFAVAPYASCETHSHHLLWDTPVPRVVTWSPPRIRPCSCLHVSHKAWSAFRSPRAFRSGAGHCSFKGRGRQRADGSVHLQLTLGLDSYGIILCCREALPASPDVVSPSYLTRRAPKSDLKWSPENRCRRPDVPHPSVEGTQPDCQEWSGSRPSQCACARSQRLLPSQWFPPLS

SEQ ID NO: 920539 - protein, 285 aa, Homo sapiens; identical to SEQ ID NO: 920538

SEQ ID NO: 920540 - protein, 611 aa, Homo sapiens
MRPMENPRCPRRPLAEKKARSLDRPQAPGKGSESWDCHWLSLPTAPSRKALHWTTSDWARHSDSPAPSAEAHCTTAAAPTPEETGDFLPSEQRPSQDTKKGWLKTMLNFFVRTGPEEPREKASRRPRGKEGISQHPEPLEAAGEPALRKKAHHDKKPSRKKQGHKKHAAEVTKAAQDQEARGREEGLSKAAAALRSGEADLGPARRGGEDSDHQSFLIKVDGTGALDVSPHATGHQQEEELKKPDQDAIIQMIVELLKRVGDQWEEEQSLASQLGVALPNPAPAVRKKSQEKKTSLKRTSKTNPKKHGSEEAKRGAADVSSPEAWPPKKSSFLPLCVSGHRPSISSSYEEFIQKIISMLQDAEEQQGEEQPQVQQEEVGVENPAPHCRRKSQEKRSSFRRAFYHKKHTSKEPRRAGAAGAASPEARRPKRPSFLPLCVGGHRPSTSSSLDPEDLECREPLPAEGEPVVISEAPSQARGHTPEGAPQLSGACESKEIIIQKLVALLQEVDGQLGQQIRRHPSFKRFFYEFSDSSLSKLVATLRSQVAHSSKLDRNRARRLYQFDVSLANKFAGSNSHAMCILMGLRDHYNCTQFPYREDQPNITSPKVESPD

SEQ ID NO: 920541 - protein, 152 aa, Homo sapiens
ESAVLAFTPIMFVWARLSAPVIVYVRVLPIGMCGELSRRMKSDAVESDTAYSSRIHPWFFCRVKNSLGARGTKPAKICTASQGTYFPASNSFAVTKAATHAELKCLLIAKAAIFGGDKQTTSKPLQIPYIPGLHSRPTELNPLGMVPEKNIF

SEQ ID NO: 920542 - protein, 520 aa, Homo sapiens
MSHVYISVAVSRCKQNPEKWSGKMSNQQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATGKILKNNETLVQHGVKPQEIVQVEIFSTNPDLYPVRRIDGLTDVSQIITVTVQTGLDQYQQVPVEIVKSDFHKPFLGGFRHKVTGVEYHNAGTQTVPKRIPERLSIFCRDTQKKNLQQTTNTTSTQMTNIGVYVSNMTDKLVTPGKYFSAAEYHAQRLKAVPQDPLKFYKKIYFCHSCQLYLPSTEFSVSSTSRRIYRCRNCINLQNEAQKRESFLKYKCLLQQLYYTEADYEDDSKIAFLMQLQDIQYLTENIWASQSVLSACDNLSDLVMVRWNKSLEWSPWNCILLTKDEAAAHLKLTSIEEGYERSFIHKIKHKHILAKNYFSQVPVLASFILDDGEIDEIRWKYHSDTTPKIIESQRPPH

SEQ ID NO: 920543 - protein, 274 aa, Homo sapiens
MAVVCTCVRVMHVHLHACAVVCVMYVHLHACAVACVMYVHLHACAVACDPILMRSKGSEGDGAQIDECGGNQHEGYVISVKYEFHSTKGNDSQQDLASGSPCLWIKEPFEACLVMSWKTAYDTKISPYPTRLAGFIPVSNETCWVYPRIQRDLLGLSPYPTRLAGFIPVSNETCWVYPRIQRDLLGLSPYPTRLAGFIPVSNETCWVYPRIQRDLLGLSPYPTRLAGFIPVSNETCWVYPRIQRDLLGLSPYPMRLAGFIPVSNETCWVYPRIQ

SEQ ID NO: 920544 - protein, 689 aa, Homo sapiens
GFGVDYFVNELLGTPPRRGSRSEAPPHLPDGAAAGWGLPPTSWTGQLAGLGLPPTSRTGRLPGGGAPHFPDWVAGQRRSSLPRRVGGRAETLLSSQTGSRPGRGALHISDGAAGQRRSPHPRRWAAGQRRSSLPRRDDGREEALLTSQTGRPGRGAPHIPEDGRPGRDAPHFLDGVAAGQRLQSRHFGRPRQAAGRRPAGSPPAAQASLSDVALECCCGIGVHGPLTFRDVAIEFSLEEWQCLDTAQRNLYRKVMFENYRNLVFLVILRGYGKCGHENLQLRISCKSVDESKVFKEGYNELNQCLRTTQSKIFQCDKYVKVFHKFSNSNSHKKRNTGKKVFKCKECGKSFCMLSHLTQHIRIHTRENSYKCEECGKVLNWFSELIKHKGIHMGEKPYKCEECGKAFNQSSTLIKHKKIHIEEKPFKCEECGKAFSLFSILSKHKIIHTGDKPYKCDECHKAFNWFATLTNHKRIHTGEKPFKCEECGKDFNQFSNLTKHKKIHTGEKPYKCEECGKAFNQFANLTRHKKIHTGEKSYKCEECGKAFIQSSNLTEHMRIHTGEKPYKCEECGKAFNGCSSLTRHKRIHTRENTYKCEECGKGFTLFSTLTNHKVIHTGEKSYKCDECGNVFNWPATLANHKRIHAREKPYKCEECGKAFNRSSHLTRHKKIHTGEKLYKPEKCDNNFDNT

SEQ ID NO: 920545 - protein, 135 aa, Homo sapiens
MMTKCTGIFRDGDPRTEKEHTEEYTMHNLIYINYQKIKTSYAVRNRDSGDPWYSKGRTTIVVAHRLSTIRSADLIVTLKDGMLAEKGAHAELMAKRGLYYSLVMSQDPYLRVSWIHPTGFHITFSLGHINMSHGN

SEQ ID NO: 920546 - protein, 160 aa, Homo sapiens
DDGFQLHLCPCKGHEFILFMAAQYSMVYMCRTSFIQSIIDGHLALGETLVGAFAWNTYMRPPHVVWASPQHGDWFLKMSMESQVEAILSFMTLSPSCVVSLALNFVHQDSHKRPSNFKVRKKFTLSLAGDWQNSERLLGTRYIAVANFGKKNTSCCNVVL

SEQ ID NO: 920547 - protein, 1857 aa, Homo sapiens
MDIYDELSPEQHNLSLYSMELVLKKSTGHSAAQVALTETAPGSQHSSPLHVTAPPSATTFDTAFFNQGKQTKSTADPSIFVATYVSVTSKEVAVNDDEMDNFLPDTHWTTPRMVSPIQYITVSPPGLPREALEPMLTPSLPMVSLQDEEVTSGWQNTTRQPAAYAESASHFHTFRSAFRTSEGSSRSLMPQPLGDGITIPLPSLGEVSQPPEEVWATSADRYTDVTTVLSQSLEETISPRTYPTVTASHAALAFSRTHSPLLSTPLAFASSASPTDVSSNPFLPSDSSKTSELHSNSALPGPVDNTHILSPVSSFRPYTWCAACTVPSPQQVLATSLMEKDVGSGDGAETLCMTVLEESSISLMSSVVADFSEFEEDPQVFNTLFPSRPIVPLSSRSMEISETSVGISAEVDMSSVTTTQVPPAHGRLSVPASLDPTAGSLSVAETQVTPSSVTTAFFSVITSILLDSSFSVIANKNTPSLAVRDPSVFTPYSLVPSVESSLFSDQERSSFSEHKPRGALDFASSFFSTPPLELSGSISSPSEAPASLSLMPSDLSPFTSQSFSPLVETFTLFDSSDLQSSQLSLPSSTNLEFSQLQPSSELPLNTIMLLPSRSEVSPWSSFPSDSLEFVEASTVSLTDSEAHFTSAFIETTSYLESSLISHESAVTALVPPGSESFDILTAGIQATSPLTTVHTTPILTESSLFSTLTPPDDQISALDGHVSVLASFSKAIPTGTVLITDAYLPSGSLFVSEATPFPLPTELTVVGPSLTPTEVPLNTSTEVSTTSTGAATGGPLDSTLMGDAASQSPPESSAAPPLPSLRPVTAFTLEATVDTPTLATAKPPYVCDITVPDAYLITTVLARRAVQEYIITAIKEVLRIHFNRAVELKVYELFTDFTFLVTSGPFVYTAISVINVLINSKLVRDQTPLILSVKPSFLVPESRFQVQTVLQFVPPSVDTGFCNFTQRIEKGLMTALFEVRKHHQGTYNLTVQILNITISSSRVTPRRGPVNIIFAVKSTQGFLNGSEVSELLRNLSVVEFSFYLGYPVLQIAEPFQYPQLNLSQLLKSSWVRTVLLGVMEKQLQNEVFQAEMERKLAQLLSEVSTRRRMWRRATVAAGNSVVQVVNVSRLEGDDNPVQLIYFVEDQDGERLSAVKSSDLINKMDLQRAAIILGYRIQGVIAQPVDRVKRPSPESQSNNLWVIVGVVIPVLVVMVIVVILYWKLCRTDKLDFQPDTVANIQQRQKLQIPSVKGFDFAKQHLGQHNKDDILIIHEPAPLPGPLKDHTTPSENGDVPSPKSKIPSKNVRHRGRVSPSDADSTVSEESSERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHSLLDDAFALVAPSSQPASTAGVGPGVPPGLPANSTPSQEERRATQWGSFYSPAQTANNPCSRYEDYGMTPPTGPLPRPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREAVPRTSGREPSAPSGNLPHRGLQGPGLGYPTSSTEDLQPGHSSASLIKAIREELLRLSQKQSTVQNSTADRPRLADLPSIRFLWKQDQKEIN

SEQ ID NO: 920548 - protein, 1666 aa, Homo sapiens
VSGDRDENSFSLSISSSARRTTRSEPIRRAGKSGTSTPTTPGSTAISPRTYPTVTASHAALAFSRTHSPLLSTPLAFASSASPTDVSSNPFLPSDSSKTSELHSNSALPGPVDNTHILSPVSSFRPYTWCAACTVPSPQQVLATSLMEKDVGSGDGAETLCMTVLEESSISLMSSVVADFSEFEEDPQVFNTLFPSRPIVPLSSRSMEISETSVGISAEVDMSSVTTTQVPPAHGRLSVPASLDPTAGSLSVAETQVTPSSVTTAFFSVITSILLDSSFSVIANKNTPSLAVRDPSVFTPYSLVPSVESSLFSDQERSSFSEHKPRGALDFASSFFSTPPLELSGSISSPSEAPASLSLMPSDLSPFTSQSFSPLVETFTLFDSSDLQSSQLSLPSSTNLEFSQLQPSSELPLNTIMLLPSRSEVSPWSSFPSDSLEFVEASTVSLTDSEAHFTSAFIETTSYLESSLISHESAVTALVPPGSESFDILTAGIQATSPLTTVHTTPILTESSLFSTLTPPDDQISALDGHVSVLASFSKAIPTGTVLITDAYLPSGSLFVSEATPFPLPTELTVVGPSLTPTEVPLNTSTEVSTTSTGAATGGPLDSTLMGDAASQSPPESSAAPPLPSLRPVTAFTLEATVDTPTLATAKPPYVCDITVPDAYLITTVLARRAVQEYIITAIKEVLRIHFNRAVELKVYELFTDFTFLVTSGPFVYTAISVINVLINSKLVRDQTPLILSVKPSFLVPESRFQVQTVLQFVPPSVDTGFCNFTQRIEKGLMTALFEVRKHHQGTYNLTVQILNITISSSRVTPRRGPVNIIFAVKSTQGFLNGSEVSELLRNLSVVEFSFYLGYPVLQIAEPFQYPQLNLSQLLKSSWVRTVLLGVMEKQLQNEVFQAEMERKLAQLLSEVSTRRRMWRRATVAAGNSVVQVVNVSRLEGDDNPVQLIYFVEDQDGERLSAVKSSDLINKMDLQRAAIILGYRIQGVIAQPVDRVKRPSPESQSNNLWVIVGVVIPVLVVMVIVVILYWKLCRTDKLDFQPDTVANIQQRQKLQIPSVKGFDFAKQHLGQHNKDDILIIHEPAPLPGPLKDHTTPSENGDVPSPKSKIPSKNVRHRGRVSPSDADSTVSEESSERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHSLLDDAFALVAPSSQPASTAGVGPGVPPGLPANSTPSQEERRATQWGSFYSPAQTANNPCSRYEDYGMTPPTGPLPRPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREAVPRTSGREPSAPSGNLPHRGLQGPGLGYPTSSTEDLQPGHSSASLIKAIREELLRLSQKQSTVQNSTADRPRLADLPSIRFLWKQDQKEIN

SEQ ID NO: 920549 - protein, 172 aa, Homo sapiens
YTIWGPPQSIHFNSHNPRGMTSGFLSPPLGWPCEEARKYCERQGLGEPLWPTGGDQPSSHSQKRKCGRVLCCCSNQRQPSSKPQMTEPSPFNEGEFQVACVPQGLGLAQSGKVSIQKSSMTQRKPGENSQWLVITDSQWKLDLEAPLTNNVAIVESPHGHGIMLGSQQGLTF

SEQ ID NO: 920550 - protein, 525 aa, Homo sapiens
MATLLRSKLSNVATSVSNKSQAKMSGMFARMGFQAATDEEAVGFAHCDDLDFEHRQGLQMDILKAEGEPCGDEGAEAPVEGDIHYQRGSGAPLPPSGSKDQVGGGGEFGGHDKPKITAWEAGWNVTNAIQGMFVLGLPYAILHGGYLGLFLIIFAAVVCCYTGKILIACLYEENEDGEVVRVRDSYVAIANACCAPRFPTLGGRVVNVAQIIELVMTCILYVVVSGNLMYNSFPGLPVSQKSWSIIATAVLLPCAFLKNLKAVSKFSLLCTLAHFVINILVIAYCLSRARDWAWEKVKFYIDVKKFPISIGIIVFSYTSQIFLPSLEGNMQQPSEFHCMMNWTHIAACVLKGLFALVAYLTWADETKEVITDNLPGSIRAVVNIFLVAKALLSYPLPFFAAVEVLEKSLFQEGSRAFFPACYSGDGRLKSWGLTLRCALVVFTLLMAIYVPHFALLMGLTGSLTGAGLCFLLPSLFHLRLLWRKLLWHQVFFDVAIFVIGGICSVSGFVHSLEGLIEAYRTNAED

SEQ ID NO: 920551 - protein, 180 aa, Homo sapiens
CVLIAQLPLIMSEHVVLHPTSQWLSVDHLISYFIHKIGSVSKTSYIILLIHITKLPASSAQVSEGKFFLPSSPLGTYSLLLPLQLASSIFFLFSFTFNLTFFIEPSSSIYRPAHVPLNLTFYALYISKEARNADFLRYLSILNCWQLFLKNIVNTGEGNKMKIWANLVQRLWMSAHGFHG

SEQ ID NO: 920552 - protein, 180 aa, Homo sapiens; identical to SEQ ID NO: 920551

SEQ ID NO: 920553 - protein, 169 aa, Homo sapiens [sequence omitted]

SEQ ID NO: 920554 - protein, 96 aa, Homo sapiens
NCCNPLLISTATAVALLVSSKPKSAVPLVHVKETVSKPYVTESPAEDSNWVNKVFKKNKQKTSGTRKGFPRHSGSKKPSSKVQQVVVCCVPLQNRC

SEQ ID NO: 920555 - protein, 379 aa, Homo sapiens
MGETSVIQHLGIQMSSCRITYEYLRVLNVGVAEVKKSFLGPLSPSCKMVQMMRQFLYRVLPEDSYKALYCSCFVPVYCGLIPPTYRGVRYIDGGFTGMQPCAFWTDAITISTFSGQQDICPRDCPAIFHDFRMFNCSFQFSLENIARMTHALFPPDLVILHDYYYRGYEDAVLYLRRLSKYRWGPSCAQATQLHTWFITAHPTTWTVTSVTSAAGTTVWITSQIPTLSGTHFTQAIPGAFNCGGTSNTAPKFSFSLPCSATCGGTRPRTAPRVRVSRSTDAAGLRLSQVPRHDSGSVALLVSSKPKSAVPLVHVKETVSKPYVTESPAEDSNWVNKVFKKNKQKTSGTRKGFPRHSGSKKPSSKVQQVVVCCVPLQNRC

SEQ ID NO: 920556 - protein, 241 aa, Homo sapiens
MGELALSWAGSQVSSAVKSQVWCISQHCCVRCVGFIPDPTQDKVASLSSLVLTLEPHGGADILLEDIRKEIKELAVRGGRGSSKFKGPGVGCASMCKEQYRDRVAGTRCARERGEGNKRCLLGWRAFAKVLEKTQDGEEEPERPGKELVGRRGVVHSRDGVAGGWCCKEASRAGKERSRRSGQGPDLTGQGSPGKKFASYPVSHEQPGKVRQVSTGLALRAPWANATVLFVYSKLCISKRH

SEQ ID NO: 920557 - protein, 117 aa, Homo sapiens
MIFGNPWWEALLTAGKWTFLVTATTMILLPELLMEVVQSNRCSKKPFTYTVSFNPQSQGSPTPGATDRSMNPTVNCACEGSRLRAPYENLTPDDLSLSPITPRWDRLVAGKQAQGSH

SEQ ID NO: 920558 - protein, 117 aa, Homo sapiens; identical to SEQ ID NO: 920557

SEQ ID NO: 920559 - protein, 383 aa, Homo sapiens
MVKYHELQRSWVFAGETMKKRCSDVGLQSEDYTTPPHGPGELCFLDSLSKSAGCEMSSKPLWTALSEKKRYSHGNIPNFEYYETTGTKYVVQGVTHFKEWHCLSQKVKRGNWKIVSGPSDTAPPCVEKGKELHAYYSASYIQSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVYTSQVFWQLLINFITAPSIGDFHLGWKPGYSVENSLDY

SEQ ID NO: 920560 - protein, 338 aa, Homo sapiens
MVKYHELQRSWVFAGETMKKRCSDVGLQSEDYTTPPHGPGELCFLDSLSKSAGCEMSSKPLWTALSEKKRYSHGNIPNFEYYETTGTKYVVQGVTHFKEWHCLSQKVKRGNWKIVSGPSDTAPPCVEKGKELHAYYSASYIQSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSESCRGYSRINYH

SEQ ID NO: 920561 - protein, 176 aa, Homo sapiens
MDLDGNHMTSFLLEKFQEVIHSREQGTENPQEVKEVLLPFTDYRLLCPSHSLNPMEEALLGPSEAAGSPPCESFRVPSHWLQVAKLWLQFKSLPWSWMFQKGHSVLQGCLCDPGFDLGKVAPHCRVEAICLLCLHERPSRTLSAFGVEVPCQKLQLSMLAVWPAYLLPFQRFLCPG

SEQ ID NO: 920562 - protein, 582 aa, Homo sapiens
VRMDNHMYILEEAALLTSYSRCNSRYSRDRISPRHSRAPNNKPYLFSTSHNLNSSACPLKPFANTSNLISCSSSIQPVLVGTASPLTFATMLLLLRHSVLHASASLGPRQRRRLARLSPSAPRLPSDQARSAARPRPPRRRPGPRSQPRARVGAERSRPAHYGPRLEAPPPPARGARMLARRKPMLPALTINPTIAEGPSPTSEGASEANLVDLQKKLEELELDEQQKRLEAFLTQKAKVGELKDDDFERTSELDAGNGGVVTKVQHRPSGLIMARKLIHLEIKPAIRNQIIREHQVLHECNSPYIVGFYGAFYCDREISICMEHMDGGSLDQGLKEAKRIPEDILGKVSIAVLRGLAYLREKHQIMHRNVKPSNILVNSRGEIKLCDFGVSGQLIDSMANSFVGTRSYMAPERLQGTHYSVQSVIWSMDLSLVELAIERYPIPPPDAKELEAIFGQPVVDREEGEPHSISSWPGSPGRPNSGYGMDSLPAMAIFELLDYIVKEPPPKLPNGVFTPDFQEFVNKCLIKNPTERADLKMLTNHAFIKRSEACLLSNHQAKHTLMNTSNSASKWTLTTLMLTTN

SEQ ID NO: 920563 - protein, 557 aa, Homo sapiens
VRMDNHMYILEEAALLTSYSRCNSRYSRDRISPRHSRAPNNKPYLFSTSHNLNSSACPLKPFANTSNLISCSSSIQPVLVGTASPLTFATMLLLLRHSVLHASASLGPRQRRRLARLSPSAPRLPSDQARSAARPRPPRRRPGPRSQPRARVGAERSRPAHYGPRLEAPPPPARGARMLARRKPMLPALTINPTIAEGPSPTSEGASEANLVDLQKKLEELELDEQQKRLEAFLTQKAKVGELKDDDFERTSELDAGNGGVVTKVQHRPSGLIMARKLIHLEIKPAIRNQIIREHQVLHECNSPYIVGFYGAFYCDREISICMEHMDGGSLDQGLKEAKRIPEDILGKVSIAVLRGLAYLREKHQIMHRNVKPSNILVNSRGEIKLCDFGVSGQLIDSMANSFVGTRSYMAPERLQGTHYSVQSVIWSMDLSLVELAIERYPIPPPDAKELEAIFGQPVVDREEGEPHSISSWPGSPGRPNSGYGMDSLPAMAIFELLDYIVKEPPPKLPNGVFTPDFQEFVNKCLIKNPTERADLKMLTNHAFIKRSEVKEADFAC

SEQ ID NO: 920564 - protein, 145 aa, Homo sapiens
MAAGGESGRPSLHPTVGARRALRVLHTNGEKCAFRSSPTEWACLREELLPTANPEFPPPATKPTAASPPVKPGSEQTVTPVGSAGWKGHWSRPRLGLGDTHRTLEEATPGPRERAQDPGGGHTWASGTGTSRGRTGKDRRGWAHI

SEQ ID NO: 920565 - protein, 831 aa, Homo sapiens
MENQRSSPLSFPSVPQEETLRQAPAGLPRETLFQSRVLPPKEIPSLSPTIPRQGSLPQTSSAPKQETSGWMPHVLQKGPSLLCSAASEQETSLQGPLASQEGTQYPPPAAAEQEVSLLSHSPHHQEAPVHSPEAPEKDPLTLSPTVPETDMDPLLQSPVSQKDTPFQISSAVQKEQPLPTAEITRLAVWAAVQAVERKLEAQAMRLLTLEGRTGTNEKKIADCEKTAVEFANHLESKWVVLGTLLQEYGLLQRRLENMENLLKNRNFWILRLPPGSNGEVPKVPVTFDDVAVHFSEQEWGNLSEWQKELYKNVMRGNYESLVSMDYAISKPDLMSQMERGERPTMQEQEDSEEGETPTDPSAAHDGIVIKIEVQTNDEGSESLETPEPLMGQVEEHGFQDSELGDPCGEQPDLDMQEPENTLEESTEGSSEFSELKQMLVQQRNCTEGIVIKTEEQDEEEEEEEEDELPQHLQSLGQLSGRYEASMYQTPLPGEMSPEGEESPPPLQLGNPAVKRLAPSVHGERHLSENRGASSQQQRNRRGERPFTCMECGKSFRLKINLIIHQRNHIKEGPYECAECEISFRHKQQLTLHQRIHRVRGGCVSPERGPTFNPKHALKPRPKSPSSGSGGGGPKPYKCPECDSSFSHKSSLTKHQITHTGERPYTCPECKKSFRLHISLVIHQRVHAGKHEVSFICSLCGKSFSRPSHLLRHQRTHTGERPFKCPECEKSFSEKSKLTNHCRVHSRERPHACPECGKSFIRKHHLLEHRRIHTGERPYHCAECGKRFTQKHHLLEHQRAHTGERPYPCTHCAKCFRYKQSLKYHLRTHTGE

SEQ ID NO: 920566 - protein, 911 aa, Homo sapiens
MELSGFRQPPTSLGVFLFKRPERDMPPRMQFVATWQLLCSSPAPVRAARARTDARPRGPGDGLRVPGSAARPGISVQQLDMENQRSSPLSFPSVPQEETLRQAPAGLPRETLFQSRVLPPKEIPSLSPTIPRQGSLPQTSSAPKQETSGWMPHVLQKGPSLLCSAASEQETSLQGPLASQEGTQYPPPAAAEQEVSLLSHSPHHQEAPVHSPEAPEKDPLTLSPTVPETDMDPLLQSPVSQKDTPFQISSAVQKEQPLPTAEITRLAVWAAVQAVERKLEAQAMRLLTLEGRTGTNEKKIADCEKTAVEFANHLESKWVVLGTLLQEYGLLQRRLENMENLLKNRNFWILRLPPGSNGEVPKVPVTFDDVAVHFSEQEWGNLSEWQKELYKNVMRGNYESLVSMDYAISKPDLMSQMERGERPTMQEQEDSEEGETPTDPSAAHDGIVIKIEVQTNDEGSESLETPEPLMGQVEEHGFQDSELGDPCGEQPDLDMQEPENTLEESTEGSSEFSELKQMLVQQRNCTEGIVIKTEEQDEEEEEEEEDELPQHLQSLGQLSGRYEASMYQTPLPGEMSPEGEESPPPLQLGNPAVKRLAPSVHGERHLSENRGASSQQQRNRRGERPFTCMECGKSFRLKINLIIHQRNHIKEGPYECAECEISFRHKQQLTLHQRIHRVRGGCVSPERGPTFNPKHALKPRPKSPSSGSGGGGPKPYKCPECDSSFSHKSSLTKHQITHTGERPYTCPECKKSFRLHISLVIHQRVHAGKHEVSFICSLCGKSFSRPSHLLRHQRTHTGERPFKCPECEKSFSEKSKLTNHCRVHSRERPHACPECGKSFIRKHHLLEHRRIHTGERPYHCAECGKRFTQKHHLLEHQRAHTGERPYPCTHCAKCFRYKQSLKYHLRTHTGE

SEQ ID NO: 920567 - protein, 796 aa, Homo sapiens
MELSGFRQPPTSLGVFLFKRPERDMPPRMQFVATWQLLCSSPAPVRAARARTDARPRGPGDGLRVPGSAARPGISVQQLDMENQRSSPLSFPSVPQEETLRQAPAGLPRETLFQSRVLPPKEIPSLSPTIPRQGSLPQTSSAPKQETSGWMPHVLQKGPSLLCSAASEQETSLQGPLASQEGTQYPPPAAAEQEVSLLSHSPHHQEAPVHSPEAPEKDPLTLSPTVPETDMDPLLQSPVSQKDTPFQISSAVQKEQPLPTAEITRLAVWAAVQAVERKLEAQAMRLLTLEGRTGTNEKKIADCEKTAVEFANHLESKWVVLGTLLQEYGLLQRRLENMENLLKNRNFWILRLPPGSNGEVPKVPVTFDDVAVHFSEQEWGNLSEWQKELYKNVMRGNYESLVSMDYAISKPDLMSQMERGERPTMQEQEDSEEGETPTDPSAAHDGIVIKIEVQTNDEGSESLETPEPLMGQVEEHGFQDSELGDPCGEQPDLDMQEPENTLEESTEGSSEFSELKQMLVQQRNCTEGIVIKTEEQDEEEEEEEEDELPQHLQSLGQLSGRYEASMYQTPLPGEMSPEGEESPPPLQQRNCTEGIVIKTEDKCPECDSSFSHKSSLTKHQITHTGERPYTCPECKKSFRLHISLVIHQRVHAGKHEVSFICSLCGKSFSRPSHLLRHQRTHTGERPFKCPECEKSFSEKSKLTNHCRVHSRERPHACPECGKSFIRKHHLLEHRRIHTGERPYHCAECGKRFTQKHHLLEHQRAHTGERPYPCTHCAKCFRYKQSLKYHLRTHTGE

SEQ ID NO: 920568 - protein, 181 aa, Homo sapiens [sequence omitted]

SEQ ID NO: 920569 - protein, 219 aa, Homo sapiens
MWGQRHQPSKTPSSGSGGGGPKPYKCPECDSSFSHKSSLTKHQITHTGERPYTCPECKKSFRLHISLVIHQRVHAGKHEVSFICSLCGKSFSRPSHLLRHQRTHTGERPFKCPECEKSFSEKSKLTNHCRVHSRERPHACPECGKSFIRKHHLLEHRRIHTGERPYHCAECGKRFTQKHHLLEHQRAHTGERPYPCTHCAKCFRYKQSLKYHLRTHTGE

SEQ ID NO: 920570 - protein, 685 aa, Homo sapiens
MELSGFRQPPTSLGVFLFKRPERDMPPRMQFVATWQLLCSSPAPVRAARARTDARPRGPGDGLRVPGSAARPGISVQQLDMENQRSSPLSFPSVPQEETLRQAPAGLPRETLFQSRVLPPKEIPSLSPTIPRQGSLPQTSSAPKQETSGWMPHVLQKGPSLLCSAASEQETSLQGPLASQEGTQYPPPAAAEQEVSLLSHSPHHQEAPVHSPEAPEKDPLTLSPTVPETDMDPLLQSPVSQKDTPFQISSAVQKEQPLPTAEITRLAVWAAVQAVERKLEAQAMRLLTLEGRTGTNEKKIADCEKTAVEFANHLESKWVVLGTLLQEYGLLQRRLENMENLLKNRNFWILRLPPGSNGEVPKVPVTFDDVAVHFSEQEWGNLSEWQKELYKNVMRGNYESLVSMDYAISKPDLMSQMERGERPTMQEQEDSEEGETPTDPSAAHDGIVIKIEVQTNDEGSESLETPEPLMGQVEEHGSSSGSGGGGPKPYKCPECDSSFSHKSSLTKHQITHTGERPYTCPECKKSFRLHISLVIHQRVHAGKHEVSFICSLCGKSFSRPSHLLRHQRTHTGERPFKCPECEKSFSEKSKLTNHCRVHSRERPHACPECGKSFIRKHHLLEHRRIHTGERPYHCAECGKRFTQKHHLLEHQRAHTGERPYPCTHCAKCFRYKQSLKYHLRTHTGE

SEQ ID NO: 920571 - protein, 429 aa, Homo sapiens
MELSGFRQPPTSLGVFLFKRPERDMPPRMQFVATWQLLCSSPAPVRAARARTDARPRGPGDGLRVPGSAARPGISVQQLDMENQRSSPLSFPSVPQEETLRQAPAGLPRETLFQSRVLPPKEIPSLSPTIPRQGSLPQTSSAPKQETSGWMPHVLQKGPSLLCSAASEQETSLQGPLASQEGTQYPPPAAAEQEVSLLSHSPHHQEAPVHSPEAPEKDPLTLSPTVPETDMDPLLQSPVSQKDTPFQISSAVQKEQPLPTAEITRLAVWAAVQAVERKLEAQAMRLLTLEGRTGTNEKKIADCEKTAVEFANHLESKWVVLGTLLQEYGLLQRRLENMENLLKNRNFWILRLPPGSNGEVPKVPVTFDDVAVHFSEQEWGNLSEWQKELYKNVMRGNYESLVSMGKEKPSLAGGCLDASSKCIHKLREF

SEQ ID NO: 920572 - protein, 183 aa, Homo sapiens
APGFALSRVAGRAASTAAEFRAAHRPPPQVGFPALLPRHRSAMKMHFCIPVSQQRSDALGGRYVLYSVHLDGFLFCRVRYSQLHGWNEQLRRVFGNCLPPFPPKYYLAMTTAMADERRDQLEQYLQNAAPAEGEDPALPSFFRGSENCTEHRNLEDVPDRRRKGSKGQWATNSSHPDQWQRVG

SEQ ID NO: 920573 - protein, 134 aa, Homo sapiens
MGKDGIFGSSSGDPPLISLHFRPGLRGAFPARGRRGDGMEEREEDAPASRGKWVQPEDGTMFPWRMAQAPSRPGWSQSQACPRSLASVLVATPGPPSASHDVYPSLAPVEIMFKRKHPGGHNDNNNTTTCAPWV

SEQ ID NO: 920574 - protein, 137 aa, Homo sapiens
MQAALTAFFVLLFSLLSLLGIAANGFIVLVLGREWLRYGRLLPLDMILISLGASRFCLQLVGTVHNFYYSAQKVEYSGGLGRQFFHLHWHFLNSATFWFCSWLSVLFCVKIANITHSTFLWLKWRFPGWVPWLLLGS

SEQ ID NO: 920575 - protein, 692 aa, Homo sapiens
ANILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALTINMTVNGVGYYSHEVGRPVLRTSKILGSRDFDICVRDMIPADVPEHFRGRVSIWAMVTSVDGSQQVAFDDSTPVQRQLVDIRYSKDTRKQFKPGLAYVGKVELSYPDGSPAEWVTVQIKAELTPKDNIYTSEVVSQGGLVGFEIPSIPTSAQHVWLETKVMALNGKPVGAQYLPSYLSLGSWYSPSQCYLQLQPLSHPLQVGEEAYFSDKYTCPCNFTLYYEVAARGNIVLSGQQPAHITQQRSKRAAPALEKPIRLTHLSETEPPPAPEAEVDVCVTSLRLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFLWPWGITKDSGFAFTVRRGGLRSRCPLLRSSCLEIRVLEIQKWVGNRIGSFSFFFSKWGLALWPRLECSGVPEQGQALRSFNKYFLSEIKDFTHIKKVLPWGLAERNYRLLLTSKETDCYSGTYVTRKKHFHKEFDLMASCGHRTLIVMTQPVFPVILMNSQQNQIVILLFSLYTDIFSCS

SEQ ID NO: 920576 - protein, 101 aa, Homo sapiens
TLVLLDILDKDFTHIKKVLPWGLAERNYRLLLTSKETDCYSGTYVTRKKHFHKEFDLMASCGHRTLIVMTQPVFPVILMNSQQNQIVILLFSLYTDIFSCS

SEQ ID NO: 920577 - protein, 155 aa, Homo sapiens
LSLSPMFWAAKHPKAKHSGPHPWLSSKEVTAAFQEISGKLVPPGRVKSKRPWRIGCILGSLVVLPANASTSADNHPQSKTTGQKLLEATNSPVLEHHNGCPTIQFNYDMLCLELASDPSRLRAQLHKTTPFTCQQQIWGPSYPHFCPADYKFWFP

SEQ ID NO: 920578 - protein, 155 aa, Homo sapiens; identical to SEQ ID NO: 920577

SEQ ID NO: 920579 - protein, 200 aa, Homo sapiens
MWTEEAGATAEAQESGIRNKSSSSSQIPVVGVVTEDDEAQDVFKPMDLNRVIKLLEETDKDGLEEKQLKFVKKLVQCYQNGLPLRDLAQIFKILNLCSGKIKNQPRFIESAYDIIKLCGLPFLKKKVSDEITYAEDTANSIALLGDLMKIPSSELRIQICKCIVDFYHAEPPKKHIPGEVYNGLSVITCVCRKQNILISL

SEQ ID NO: 920580 - protein, 297 aa, Homo sapiens
MTVPAEVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKESLHPVNFQSTHPSPPSCPVMASKTAGVSPLARSLRMLAKWEVGDTRKAPQKPPKASWQTSPERPCAGGAGPGRAGAAAQLLRLALQVIALTVLASVRIYYQYRRVKPVTREIVIRDPYALRPLRRLIDAYAFRIYGHWVKKGQQQNRAALFENTPKAVLLSLAEEDY

SEQ ID NO: 920581 - protein, 490 aa, Homo sapiens
MKWAQQVLQRLQMFWSNFASLRYLFLGNPDHALVYQKYVEMTTLLDQFESRIYNEWKSNVDEICEFNLNQPLVKFSAINGLLCVNFDPKYIGNLDLLVQGYNKLKQTLLEVEYPLIEDELRAIDEQLTAATTWLTWQDDCWGYIERVRAATSELEHRVERTQKNVKVIQQTMRGWARCVLPPRREHRREAAFTLEDKGDLFTKKYKLIQGDGCKIHNLVEENRKLFKANPSLDTWKIYVEFIDDIVVEGFFQAIMHDLDFFLKNTEKQLKPAPLNELQEFIKETDSGLQRELNEGDHDGLVDIMVHLLAVRSRQRATDELFEPLKETITLLESYGQKMPEQVYIQLEEIWSLNKEVRVWDAYTGLEGTVKDMTASLRAITELQSPALRDRHWHQLMKAIGVKFLINEATTLADLLALRLHRVEDDVRRIVDKAVKELGTEKVITEISQTWATMKFSYEVHYRTGIPLLKSDEQLFETLEHNQGTRAQCAG

SEQ ID NO: 920582 - protein, 159 aa, Homo sapiens
MTSLNADTGYNLFTSLRKLDAGEARSHRSQQTNTRTENQTPYVLTHKWELNNENTWTQRGEHHTPGPIDVNGLKALPTQSCSPSSNSYDTFLVSPLHPFQDPPGITRSASATMNCWKFPATLFPASAHTVPLPVKVLPVFLAHPCLSPAQTSPPASSQS

SEQ ID NO: 920583 - protein, 79 aa, Homo sapiens
HRKLHARGSAEAGVLRAWEHVGEHAGTAGANGFERMRPTRHFTVAMTTGRSATAAGTRPLRLPGESGLSGPRLTRLGCA

SEQ ID NO: 920584 - protein, 144 aa, Homo sapiens
WIGRISIVKMAILFKVIYRFSAIPIILPSIFFTELEKTSLKLVWKQNRALISQDKPKQKEQSGRYQATQLQTILQGYCNQNSMRKRESLESCEEISDINWHVLKESLWMLCGENTEKGLKWKLQAQYYRSVDFSYNVSMRKSKS

SEQ ID NO: 920585 - protein, 144 aa, Homo sapiens; identical to SEQ ID NO: 920584

SEQ ID NO: 920586 - protein, 233 aa, Homo sapiens
MPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKVSALVGPLSLVALTEVLKQHLPLEARLVALTEVLKQHLPLEARTGVLMGVKNTFWWAPKPSGCSLYNALLWAQPRLWRKSGLGLNP

SEQ ID NO: 920587 - protein, 300 aa, Homo sapiens
MMLTWMVSVASMVRKLVYEQEIQIEEGVQMCPSVRSGVPNPWAMEQSVACWELSLTAGGIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQLVNSCLSAPPASAHCVRK

SEQ ID NO: 920588 - protein, 241 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPPGSDITIAINNTLTPTTLPPGTIQYLTDTSKYPKGYFVQNTYFDFFNYAGLQRSVLLYTTPTTYIDDITVTTSVEQDS

SEQ ID NO: 920589 - protein, 134 aa, Homo sapiens
MSAPRGINFQHSRSCLNVGPQGSLGVEISKAVDNSGKAFTSCLSTALRPARAYTAARWNYTQCPAYAKVLPPLVMLLPVLTPPSQLDPAEQPGICVRDAPQSHPDTGEAGVFIPRPSVTGAGLLLGHSPQHLQR

SEQ ID NO: 920590 - protein, 134 aa, Homo sapiens; identical to SEQ ID NO: 920589

SEQ ID NO: 920591 - protein, 187 aa, Homo sapiens
MRTSIKPSTGPGYVRLCYYPNTFSSAEQATEHMQTLINTTGVQAMDIWTNALKQPGGDLSHYNIGAAAAPGGGCTRAEIVTSKRHLLLVTLVLGILQGRSQCQLLSDVFPEVEFCCSPPPTPSPIALSTVTGSMGHEEEPGHPGRAGAVKGTLTKPEAMETGDAPRTRNRGLGAGNCISTPRTVPGT

SEQ ID NO: 920592 - protein, 182 aa, Homo sapiens
MVHLGPPMECLTTVDKWDIKVGRQRAVSIDSQTKLVFTSFDSPDLDKLQNAKGIRQNVAARSSGAEGRCDGILQKALPDQYKKLSTSVLTANSWKKDSPYQTPNALNQGKVLHGAITVLSNFLQKLALPEVALGYLNILDKVLAVTTYSCIEQKPNISGITKSGSVFLAYQALQGCTAATLT

SEQ ID NO: 920593 - protein, 279 aa, Homo sapiens
MNCTNWSPLSPFPDFWLGSTNEGLLPQGIGAGGPSQPLTFPDQTQADPLAGLAAPGGTHASCPGKNTVLESEAIISSGLTVSWSLTNIDEKGEPSRPRFPSASSPSRWSIGRKLAIQIHQALEDARQKLRDNLRSDIPSLLRFLEWKGLGKGVNAKKCESLRPFRILTIKVEVKQGWMKTQDKEECTSGDWHGDTEQGGNPKKGKHGIKKKRTQDSSKGNSQMRSVSEQCQIKETFTIKMLPAPQCHSTESLQRQHSPEYGTNIEMDKAHHSSRLTINS

SEQ ID NO: 920594 - protein, 557 aa, Homo sapiens
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLIGGQAWDWANQGEDERVLFTFPGNLVTSVAGIYFTDNKGDTSFFKVSKKMPKIPVLVSCEDDLSDDREELLHGISELDISNSDCFPSQLLVHGALAFPLGLDSYHGCVIAAARYGRGRVVVTGHKVLFTVGKLGPFLLNAVRWLDGGRRGKIVVQTELRTLSGLLAVGGIDTSIEPNLTSDASVYCFEPVSEVGVKELQEFVAEGGGLFVGAQAWWWAFKNPGVSPLARFPGNLLLNPFGISITSQSLNPGPFRTPKAGIRTYHFRSTLAEFQVIMGRKRGNVEKGWLAKLGPDGAAFLQIPAEEIPAYMSVHRLLRKLLSRYRLPVATRENPVINDCCRGAMLSLATGLAHSGSDLSLLVPEIEDMYSSPYLRPSESPITVEVNCTNPGKEQGLEAQYYGNGGMGTG

SEQ ID NO: 920595 - protein, 557 aa, Homo sapiens; identical to SEQ ID NO: 920594

SEQ ID NO: 920596 - protein, 193 aa, Homo sapiens
SFEPAALCLLGGEAASSWEQPPPAPSRLLLPRTRAAGNSGANKTNRAMATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEQDKKQKTNQK

SEQ ID NO: 920597 - protein, 151 aa, Homo sapiens
RNVLRKFMNLCWAVFKPWAVFKAVLGHMRPVGHGQKRSLFSLHEGELNCVRQENFVVVDVVLNIGGWWILALGPLKQLNEADTCHVSWLSSNFLNSPLLYLGNVLLCDLPEITQPRVWQSLRFQARLSDARPSQLSYASTAPRTSPWSTCQ

SEQ ID NO: 920598 - protein, 338 aa, Homo sapiens
MRAPSYSPTPPAGEASPSYSEGSFLCPGRCLETWLPDVQAPGACPLLLPLLLDSLTFLLCHKQPGSFPTQGPCVTDHSPPGCCPQPCAWLPLLTFQGSARCHLLGSRETQENYTDVASDHTELTFSLRSQTLREVNKSLNKTIPENKNANMKREQPLQTELQDPRGLFNPQKQGSQEARAFGGGERSQQGEGRGPSERLSRQAIEGTWARDEALQPSEQLRQQSLTSQQGALAAGKLGLTPGHCPLEPLASTCPPTAMVMAPQQEEAQQPPGAPACGAITSRPSVVAGAATLGLLSASRWERRKEENPQQLPVLPLHWARAVSHRLSGQEAGHHPGSV

SEQ ID NO: 920599 - protein, 254 aa, Homo sapiens
FPFMADNGNPQTGLARSSGRGRAIPLGSGFHLVEAGPSLPSVGTQRDLLSLSEGTQPPSYVLRAAVVGSGLSIPRAHPHAQPESKPSRLPSAICTGPRCHRPRTLRNSGRSPSSSHLLGLSVRRCCRQEATGSSCLPEIGAGQAPHQPLALWTWVVNRLKGTETTQKAGRGPTSLRLRWDNPRSGHPRARGPGVPVTSPGDVTSEGGGFARFLHRWGRDLDLEHRVDLGEMTSSPLKSKEVCLFIKIQMSGGDN

SEQ ID NO: 920600 - protein, 562 aa, Homo sapiens
AFSSTNQDCAHCACTMRACESDTRDPETDKHTEDQSPSTPLPQPAAEKNSYLYSTEITLWTVVAAIQALEKKVDSCLTRLLTLEGRTGTAEKKLADCEKTAVEFGNQLEGKWAVLGTLLQEYGLLQRRLENVENLLRNRNFWILRLPPGSKGEAPKVPVTFDDVAVYFSELEWGKLEDWQKELYKHVMRGNYETLVSLDYAISKPDILTRIERGEEPCLDRWGQEKGNEVEVGRPRMMGTGLPPYPEHLTSPLSPAQEELKEGQAPKQQQDSEARVAPAGPEAGGGVAIKTEAQSEDEMTPERLFLGVSRGQTECRIPRGPRNRPGGPSRHQAQGMPRVRAGEPRPPGASGETPRVLSRRRQRAFPCPDCGQSFRLKINLTIHQRTHVEEGRQEAPGRSPTSCGDSQAMLEPGEVVVPGPVIRWLPEEPEGRRSVAGGRALVGRRPAASKMYHCSECLRFFQQRKSLLLHQRLHTGNGQGWPACPYCGKAFRRPSDLFRHQRIHTGERPYQCPQCGRTFNRNHHLAVHMQTHARGQVGPHFPAAPARHGSLPLPWPSRKEEG

SEQ ID NO: 920601 - protein, 268 aa, Homo sapiens
AFSSTNQDCAHCACTMRACESDTRDPETDKHTEDQSPSTPLPQPAAEKNSYLYSTEITLWTVVAAIQALEKKVDSCLTRLLTLEGRTGTAEKKLADCEKTAVEFGNQLEGKWAVLGTLLQEYGLLQRRLENVENLLRNRNFWILRLPPGSKGEAPKVPVTFDDVAVYFSELEWGKLEDWQKELYKHVMRGNYETLVSLDYAISKPDILTRIERGEEPCLDRWGQEKGNEVEVGRPRMMGTDSVMTCLAIITVISCLLNSCAAVSFCGT

SEQ ID NO: 920602 - protein, 346 aa, Homo sapiens
AFSSTNQDCAHCACTMRACESDTRDPETDKHTEDQSPSTPLPQPAAEKNSYLYSTEITLWTVVAAIQALEKKVDSCLTRLLTLEGRTGTAEKKLADCEKTAVEFGNQLEGKWAVLGTLLQEYGLLQRRLENVENLLRNRNFWILRLPPGSKGEAPKVPVTFDDVAVYFSELEWGKLEDWQKELYKHVMRGNYETLVSLDYAISKPDILTRIERGEEPCLDRWGQEKGNEVEVGRPRMMGTGLPPYPEHLTSPLSPAQEELKEGQAPKQQQDSEARVAPAGPEAGLALRTDLQGEAQICSAEISLPAIVAAVQVVEKKMEPQAAWLQSLEGCMWTAKKKLADCEKVA

SEQ ID NO: 920603 - protein, 268 aa, Homo sapiens; identical to SEQ ID NO: 920601

SEQ ID NO: 920604 - protein, 152 aa, Homo sapiens
MYGYLRGKRTALSDVVFLKIIRLSTEHITTGKGEGKTHATEYSVSPTKVEATSTSWPPLDPHGKGSVSEKAVAPLAGMLTLMTVKRPGGQHRGGWQGKGWHGSLFAPPWPGSNCFGKNIAIKRQQKEITQVFRPSSILVWVFSPGNEPDRPK

SEQ ID NO: 920605 - protein, 535 aa, Homo sapiens
MDFGHISVIELLHSLFDLVLGGFNIHSEHKCVVVFYLLHGRLSGQRKLCDSIVRPEPSSHLPPDTGRFGTNSAGHRMVDLLPPLSRSLKPATLSPTPTPLNMALPLTQWRNWAPSEGAATYPPTHQRVCFLRQLPFTISQCLSPFPSALHHSPVPLTISQCPSPFPSAPHHFPVPFTIPQCPSPFPSALHHFPVPFTISQCPSPFPSALHHFPVPFTISQCPSPFPSVPHHFPVPLTIPQCPSPFPSASHHSPVPFTISQCPSPFPSTLHHSPVSLTISQCLSPFPSALHHFPVPFTISQCPSPFPSVPHHFPVPFTIPQCPSPFPSALHHSPVSLTISQCLSPFPSALHHSPVPLTISQCLSPFPSALHHFPVLLTISQCPSPFPSALHHSPVPFTIPQCPSPFPSASHHSSVPDALSSLDMHTYCYLGWPPFCPAQALPVLLDDSGSSWCHLTLFLEPEIGGKRSNDTAQWMPIGCCLSSLQLWQHNNYLGGSEKCWCPDVTPGECNQKRMASVPFRSFSGDSAKRGARDPQL

SEQ ID NO: 920606 - protein, 535 aa, Homo sapiens; identical to SEQ ID NO: 920605

SEQ ID NO: 920607 - protein, 218 aa, Homo sapiens
ELLTSLPLASLPASGRLECLVLQAPSGSDKAGTMSTFGYRRGLSKYESIDEDELLASLSAEELKELERELEDIEPDRNLPVGLRQKSLTEKTPTGTFSREALMAYWEKESPPPPPPPPPLPEKKLITRNIAEVIKQQESAQRALQNGQKKKKGKKVKKQPNSILKEIKNSLRSVQEKKMEDSSRPSTPQRSAHENLMEAIRGSSIKQLKRVEVPEALR

SEQ ID NO: 920608 - protein, 536 aa, Homo sapiens
ELLTSLPLASLPASGRLECLVLQAPSGSDKAGTMSTFGYRRGLSKYESIDEDELLASLSAEELKELERELEDIEPDRNLPVGLRQKSLTEKTPTGTFSREALMAYWEKESQKLLEKERLGECGKVAEDKEESEEELIFTESNSEVSEEVYTEEEEEESQEEEEEEDSDEEERTIETAKGINGTVNYDSVNSDNSKPKIFKSQIENINLTNGSNGRNTESPAAIHPCGNPTVIEDALDKIKSNDPDTTEVNLNNIENITTQTLTRFAEALKDNTVVKTFSLANTHADDSAAMAIAEMLKVNEHITNVNVESNFITGKGILAIMRALQHNTVLTELRFHNQRHIMGSQVEMEIVKLLKENTTLLRLGYHFELPGPRMSMTSILTRNMDKQRQKRLQEQKQQEGYDGGPNLRTKVWQRGTPSSSPYVSPRHSPWSSPKLPKKVQTVRSRPLSPVATPTSSSSPSSTPREKAHYQKHCRSHQTTGECPTGITKWTKKEKREKGQETAKQYSKGNKKFSEVSAREENGRQFPTFYPTEISS

SEQ ID NO: 920609 - protein, 351 aa, Homo sapiens
ELLTSLPLASLPASGRLECLVLQAPSGSDKAGTMSTFGYRRGLSKYESIDEDELLASLSAEELKELERELEDIEPDRNLPVGLRQKSLTEKTPTGTFSREALMAYWEKESQKLLEKERLGECGKVAEDKEESEEELIFTESNSEVSEEVYTEEEEEESQEEEEEEDSDEEERTIETAKGINGTVNYDSVNSDNSKPKIFKSQIENINLTNGSNGRNTESPAAIHPCGNPTVIEDALDKIKSNDPPPPPPPPPLPEKKLITRNIAEVIKQQESAQRALQNGQKKKKGKKVKKQPNSILKEIKNSLRSVQEKKMEDSSRPSTPQRSAHENLMEAIRGSSIKQLKRVEVPEALR

SEQ ID NO: 920610 - protein, 577 aa, Homo sapiens
ELLTSLPLASLPASGRLECLVLQAPSGSDKAGTMSTFGYRRGLSKYESIDEDELLASLSAEELKELERELEDIEPDRNLPVGLRQKSLTEKTPTGTFSREALMAYWEKESQKLLEKERLGECGKVAEDKEESEEELIFTESNSEVSEEVYTEEEEEESQEEEEEEDSDEEERTIETAKGINGTVNYDSVNSDNSKPKIFKSQIENINLTNGSNGRNTESPAAIHPCGNPTVIEDALDKIKSNDPDTTEVNLNNIENITTQTLTRFAEALKDNTVVKTFSLANTHADDSAAMAIAEMLKVNEHITNVNVESNFITGKGILAIMRALQHNTVLTELRFHNQRHIMGSQVEMEIVKLLKENTTLLRLGYHFELPGPRMSMTSILTRNMDKQRQKRLQEQKQQEGYDGGPNLRTKVWQRGTPSSSPYVSPRHSPWSSPKLPKKVQTVRSRPLSPVATPPPPPPPPPPPPPSSQRLPPPPPPPPPPLPEKKLITRNIAEVIKQQESAQRALQNGQKKKKGKKVKKQPNSILKEIKNSLRSVQEKKMEDSSRPSTPQRSAHENLMEAIRGSSIKQLKRIPTLV

SEQ ID NO: 920611 - protein, 524 aa, Homo sapiens
ELLTSLPLASLPASGRLECLVLQAPSGSDKAGTMSTFGYRRGLSKYESIDEDELLASLSAEELKELERELEDIEPDRNLPVGLRQKSLTEKTPTGTFSREALMAYGKRSPKNSWRRRGWGNVERLQKTKRKVKKSLSLLKVTEEESQEEEEEEDSDEEERTIETAKGINGTVNYDSVNSDNSKPKIFKSQIENINLTNGSNGRNTESPAAIHPCGNPTVIEDALDKIKSNDPDTTEVNLNNIENITTQTLTRFAEALKDNTVVKTFSLANTHADDSAAMAIAEMLKVNEHITNVNVESNFITGKGILAIMRALQHNTVLTELRFHNQRHIMGSQVEMEIVKLLKENTTLLRLGYHFELPGPRMSMTSILTRNMDKQRQKRLQEQKQQEGYDGGPNLRTKVWQRGTPSSSPYVSPRHSPWSSPKLPKKVQTVRSRPLSPVATPTSSSSPSSTPREKAHYQKHCRSHQTTGECPTGITKWTKKEKREKGQETAKQYSKGNKKFSEVSAREENGRQFPTFYPTEISS

SEQ ID NO: 920612 - protein, 138 aa, Homo sapiens
MHGKRRIKVADGIKVAHQLTLTRIILVYLMLTQRTLEDGGRSKSFLSRRVGPSAPWRGECADSGSRASQALSGASARTLAHAATAQMTACAFQGAWQTLSVKELRHEKVPIRRIPRPLHSLCKGTACVRTKTNQTPTM

SEQ ID NO: 920613 - protein, 1046 aa, Homo sapiens
DLLRLIHSHENSMGRTCLRDSVTSHWVLLTKHGNSSILRLDELDKETKGDKPAENRALEKTEFGEQEEETKRRQQESEDIRIQLVKDARRFDGVDAEFKKRKILCGPKVVTVLITFIFIKTVCFYIAFDLHLRVEKQNLEKIVLISTAPYCTFMQELMFKTAKVENVLEATCRPNLYEKLKDLQSRLSLCEKALAEYLETKRIAFPRFYFVSSADLLDILSKGAQPKQVTCHLAKLFDSIADLQFEDNQDVSAHRAVGMYSKEKEYVPFQAECECVGHQVLNTYYASDARSGFGEFRNGPCLRGALRPIEKMDMHIIMEVVSPQAFTWLSQLRHRWEDTQKHCFVNICDAQFQYFYEYLGNSPRLVITPLTDSGAPAGPAGTGKTETTKDLGRALGMMVYVFNCSEQMDYKSIGNIYKGLVQTGAWGCFDEFNRISVEVLSVVAVQVKMIHDAIRNRKKRFVFLGEAITLKPSVGIFITMNPGYAGRTELPENLKALFRQEFLKIYAMRVIVLHCPCKIFVWLWHQSSADIMKPCAMVAPDIELICEILLVAEGFVDARALARKFITLYTLCKELLSKQDHYDWGLRAIKSVLVVAGSLKRGDKNRPEDQVLMRALRDFNMPKIVTDDIPVFLGLVGDLFPALDVPRRRKLHFEQMVRQSTLELRLQPEESFILKVVQLEELLAVRHSVFVVGNAGTGKSKILRTLNRTYVNMKQKPVWNDLNPKAVTTDELFGFIHHATREWKDGKYVTFYKSPQLFMKEGFCYLCLAYGKLSLFSSILREQANLKHDGPKWIVLDGDIDPMWIESLNTVLTLASNERIALTPFMRLLFEIHHLRSATPATVSRAGILYVNPQDLGWNPYVASWIDRRRHQSEKANLTILFDKYVPACLDKLRTSFKTITSIPESSLVQESLGQVILWMHRGITGPGHHVDMAVTGPDHPRDIGVSGPDYPMDIGVTGPDHPVDMGITGTGHPVDMGITGPGHPISDYQADFSRWWQKEMKAVKFPSQGTIFDYYVDHKTKKLLPWADKIAQFTMDPDVPLQYQL

SEQ ID NO: 920614 - protein, 556 aa, Homo sapiens
MAEAVAAPISPWTMAATIQAMERKIESQAARLLSLEGRTGMAEKKLADCEKTAVEFGNQLEGKWAVLGTLLQEYGLLQRRLENVENLLRNRNFWILRLPPGSKGESPKVPVTFDDVAVYFSEQEWGKLEDWQKELYKHVMRGNYETLVSLDYAISKPEVLSQIEQGKEPCNWRRPGPKIPDVPVDPSPGSGPPVPAPDLLMQIKQEGELQLQEQQALGVEAWAAGQPDIGEEPWGLSQLDSGAGDISTDATSACSDGTLKLNTAASTEDVKIVIKTEVQEEEVVATPVHPTDLEAHGTLFGPGQATRFFPSPAQEGAWESQGSSFPSQDPVLGLREPARPERDMGELSPAVAQEETPPGDWLFGGVRWGWNFRCKPPVGLNPRTGPEGLPYSSPDNGEAILDPSQAPRPFNEPCKYPGRTKGFGHKPGLKKHPAAPPGGRPFTCATAAVGRPTGRARAQAVAAAAVAAAVAAAVGAAHGMAAPFGVGSAAVASRAPRTSSAIACCTPASGPSPAPSVRSASPNAPSSSTTTERTRACGPSPAPSKFNDVCKVPFAI

SEQ ID NO: 920615 - protein, 167 aa, Homo sapiens
EQQLKRSTKMCIFSNVLFRRVHRSDKKKKGHCRGQSQEVWRVVDKELLQEAEQGLSQQEQPSTSDRWVNEHSSSSGTALSMGNRIRPCRKERVGLKDKHDLDGCRVGNRNKDMDVLSIFHARWVLRNADQIYENHRIMQCPGASSNRALLPLCYGLNCVPPKDMLKL

SEQ ID NO: 920616 - protein, 152 aa, Homo sapiens
MLCRGKRFSMSASVASPKAPPPSRGAHRNSRRGCWVFQERPDAGRWPPVATGLGRMEAPAERALPRLQALARPPPPISYEEELYDCLDYYYLRDFPACGAGRSKGRTRREQALRTNWPAPGGHERKVAQKLLNGQRKRRQRQLHPKMRTRLT

SEQ ID NO: 920617 - protein, 256 aa, Homo sapiens
WVTLSISTRHHLQVMCCHHAGPRPCVTPIRAVVISHCRALLMPPSSAINCKFPEDRNTFYKAIAAIDSDSSDGCVQSKLNTFWKRFTILHAIKNIQKDYNLLKAQMGGSLDPGDGGRRIDIKVRAVYGKFHDAYHRNLYQDKMIADAREKERQPPPTCKQECESLSSRSFAIIFAGGVAVFSRTGVASGLHSPNALPFSTEERKGRIPSNTISFMSSLIDSFSPPLRQNESNRISVAPSPYPDPMLIVATNVATPV

SEQ ID NO: 920618 - protein, 1327 aa, Homo sapiens
MTSLIPQVSELVLNVTISTLTFLQQHGVAVTEPVYHLSMQNIVWDPQKVQYDLKSQFGFDDLHTEQILNSSAELKEIPTDTSLEKMVCSVLSSTSEDEAEKWGHVGGCHPKWSEAKNYLVHAVSWLRVYQQVLSPLSMFCSKKTLTGMGHSLEALRNQFEEESKPWKVVEALHTALLLLNDSLSADGPKDNHTFPKMFFLVPAHVPAVRVAEVWELFTQALADSVDFGKARTHRGASAPSSKDSPFNVARCCECEVLQHLWKLQSLLQNLPQWPALKRFLQLDGALRNAIAQNLHFVQEVLICLETSANDFKWFELNQLKLEKDVFFWELKQMLAKNAVCPNGRFSEKEVFLPPGNSSIWGGLQGLLCYCNSSETSVLNKLLGSVEDADRILQEVITWHKNMSVLIPEEYLDWQELEMQLSEASLSCTRLFLLLGADPSPENDVFSSDCKHQLVSTVIFHTLEKTQFFLEQAYYWKAFKKFIRKTCEVAQYVNMQESFQNRLLVDQLEQVSVNLMDFFKNISSVGTGNLVVNLLVGLMEKFADSSHSWNVNHLLQLSRLFPKDVVDAVIDVYYVLPHAVRLLQGVPGKNITEGLKDVYSFTLLHGITISNITKEDFAIVIKILLDTIELVSDKPDIISEALACFPVVWCWNHTNSGFRQNSKIDPCNVHGLMSSSFYGKVASILDHFHLSPQGEDSPCSNESSRMEITRKVVCIIHELVDWNSILLELSEVFHVNISLVKTVQKFWHKILPFVPPSINQTRDSISELCPSGSIKQVALQIIEKLKNVNFTKVTSGENILDKLSSLNKILNINEDTETSVQNIISSNLERTVQLISEDWSLEKSTHNLLSLFMMLQNANVTGSSLEALSSFIEKSETPYNFEELWPKFQQIMKDLTQDFRIRHLLSEMNKGIKSINSMALQKITLQFAHFLEILDSPSLKTLEIIEDFLLVTKNWLQEYANEDYSRMIETLFIPVTNESSTEDIALLAKAIATFWGSLKNISRAGNFDVAFLTHLLNQEQLTNFSVVQLLFENILINLINNLAGNSQEAAWNLNDTDLQIMNFINLILNHMQSETSRKTVLSLRSIVDFTEQFLKTFFSLFLKEDSENKISLLLKYFHKDVIAEMSVVEICEVFQQTVKPSEAMEMLQKVKMMVVRVLTIVAENPSWTKDILCATLSCKQNGIRHLILSAIQGVTLAQDHFQEIEKIWSSPNQLNCESLSKNLSSTLESFKSSLENATGQDCTSQPRLETVQQHLYMLAKSLEETWSSGNPIMTFLSNFTVTEDVKIKDLMKNITKLTEELRSSIQISNETIHSILEANISHSKYESL

SEQ ID NO: 920619 - protein, 132 aa, Homo sapiens
MPIPPSPQPSLCGRVGTDAIPQPQPSQHQPTGPPVGLCSSKEERAIWDNGSQSPLKFQRVGKNTSIRPILMSLSLFISSPEHFLDLNNARLNMDGISDSEQRGGDVGLLINYSPWARVGCKRKQKKDRRQDK

SEQ ID NO: 920620 - protein, 134 aa, Homo sapiens
MFRPFPQPWVDLSLAPPTASWGHKRKCCGFPGGTLCSLSLSEGPSLCTFSDFKIRTLLFINLADAIASSGSQASVLGSSCLLPLLLRSQHQQLTQGRPRLRLQTALPSSERIENYSSWFIRLDDPQQSISIQNG

SEQ ID NO: 920621 - protein, 450 aa, Homo sapiens
SISVLSFKCLLIPPLDLPWRLVVMQEQSAGILSCCLSLPATVSARFQEQQKMNTLQVCRLVNDVYRVYNRHQYPFVVLNISVDSENKPHSPKTPEPRRSPLGQKRGMSSSSTSDAISDKGVLRPQKEAVSSSQGPSDPTDRAEVEKDSGHGSTSVDSEGFSIPDTGSHCSSECVASTPGDRGSQEHVDSQEKAPETDDSFSDVDCHSNQEDTGSKRIKQLHHEAQQSEGEQNYRKFRARICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKSWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 920622 - protein, 744 aa, Homo sapiens
MSHVPRMCCAFAGTYSSVGSLFGVMVPTEAVRGKMSYDTCCPQGLFLFPLDAGQLERPQAFCPGSSKRKGQVGGASRAHRRPLWHTCAQEGMLGHVSSGLYPWALGDMASPGGPHSASSGAFSWARLLREGSAQPWLCLCRILYACCVVSSHAVARNHSFIPDPVSCLFHELVCRQHGAGRCRGSLMHETQIPLRREKTNTDTVHGGKGHFHVCSQRALSESDPKDGQYSKKKHNAYDVQTAEGVLSTIVKGVSRWPQAAQMKRPVWAAERSLEVGSKGHEPVWAAGGGPGKEGSRGSTCGGLLPDPRELEASLPPGPPSQAEPAARGTEQCPPCAQCGQSFGQKELSAPHQRVHRGPRPFAGAQCPKSFTQRTTPASHRRAHVAECTYTRAQCGKTFLQQIDAHTHYCAHIREKPYECAKLFGRLSTLLEHRHMHTGERPFQCTQCGCCFSRLSTLLEHRHTHISEKPFQCAQCDKRFTRLANLTVHQRVHLGERSFQCAQYSRRFMQKPGFLRHLCGHSQEKHYPCSPCGESFTCPSWLVRHQDSHASQASPSCLVCERDSSTDEPPTGLRGAVWGSTPSNPSAALRFEGTGTELGLRRCPGDRQRGSGDQEGLGWGSLAQFSFSREDGEMWVAPRELPKGALRAQGQLVPLKSEQPLLGATSWPGQSILAMVLASRGRAVLPGTEIAHGPSRCREAAGIEASPKHLSLTEGKAWAWRWGAQEWLALPCSIRRVIFRDKGPS

SEQ ID NO: 920623 - protein, 989 aa, Homo sapiens
SAAVCWSQSLAPGCEVVEKKMEPQAAWLQSLEGCMWTAKKKLADCEKVAVEFGNQLEAKWAVLGTLLQEYGLLQRWLGNVENLLCNRNFWILQLPPGSKGEAPKKRVPVCCGRQGEEAVRPQARKEKHVEGRAAGSLSLTAMDGQTHSWASVSSSVWTEVTCLCGQWMGTLPLGLMALTSSPRKLRGLATLLSMPLNTRLEEAAPSLAEHPPFPGLQRTALPLPFSSPQARPPPSQIWHQWRKETGRQLQPAQCGEGPEPGHWALVNGGASLVCGSQVGLVSSEWLCQKGLVYDRNAGQLERPQAFCPGSSKRKGQVGGASRAHRRPLWHTCAQEGMLGHVSSGLYPWALGDMASPGGPHSASSGAFSWARLLREGSAQPWLCLCRILYACCVVSSHAVARNHSFIPDPVSCLFHELVCRQHGAGRCRGSLMHETQIPLRREKTNTDTVHGGKGHFHVCSQRALSESDPKDGQYSKKKHNAYDVQTAEGVLSTIVKGVSRWPQAAQMKRPVWAAERSLEVGSKGHEPVWAAGGGPGKEGSRGSTCGGLLPDPRELEASLPPGPPSQAEPAARGTEQCPPCAQCGQSFGQKELSAPHQRVHRGPRPFAGAQCPKSFTQRTTPASHRRAHVAECTYTRAQCGKTFLQQIDAHTHYCAHIREKPYECAKLFGRLSTLLEHRHMHTGERPFQCTQCGCCFSRLSTLLEHRHTHISEKPFQCAQCDKRFTRLANLTVHQRVHLGERSFQCAQYSRRFMQKPGFLRHLCGHSQEKHYPCSPCGESFTCPSWLVRHQDSHASQASPSCLVCERDSSTDEPPTGLRGAVWGSTPSNPSAALRFEGTGTELGLRRCPGDRQRGSGDQEGLGWGSLAQFSFSREDGEMWVAPRELPKGALRAQGQLVPLKSEQPLLGATSWPGQSILAMVLASRGRAVLPGTEIAHGPSRCREAAGIEASPKHLSLTEGKAWAWRWGAQEWLALPCSIRRVIFRDKGPS

SEQ ID NO: 920624 - protein, 127 aa, Homo sapiens
MVTLQINFASREAVKGPPSHRTKLAQFLSLGARKPHGQPLDVCSASGNPNGRNGKQTAEDNFYKQDGLWLWIPGSNFSVPKQATGTAANRAAETTHPPIKVKPAPNPSPRRNGDSQKICLSLSPLSS

SEQ ID NO: 920625 - protein, 127 aa, Homo sapiens; identical to SEQ ID NO: 920624

SEQ ID NO: 920626 - protein, 347 aa, Homo sapiens
CLSLARTLSLFLIFVSFCFSSQTVLVHTTETARLRYFMELLLEKGKPLMLVGNAGVGKTVFVGDTLASLSEDYIVSRVPFNYYTTSTALQKILEKPLEKKAGHNYGPGGNKKLIYFIDDMNMPEVDLYGTVQPHTLIRQHIDYGHWYDRQKVMLKEIHNCQYVACMNPMVGSFTINPRLQGIDSHMLLQQPLIYCHFADRGKDPHYMPVKDWEVLKTILTETLDNYNELNAAMHLVLFEDAMQHVCRISRILRTPQGCALLVGVGGSGKQSLSRLAAYLRGLEVFQITLTEGYGIQELRVDLANLYIRTGAKNMPTVFLLTDAQVLDESFLVLINDLLASEGFRKVL

SEQ ID NO: 920627 - protein, 620 aa, Homo sapiens
QQRLYRDVMLENYGNLFSLAGSLHFTAEILLEHDINDSFQKVILRKSGSCDLNTLRLKKDYQRVGNCKGQKSSYNGIHQCLSATRSKTCQYNKCGKAFGLCSIFTEHKKIFSREKCYKCEECGKDCRLSDFTIQKRIHTADRSYKCEECGKACKKFSNLTEHNRVHTGKKPYKCEECGKTFTCSSALTKHKRNHTGDRPYKCEECHKAFRCCSDLTKHKRIHTGEKPYKCKECHKAFRCCSDLTKHKRIHTGEKPYKCNECGKAFMWISALSQHNRIHTGEKPYICEECGKAFTYSSTLISHKRIHMELRPYKCEECGKTFKWFSDLTNHKRIHTGEKPYKCEECGKSFTCSSNLIKHKRIHMEVRPYKCEECGKTFKWFPDLTNHKRIHTGEKPYKCEECGKTFTCSSSLIKHKRSHTGDRPTSAKNVAKPLGGSQTLLNISKHKRIHTGEKPYICEECGKAFIRSSTLTSHKRIHMEERPYKCEECGKTYLAKHKIIHIGEKPYKCNECGKGFMWISALRKHKRIHTGETPYIHEECGKAFTYSSILINHKRIHMEEGPYKCEECGKTFMWLSDFTNHKRIHPGEKPYKCEECGKVLSSFSHVIRHKTIHSREKLHKC

SEQ ID NO: 920628 - protein, 457 aa, Homo sapiens
RYPHRFAGTNVKNVAKHLPVPQPLLNTREIILETDPTNAKNVTKPLGVAQTLLNIREFILERNPTNVKNVTKPLGVAQTLLNIREFILERNPTNVMNVEKLLCGSRPLVNITEFILERNPTFVKNVAKPLPTPQPLLATREFIMELRPYKCEECGKTFKWFSDLTNHKRIHTGEKPYKCEECGKSFTCSSNLIKHKRIHMEVRPYKCEECGKTFKWFPDLTNHKRIHTGEKPYKCEECGKTFTCSSSLIKHKRSHTGDRPTSAKNVAKPLGGSQTLLNISKHKRIHTGEKPYICEECGKAFIRSSTLTSHKRIHMEERPYKCEECGKTYLAKHKIIHIGEKPYKCNECGKGFMWISALRKHKRIHTGETPYIHEECGKAFTYSSILINHKRIHMEEGPYKCEECGKTFMWLSDFTNHKRIHPGEKPYKCEECGKVLSSFSHVIRHKTIHSREKLHKC

SEQ ID NO: 920629 - protein, 156 aa, Homo sapiens
SKQDLALYIMAIKKHKGDFSKCYARSNNALRLSEIDQSLKAALHQMEGTSDETSGKYQNEREMQGSKGSSNSLRHPPVSKEVTESQKGRGEIMDSRLLEEKLDANVLAFILPACCLYHLRGSNHPSCWKHRLSSMSQLFYIPGNVLAFLSLFDVTM

SEQ ID NO: 920630 - protein, 394 aa, Homo sapiens
MFAQSVAPLCPYDNDSMSITGETGIGKSTLIDTLFNTNLKDNKSSHFYSNVGLQIQTYELQESNVQLKLTVVETVGYGDQIDKEASYQPIVDYIDAQFEAYLQEELKIKRSLFEYHDSRVHVCLYFISPTGHSLKSLDLLTMKNLDSKVNIIPLIAKADTISKNDLQTFKNKIMSELISNGIQIYQLPTDEETAAQANSSVSGLLPFAVVGSTDEVKVGKRMVRGRHYPWGVLQVENENHCDFVKLRDMLLCTNMENLKEKTHTQHYECYRYQKLQKMGFTDVGPNNQPVSFQEIFEAKRQEFYDQCQREEEELKQRFMQRVKEKEATFKEAEKELQDKFEHLKMIQQEEIRKLEEEKKQLEGEIIDFYKMKAASEALQTQLSTDTKKDKHRKK

SEQ ID NO: 920631 - protein, 350 aa, Homo sapiens
MIQAKVSGEKERQAYAKGNIYSEDTLSLTRKGTSVKQLGGNVPLNDMVTIEYSVLPFAITFLEIIYLEIFPEVWFSYCDKGKCRTTATFAERTIIHNFTERRKVSFLELQAALPMVEGEVMQALPWLLQQNLSQCHVVTAGDERGLLSAIQYSLSYSLQCLFPCYDVKTSFPSNSRDPQLQVCWNLLEVHSRSCLPGYHQRRLQNSKYCYLILPLEASSQRDTQLYEVSAGPYWQLYRLLQLPLAGKGKSPNPLHFPGNNHDSIREPGSSNAIKSGWTHPGIPVEAPEATGFEKTCPWDTGNIYKVSENNFEESFKSYTERHRLEPADSGLKQTPFVGNKLLGTPDPSPQ

SEQ ID NO: 920632 - protein, 892 aa, Homo sapiens
DLRMSHSVLEPHGLPVILGDLLFWFTSWPFSKVQASPRSPGLEPFSTTFTPKIHLLPLSSQVPAGDISLLIPDEKLESRTRRVLSNTYQKLIQSVFLDDSIPNGVKYLMLLALIEKPTVDPIYIALFGSTGAGKSSLINAIIQQAMFLPVSGESICTSCIVQVSSGCCVQYEAKIHLLSDQLMPLLNEKSPSQEKVHQVSWGGGLAWSLHFYETLGKPFPSSRPQIDDLDFLNMQPPGPPQGAMGPSVCRCSLCLCQEGLGPTLPWQEWREELKNLTKLLHRTEELGREEADAWNRDEAVEEATWKLQMIYGNGAESKNYEELLRAKPKRKIPTSRVITLKAEEAEELSIKLDPYIRTQRRDWDGEAAEMRIWPLIKHVEVTLPKSDLIPEGVVLVDIPGTGDFNSKRDEMWKKTIDKCSVIWVISDIERVSGGRAHEDLLNESIKACQRGFCRDVALVVTKMDKLHLPEYLRERKAGNQAIQSQREAVLERNEMIKLQRTRILKEKLKRKLPADFKVLEASDLVYTVSAQEYWQQALLTEEETEIPKLREYIRKSLLDKKKRTVTKYVTEAFGLLLLTDSFNSTQNLPNEHLHMSVLRRFAEEKVELLEKAIAQCFACMEQPLQEGVRTARTSYRCILRACLVRSKGNQGFHQTLKAVCLKNGIYASRTLARIDLNEALTQPVYDQIDPVFGSIFRTGKPTGSALMPHIDAFKQSLQEKMTEIGIRSGWKYDSCKKNFLIQEISAILGGLEDHILRRKRRIYESLTASVQSDLKLCYEEAAQITGKKACERMKDAIRRGVDRQVAEGMFERAQERMQHQFQQLKTGIVEKVKGSITTMLALASSQGDGLYKELAAVDLGVGNHVPFRPWAPSGPRYKLERVTWYKQQLSNF

SEQ ID NO: 920633 - protein, 159 aa, Homo sapiens
MWELKGGTSNSNSLPVVGKKGFQRECFQFLPIQYDIGRGFVIDSAYYFEVWQCTEDCHMPLAQDQALRTTEIKKFQCHLSQCTMHCNDKARDSLDAGTFHQCNHPKFASCLMLTEEEGHLEFDQQEQNMLKLLQKMMRTSQVWHLMYSKVYGDHLRKLV

SEQ ID NO: 920634 - protein, 143 aa, Homo sapiens
MSLRIFSAIFVANSFIELDINILLQGLNRLSNVTSKILQKGCLEPDLSKHKLDAGSIGSEMPFLISTKRVFGTCFIKMQMLPALKHRIPSSSVLGLGLALLAPQLADSLLLDLVIIIKKLKRKKKKEKWADTCLLCDREHVSH

SEQ ID NO: 920635 - protein, 222 aa, Homo sapiens
MGPVMRSLCDGETEAPADTWDAETPAPLCVLGQFAEPFWASVSHQFQKLILLPTAVRVPGDGKARAAPTGAQELADSEGVGPGLGKGWGRAWARGGDGACSTCSALPGCLLGAPPAALRTLRKALADSGVANMSTAMNFGTKSFQPRPPDKGSFPLDHLGECKSFKEKFMKCLHNNNFENALCRKESKEYLECRMERKLMLQEPLEKLGFGDLTSGKSEAKK

SEQ ID NO: 920636 - protein, 286 aa, Homo sapiens
VSSASTRPQFLITVPVLTVINYRPHNMRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 920637 - protein, 237 aa, Homo sapiens
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVGVVAGGGRIDKPILKAGRAYHKYKAEAGSRSRKRQNAGSSVLHYDEVLLSADQDDIRVSFQQPYGLKEILA

SEQ ID NO: 920638 - protein, 271 aa, Homo sapiens
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPQLRGVAINVSLQEGDLRWEEQQPVEHPFGGGNHQHIGKPSTIRRDAPAGRKVGLIAARRTGRLRGTKTVQEKEN

SEQ ID NO: 920639 - protein, 88 aa, Homo sapiens
GLHPQADSMICSFSTWCLAVSCTPWALTEYSFIVVKPSMASQHSHPSLPTRVYTVLEELSPGTIVANITAEDPDDEGFPSHLLYSITT

SEQ ID NO: 920640 - protein, 214 aa, Homo sapiens
GLHPQADSMICSFSTWCLAVSCTPWALTEYSFIVVKPSMASQHSHPSLPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFRYAHFESWAGHSISLVALCPSASLVYSQENYKHLEKQLSRINRCELFTVVHRFP

SEQ ID NO: 920641 - protein, 476 aa, Homo sapiens
MWQDTTWVLVTLHSWGVATQERFVVTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRKINTGEKPYKCSECGKPSGTVPTCVSISGFTSGRTSPCNVARCPRAESS

SEQ ID NO: 920642 - protein, 135 aa, Homo sapiens
QLFLKTQMRREEEAAPNAADIGTSEDPWHEELAPSGNALTFRVWSCHRTDRCEGNGEALQGLVDSCNIIGFYSMGGDKPQAAYFYYSILSIPINSFILISSLFFHCNTRDYNISPPVILVCPKLESCHFLDNEEP

SEQ ID NO: 920643 - protein, 179 aa, Homo sapiens
QLRFCSFVMRLFSFTPMNMMDNNCFFLKRLSTLWLSLSGTLDSIDCIFFFLYELGFLLLFFYCLEVNLYLSIFRFTFQTRSKTVPQNCLEMKQKVMKVQNDAHPGQRTQHSDPCTGCTEHTRHWVNHEQKEKPAWVCKIYFAGKADTVEQSVAAPGRTLMTHITEPDRSRENIPSNRTA

SEQ ID NO: 920644 - protein, 140 aa, Homo sapiens
MASLRLFIFVVDKKCPYVWFLLTPTNSSVPAGTMVEWKVPDLVPPRTLTDNNIQSKRMYENYRNQFRSHSTPGKLKAKNSCIEPVALPDNLQCHRQAPEGSRDYKQLKRNWQTSLIGTFHVQAQRRFIPRKGLRGPRISS

SEQ ID NO: 920645 - protein, 302 aa, Homo sapiens
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPRVRGVAMNPVEHPFGGGNHQHIGKPSTIRRDAPAGRKWVSLLPAGLDVSGEPDCAGERELVLRASIKFVFMPPGCAHPHGFKGRGPCWEDFCGIPLVGTGRELDY

SEQ ID NO: 920646 - protein, 169 aa, Homo sapiens
SPVQSFLGNHILKMGWCQFGKLLFSACAASLCRDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSILVTAI

SEQ ID NO: 920647 - protein, 188 aa, Homo sapiens
MRLQSGEPCREFCLTVDDPEGHDAPVKDDEDPKVQLENRGKEGKRDDPGGDGEEVPAELDDDGHVADGLLVISRVPEGLLVGGQGPGQGHEGSCRCETYKGKQEDSVSEISCSNAPWNLHRKTLLKAAFQSSEKISQNSCADGWDSLRTAWKARPGSSLGPPELSCLVLYLPLCAPATLPSLRFSNAT

SEQ ID NO: 920648 - protein, 854 aa, Homo sapiens
APRLYTGCMLHAELSAEVELGEAVSDCPTGPIKFAHNYPLPYGCFVLGLFCFKRLQPNIEGTSSSAGTQPDVDECVEGTDNCHIDAICQNTPRSYKCICKSGYTGDGKHCKDVDECEREDNAGCVHDCVNIPGNYRCTCYDGFHLAHDGHNCLDVDECAEGNGGCQQSCVNMMGSYECHCREGFFLSDNQHTCIQRPEEGMNCMNKNHGCAHICRETPKGGIACECRPGFELTKNQRDCKCEIIGMAVTCNYGNGGCQHTCDDTEQGPRCGCHIKFVLHTDGKTCIGAGETCAVNNGGCDSKCHDAATGVHCTCPVGFMLQPDRKTCKDIDECRLNNGGCDHICRNTVGSFECSCKKGYKLLINERNCQDIDECSFDRTCDHICVNTPGSFQCLCHRGYLLYGITHCGDVDECSINRGGCRFGCINTPGSYQCTCPAGQGRLHWNGKDCTEPLKCQGSPGASKAMLSCNRSGKKDTCALTCPSRARFLPESENGFTVSCGTPSPRAAPARAGHNGNSTNSNHCHEAAVLSIKQRASFKIKDAKCRLHLRNKGKTEEAGRITGPGGAPCSECQVTFIHLKCDSSRKGKGRRARTPPGKEVTRLTLELEAEVRAEETTASCGLPCLRQRMERRLKGSLKMLRKSINQDRFLLRLAGLDYELAHKPGLVAGERAEPMESCRPGQHRAGTKCVQCSPGHYYNTSIHRCIRCAMGSYQPDFRQNFCSRCPGNTSTDFDGSTSVAQCKNRQCGGELGEFTGYIESPNYPGNYPAGVECIWNINPPPKRKILIVVPEIFLPSEDECGDVLVMRKNCGWLAELGQGRAVQIWLRRRTKRETDTGRNGAVKLGIYEGEIVRGL

SEQ ID NO: 920649 - protein, 833 aa, Homo sapiens
APRLYTGCMLHAELSAEVELGEAVSDCPTGPIKFAHNYPLPYGCFVLGLFCFKRLQPNIEGTSSSAGTQPDVDECVEGTDNCHIDAICQNTPRSYKCICKSGYTGDGKHCKDVDECEREDNAGCVHDCVNIPGNYRCTCYDGFHLAHDGHNCLDVDECAEGNGGCQQSCVNMMGSYECHCREGFFLSDNQHTCIQRPEEGMNCMNKNHGCAHICRETPKGGIACECRPGFELTKNQRDCKCEIIGMAVTCNYGNGGCQHTCDDTEQGPRCGCHIKFVLHTDGKTCIGAGETCAVNNGGCDSKCHDAATGVHCTCPVGFMLQPDRKTCKDIDECRLNNGGCDHICRNTVGSFECSCKKGYKLLINERNCQDIDECSFDRTCDHICVNTPGSFQCLCHRGYLLYGITHCGDVDECSINRGGCRFGCINTPGSYQCTCPAGQGRLHWNGKDCTEPLKCQGSPGASKAMLSCNRSGKKDTCALTCPSRARFLPESENGFTVSCGTPSPRAAPARAGHNGNSTNSNHCHEAAVLSIKQRASFKIKDAKCRLHLRNKGKTEEAGRITGPGGAPCSECQVTFIHLKCDSSRKGKGRRARTPPGKEVTRLTLELEAEVRAEETTASCGLPCLRQRMERRLKGSLKMLRKSINQDRFLLRLAGLDYELAHKPGLVAGERAEPMESCRPGQHRAGTKCVQCSPGHYYNTSIHRCIRCAMGSYQPDFRQNFCSRCPGNTSTDFDGSTSVAQCKNRQCGGELGEFTGYIESPNYPGNYPAGVECIWNINPPPKRKILIVVPEIFLPSEDECGDVLVMRKNSSPSSITTYETCQTYERPIAFTARS

SEQ ID NO: 920650 - protein, 355 aa, Homo sapiens
SLSLSLCLSLSRLSSFPPSTTWDLSERTAAGEFRKAESPGPSPGPRQLAPAAPPARLRPHSAMEVKRRRPRALPRLPLPSPRCSPFPFSFLGEAEGDMGGWVAALGRGGVDVVFSLSGAAGEARRGERGEGSRGNYTGEAPLRLPLPPTPPSLHPLRFAGKSLDAKGWGRTKSLWKTSLLSHCLCDWGSCGGEDAVVPSSGVPHPHPSPRCQCARTTRRFLFLFPGFLIPSSTHPSSFLSPFLPSFLLSFLRRKASLSVFTADLDLNVHTIKARGECQEWGWLSTVGRRGPAKEGATDRARRPPQTSAQPRARGEGSGAPSGCLSRTGARGVGRCAACDRQGLRDAKRLRERNRS

SEQ ID NO: 920651 - protein, 163 aa, Homo sapiens
MGCNTLGLYCGVCTESAPAREEQPDGSSMKTYASHRQPLAQLGSCGSQNPILMPRNLLRLTRGHQDREELWVHPPFLPPALCPGRLIHMYHSMALVASGFWVWLLGALQAAAGGQGVDITDCAYFCISEDRMTLPGPETCDPLGPVAPPTSKLNTPGPFPTPL

SEQ ID NO: 920652 - protein, 209 aa, Homo sapiens
GWRVMEQEEPTWRSDSVDTEDSGYGGEAEERPEQDGVQVAVVRIKRPLPSQVNRFTEKLNCKAQQKYSPVGNLKGRWQQWADEHIQSQKLNPFSEEFDYELAMSTRLHKGDEGYGRPKEGTKTAERAKRAEEHIYREMMDMCFIICTMARHRRDGKIQVTFGDLFDRYVRISDKVVGILMRARKHGLVDFEGEMLWQGRDDHVVITLLK

SEQ ID NO: 920653 - protein, 141 aa, Homo sapiens
LGEKCGGFSQGWSLEDANPMCERRTPPGLPGGARLVRRRRPPAFAGSRPPLPGAAGPPQPRASPGRAGCTPSTYLAGRASPGTKGALGSKPSPRPRGDAALRKEGRCPQDPRLLGKLDMHIPKENSVGRRQESSSRVGGRG

SEQ ID NO: 920654 - protein, 137 aa, Homo sapiens
YIWRGLFMLNLKFLMKIIHFMQIIRTNIMELKLVLQINWCCCDLSLVKIGNWREKNYVSSKKLYYTCCWIPTRSIVFESLLVTSNLICFQGHSAASLKFSGVLQKCHVLINTSNSQWFFLNYKLHEDPIPSAAIGSF

SEQ ID NO: 920655 - protein, 161 aa, Homo sapiens
MVPAPPCTSGTSVNPSGPGLFLIGPSAAGLLEFAGGPLQTLFSWVSAVEAAEQQILVNSKCCCLIVPLGGVYRGRQASLSYGGLHLIRASWLLCLPTQASAMAGAPPPTSLLRCSSISDCCASNQHGSVGMGPSKPGTGYYLLVCCLLRPSEKHSISVGVT

SEQ ID NO: 920656 - protein, 121 aa, Homo sapiens
GLGSAPEESTTFPRFTSRCNWACLSSLCSKHVKSKMGVPDLPVALLQPRLLSNCGSTIFNMELPRSPCCPASSLQKRIGGQATHISLAQIQSHGHTHCKGSWEMESSSVPKKQRKTDLMKT

SEQ ID NO: 920657 - protein, 69 aa, Homo sapiens
AESSTAEANEATHLFLAPTLRIFIMTIEVNEHFHKINKKSPQICKCFNIMIAVYFSLRSNPRWVFLICL

SEQ ID NO: 920658 - protein, 152 aa, Homo sapiens
MTGHFYSVPEVSAPGQAVGQAPLHAGSVALNSRACHPSEGSERAVCRARTLPGPGPLWHEKGRLGARGLEQAVMTLWVLPSSRFGSEETGVTLMGFRSRSSKYWILDSDLVVPPGSRTLTRVAPGLVVGPQARKDALVECGLHCHCNRLLKT

SEQ ID NO: 920659 - protein, 145 aa, Homo sapiens
MQLNPGLVNVPGVSRLRRELNTCVYPAARRLNEEVQYHTTPLSPTMVSAGDGGKLSLHLHQQTNTGTENQIPYVLTYKWELNDENTWKHRGEQHTLGPTGGWKEASGGAWPCQDLDFGATRLQICERTNFCHFKPPSLPYLLQQP

SEQ ID NO: 920660 - protein, 164 aa, Homo sapiens
EKLRMWKALKFKHGKSRRGNSDKCHWTVCYLLTSFPVVVEPLQGTKKVETSTLWMVNSTLTLIFETLTLTLIFRQNNGNYQAPSATDSSHNPGFEYFLQTKYCIVVLEHGLSIIKKTRCYKGLISDTLNTSGSLVQERITSKINFLFLPQPLDWANFKQVTELP

SEQ ID NO: 920661 - protein, 164 aa, Homo sapiens; identical to SEQ ID NO: 920660

SEQ ID NO: 920662 - protein, 164 aa, Homo sapiens; identical to SEQ ID NO: 920660

SEQ ID NO: 920663 - protein, 164 aa, Homo sapiens; identical to SEQ ID NO: 920660

SEQ ID NO: 920664 - protein, 143 aa, Homo sapiens
MEGHRKGLYCSMPAVLLALLREHLTPVATAKKVLLLNGIGRWVRVDDAAGSALVLAASDKAKPPFAAVLPQEHGSSGDADTFPLELERVPLAAVKKHRGRGLCQQHECSLGDSLLWASGDLSCALRDPLVGPASAWPDCSMFY

SEQ ID NO: 920665 - protein, 174 aa, Homo sapiens
MPSRIQGLESETLGIYVVLYSTAAKLAPKPQDEVLLTLSLSTSRGVSSLLWPPLPQAHSIGRASRKLGRLAKPTVTISTDGDVITIKTKSIFKNNEISFKLGEEFEEITPGGHKTKSKVTLDKESLIQVQDWDGKETTITRKLVDGKMVVESTVNSVICTRTYEKVSSNSVSNS

SEQ ID NO: 920666 - protein, 139 aa, Homo sapiens
MPSRIQGLESETLGIYVVLYSTAAKLAPKPQDEVLLTLSLSTSRGVSSLLWPPLPQAHSIGRASRKLGRLAKPTVTISTDGDVITIKTKSIFKNNEISFKLGEEFEEITPGGHKTKVRPTTVFQTHFKRMLVRYHPRVK

SEQ ID NO: 920667 - protein, 134 aa, Homo sapiens
MAGPGGRRTTSLPKRRGCGCCWRGEAHSPRTGRTRRGRAGRRPAPRQVATAKDAGRAPGAMASPSGSSEATGKPRGRDGRPRREEDDVPPEEKRLRLLLEGGSAQPEDCEDGEDALRPGKEDTGTQTGGDGRGA

SEQ ID NO: 920668 - protein, 133 aa, Homo sapiens
MRAGMCSCWLCVYHGKKVIESLLYARHCTLGTWDVNIRYTSAFEELIVHHGVTKKVTDNYTICLKQCHGTEKNSKGFGAQQETGGCTQLAVRTILHWKEYYRLGNLYRIEVYLTHGSGVWEVQEHGVTCAPIR

SEQ ID NO: 920669 - protein, 143 aa, Homo sapiens
ENFRLMTVEILGLGFGCNHRSSALIHLCQSAGGERRAQRRQTETGHQNEVRKQRGPKVEDEDNLLAGCVHSLSEHSRRGCWVPGPCLIPGDESGQDSKGPASGTHHLNGQPASSPTNNYQLQHATKDKGKEPWWSMRECGRAL

SEQ ID NO: 920670 - protein, 151 aa, Homo sapiens
MGKMYLLVKKHPSLTSETNIIDFTRRKLITCKLSFVSICILKVAATSLHMLESIDVKPTGTLRPVHQDGGLPKSSGDSSARRSIGHSDPTIQGGGTKWSCLLKLLCWIALGSASRPPGPFKIVTVFNLQPALLQQPRLLLHLPGSITHYLG

SEQ ID NO: 920671 - protein, 205 aa, Homo sapiens
MDTFTDPFKCPCPYLRLLEIPIMLTLVCFMVSCLRCGHAHGGARVWGMSLGHEHTYGVVLGSKKAMCRASLVPMFKVWTCSWQQSHQFLWYSTYREQGRDIVVAPSGLESGTGTWTLGSSVNQSQHWQRLQRLNGKNHWDHCALFTPLVEVRTKRIPLGADCARLGNGVAQSGDSGLWTEINERSSYPSFFQRIISPTDKARRRK

SEQ ID NO: 920672 - protein, 447 aa, Homo sapiens
MRSSTLQDPRRRDPQDDVYVDITDRLRFAILYSRPKSASNVHYFSIDNELEYENFSEDFGPLNLAMVYRYCCKINKKLKSITMLRKKIVHFTGSDQRKQANAAFLVGCYMVIYLGRTPEAAYRILIFGDTPYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKRFLDICENAEGAIAVHCKAGLGRTGTLIACYIMKHYRMTAAETIAWVRICRPGLVIGPQQQFLVMKQTSLWLEGDYFRQRLKGQENGQHRAAFSKLLSGVDDISINGVENQDQQEPKPYSDDDEINGVTQGDRSRALKRRRQSKTNDILLPSPLAVLTFTLCSVVIWWIVCDYILPILLF

SEQ ID NO: 920673 - protein, 161 aa, Homo sapiens
MLQSFWWFALNLWYSWLVSAAIPSLPPLSYSLLPACLSFFFPQDTSILDLWHALFQYDLILTNQSPVALFSKILEDCPPKLTSWGTKGWKSRQGIGTSTDDSDGGHDDDDGDGDSYGKDKATSIYLALTVDQVLSLGGGKRKGADSVLIDMHIGTLFQENL

SEQ ID NO: 920674 - protein, 148 aa, Homo sapiens
MNWVAYSLCLFMGISKFPGFTAFNLVKLHEIKCSSSRRHWRLLEALEATGSGNTQKSSEGYSRKGDPLSQFKQQQRPGAGKVLGQGQCGDFTIQVQNGFSSDINNALVQSPVQLSRPHSPKPELCSALSWLHVKVLKGSFFQNKWTVF

SEQ ID NO: 920675 - protein, 139 aa, Homo sapiens
HSHSKLHAMSSKKISNFYKVLALLPVFVKNADQMKTTFYKANNNNSFCELNIYCARHLANIISFNSHTFSSRYGSLYDTDHETEAQKVAAISPTCSRDEAQTSVLSSSPVDDSDVLPGMSTPDDMIFEDRHLFLFIIVS

SEQ ID NO: 920676 - protein, 262 aa, Homo sapiens
MVYPWCFLPTLSPAARFKPCCPSQPVRIGCATSSEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGMFFTVFLLHSDIHLKVY

SEQ ID NO: 920677 - protein, 483 aa, Homo sapiens
MVAHTLEILPILCAAFGARARWPLGTPRAAATRREAAALPPVTLALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRKQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPKLLRLVKERPQTNATVARRLVARALGLQHKKKERPAVRGPLPP

SEQ ID NO: 920678 - protein, 120 aa, Homo sapiens
QSEGLNESLAYLPGALRAHRRYQITVIAPPFPLLLPETRRGHRQMRLWPGGWWPGPWDSNTKRKSGLLSGVRCRPEAWRPNWPGSASRRSWRPQHHKPSQTPEQPRTTLELHHGVWWALV

SEQ ID NO: 920679 - protein, 445 aa, Homo sapiens
MVAHTLEILPILCAAFGARARWPLGTPRAAATRREAAALPPVTLALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRKQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPNGERF

SEQ ID NO: 920680 - protein, 443 aa, Homo sapiens
MVAHTLEILPILCAAFGARARWPLGTPRAAATRREAAALPPVTLALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRKQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVHASLHVPGLHVPLACTGLDVGRGV

SEQ ID NO: 920681 - protein, 114 aa, Homo sapiens
MACTAAVLLGERQPRPCVRSPLWGFPSRTPASGEGEATDKCDCGPAAGGPGPGTPTQKERAACCPGSAAALRPGDPTGLDLRPDVAGAPNTISLHRRQSSPAPPSSFTMGCGGL

SEQ ID NO: 920682 - protein, 162 aa, Homo sapiens
LCYRGSLEDGGCKKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVHASLHVPGLHVPLACTGLDVGRGV

SEQ ID NO: 920683 - protein, 476 aa, Homo sapiens
RPDPRAPGWEGAAGLRGAGPREPREGAQRRALPPVTLALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRKQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPKLLRLVKERPQTNATVARRLVARALGLQHKKKERPAVRGPLPP

SEQ ID NO: 920684 - protein, 274 aa, Homo sapiens
LDPVGPEPLGPEESDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPKLLRLVKERPQTNATVARRLVARALGLQHKKKERPAVRGPLPP

SEQ ID NO: 920685 - protein, 220 aa, Homo sapiens
WSCEKRATILQTPESRQVMNPARTGSILSRQQEWGTAVKILESMEATLEQDNKTRLEQFGGFRRKEDRKMWESLELPRDLWNDFDQNADSDMDNEVQAEVVSDGDKELVRNWMWKGNVGLEPRYRVPTGALTSRVVRRGPPSFRPQKCRSTDSLHHEPGKAAGTQCQPVKDLPKAVGAHSLHQPALDVAKLGKTEPGTSDHLPSHSKKPVCRMKLNRDKP

SEQ ID NO: 920686 - protein, 556 aa, Homo sapiens
MASKPAAGKSRGEKRKRVVLTLKEKIDICTRLEKGESRKALMQEYNVGMSTLYDIRAHKAQLLRFFASSDSNKALEQRRTLHTPKLEHLDRVLYEWFLGKRSEGVPVSGPMLIEKAKDFYEQMQLTEPCVFSGGWLWRFKARHGIKKLDASSEKQSADHQAAEQFCAFFRSLAAEHGLSAEQVYNADETGLFWRCLPNPTPEGGAVPGPKQGKDRLTVLMCANATGSHRLKPLAIGKCSGPRAFKGIQHLPVAYKAQGNAWVDKEIFSDWFHHIFVPSVREHFRTIGLPEDSKAVLLLDSSRAHPQEAELVSSNVFTIFLPASVASLVQPMEQGIRRDFMRNFINPPVPLQGPHARYNMNDAIFSVACAWNAVPSHVFRRAWRKLWPSVAFAEGSSSEEELEAECFPVKPHNKSFAHILELVKEGSSCPGQLRQRQAASWGVAGREAEGGRPPAATSPAEVVWSSEKTPKADQDGGGDPGEGEEVAWEQAAVAFDAVLRFAERQPCFSAQEVGQLRALCAVFRSQQQETVGLEDVVVTSPEELAIPKCCLEASTET

SEQ ID NO: 920687 - protein, 509 aa, Homo sapiens
MAKQLNLPENTDDWTKEDVNQWLESHKIDQKHREILTEQDVNGAVLKWLKKEHLVDMGITHGPAIQIEELFKELRKTAIEDSIQTSKMGKPSKNAPKDQTVSQKERRETSKQKQKGKENPDMANPSAMSTTAKGSKSLKVELIEDKIDYTKERQPSIDLTCVSYPFDEFSNPYRYKLDFSLQPETGPGNLIDPIHEFKAFTNTATATEEDVKMKFSNEVFRFASACMNSRTNGTIHFGVKDKPHGKIVGIKVTNDTKEALINHFNLMINKYFEDHQVQQAKKCIREPRFVEVLLPNSTLSDRFVIEVDIIPQFSECQYDYFQIKMQNYNNKIWEQSKKFSLFVRDGTSSKDITKNKVDFRAFKADFKTLAESRKAAEEKFRAKTNKKEREGPKLVKLLTGNQDLLDNSYYEQYILVTNKCHPDQTKHLDFLKEIKWFAVLEFDPESNINGVVKAYKESRVANLHFPSVYVEQKTTPNETISTLNLYHQPSWIFCNGRLDLDSEKYKPFD

SEQ ID NO: 920688 - protein, 509 aa, Homo sapiens; identical to SEQ ID NO: 920687

SEQ ID NO: 920689 - protein, 107 aa, Homo sapiens
MSKQVSLPEMIKDWTKEHVKKWVNEDLKINEQYGQILLSEEVTGLVLQELTEKDLVEMGLPWGPALLIKRSYNKLNSKSPESDNHDPGQLDNSKPSKTEHQKNPKHT

SEQ ID NO: 920690 - protein, 326 aa, Homo sapiens
MDRGEKIQLKRVFGYWWGTSFLLINIIGAGIFVSPKGVLAYSCMNVGVSLCVWAGCAILAMTSTLCSAEISISFPCSGAQYYFLKRYFGSTVAFLNLWTSLFLGSGVVAGQALLLAEYSIQPFFPSCSVPKLPKKCLALAMLWIVGILTSRGVKEVTWLQIASSVLKVSILSFISLTGVVFLIRGKKENVERFQNAFDAELPDISHLIQAIFQGYFAYSGGACFTLIAASTDGAAPDPPQVITNHICRMHTGKLKGNFLCLTGKKYFGNVTEDVKFVENTEFPTHLLLPQPPYTQTFPPPKPMSGPYDLDTTTFHKKTLHPWPGPF

SEQ ID NO: 920691 - protein, 201 aa, Homo sapiens
MPGQGHQRAPWSSSNASVWEDTCCQADPPLDSAPVGSLYGGSSPTFAFHTALGEVLHEGSASAADFCLDIQAHIGNLLTSKFFSYKDFDTLLYTCAAEFDFMEKETPLRYTKTLLFPVVLVVFVAIVRKIISDMWGVLAKQQTHIRTQHITYSSFRCYPVQSDSSPAHNLHSKDTVLYFSSAGKVNYYVSGFRTSGLPFGK

SEQ ID NO: 920692 - protein, 162 aa, Homo sapiens
TKGSPLTMDSLASIAVRNNFCFFINYQIQLGHKWSLVIHPQLLPRSGLRAPFHYPLLMTLSLLSGPQPCFLTMVSATIICDKFPAVVMICLVMWFEALEEPLSLKATLSWGADIPHLAFPLLALTPFCRPVKRVPAFPLPSAMIVSFLRPSQRCGTETMHSK

SEQ ID NO: 920693 - protein, 640 aa, Homo sapiens
MLRATAPCWFPPGYPEAKKVAEEAALEASRHLGGEQSQAGAPEGSKMLRATAPCWFRPGYPEAKKLAKEAAPEASRHLGAEQSPAGAPEGSKMLRATAPCCFPPGYPEAKKVAEEAALEAPEFPLPSHQPAQSFGLWVPQMHKQASAFVDIQAEPQNRGPAVPPAWPKMVTESCYFPAQRGSACRLPAAPRLTERPSGVRISAPRKRKTIAHSSSPCLVTGYTDAKRTRVASSSQRSRGSKVGRQPGKTRNSSGCQVPTVLRRGYLQLFTEECLKFCASKQEAEEKALNEEKVAYDCSPNKNRYLNVVLNTLKRLKGLTPSSMPGLSRAALYSRLQEFLLTQDQLKENGYPFPHPERPGGAVLFTGQGKGPGDSSCRVCCRCGTEYLVSSSGRCVRDQLCYYHWGRVRSSQVAGGRVSQYTCCAAAPGSVGCQVAKQHVRDGRKESLDGFVETFKKELSRDAYPGIYALDCEMCYTTHGLELTRVTVVDADMRVVYDTFVKPDNEIVDYNTRFSGVTEADVAKTSITLPQVQAILLSFFSAQTILIGHSLESDLLALKLIHSTVVDTAVLFPHYLGFPYKRSLRNLAADYLAQIIQDSQDGHNSSEDANACLQLVMWKVRQRAQIQPRHRSASPAALACP

SEQ ID NO: 920694 - protein, 217 aa, Homo sapiens
HLVSCNQTSPSESEDREMVKWVSEKGYGKSQTLVEFELTGGCKLQPQVQAGLGICGKEKRREKQECETDILSEEEKREHFKRKAAELRRRPQNSAEGRRTPQKSAHSKEVASASSPLIEQAESQCAKKVRFRLFSSYFSFFLTSKPQSYGKGWGRICGRVLLPTGPLIMENQSFFLKLTGQSMNLTTADMDFPKLQSVERGLRVFTRYFIFRLLPAK

SEQ ID NO: 920695 - protein, 195 aa, Homo sapiens
DKAQWLLFGTRGRGPEKGGAEKEKEESTAWLGQKRWDPGRPPLCPCRAPRDQRVAHKGAAEPEPPAPQGTVGSAQLGGLCAPRPAAPPPALPGPTPLPPPSPRPSPPLSPRPPLLLGCSPTLSLCSPPYSRPVVEVTFLRSAASEGGEPTGSATPLHAVSGQLSEGLEPIEGWTPYRALGSPRKTWSPPPHFSGR

SEQ ID NO: 920696 - protein, 195 aa, Homo sapiens; identical to SEQ ID NO: 920695

SEQ ID NO: 920697 - protein, 309 aa, Homo sapiens
MWKFLGKNDGQLILIISLFTLLNVLTYFFFGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 920698 - protein, 657 aa, Homo sapiens
MLRATAPCWFPPGYPEAKKVAEEAALEASRHLGGEQSQAGAPEGSKMLRATAPCWFRPGYPEAKKVAKEAAPEASRHLGAEQSPAGAPEGSKMLRATAPCWFPPGYPEAKKPAQSFGLWVPQMHKQASAFVDIQAEPQNRGPAVPPAWPKMVTESCYFPAQRGSACRLPAAPRLTERPSGVRISAPRKRKTIAHSSSPCLVTGYTDAKRTRVASSSQRSRGSKVGRQPGKTRNRSGMACKTTATTSSKRIVRRPSLPSLSLKKPIILRSSGCQVPTVLRRGYLQLFTEECLKFCASKQEAEEKALNEEKVAYDCSPNKNRYLNVVLNTLKRLKGLTPSSMPGLSRAALYSRLQEFLLTQDQLKENGYPFPHPERPGGAVLFTGQGKGPGDSSCRVCCRCGTEYLVSSSGRCVRDQLCYYHWGRVRSSQVAGGRVSQYTCCAAAPGSVGCQVAKQHVRDGRKESLDGFVETFKKELSRDAYPGIYALDCEMCYTTHGLELTRVTVVDADMRVVYDTFVKPDNEIVDYNTRFSGVTEADVAKTSITLPQVQAILLSFFSAQTILIGHSLESDLLALKLIHSTVVDTAVLFPHYLGFPYKRSLRNLAADYLAQIIQDSQDGHNSSEDANACLQLVMWKVRQRAQIQPRHRSASPAALACP

SEQ ID NO: 920699 - protein, 290 aa, Homo sapiens
KGRYGVRQSLCTPARYEGTWSNGLQDGYGVETYGDGGTYQGQWAGGMRHGYGVRQSVPYGMATVIRSPLRTSLASLRSEQSNGSVLHDAAAAADSPAGTRGGFVLNFHADAELAGKKKGGLFRRGSLLGSMKLRKSESKSSISSKRSSVRSDAAMSRISSSDANSTISFGDVDCDFCPVEDHVDATTTETYMGEWKNDKRNGFGVSERSNGMKYEGEWANNKRHGYGCTVFPDGSKEEGKYKNNILVRGIRKQLIPIRHTKTREKVDRAIEGAQRAAAMARTKVEIANSR

SEQ ID NO: 920700 - protein, 138 aa, Homo sapiens
MNESKNHITGLKSSFNPQETSFPRPLVNSKLTDSHCLPGDELPELAAGQPFPYAHSGPCAREPDNLAWGNCMGHLLPGHVDIVFVPESRGKCATCALGSMHRQAPCLLYCSALTILKFIIIVKQRVPCFLLDWALQIM

SEQ ID NO: 920701 - protein, 142 aa, Homo sapiens
MMTQYNGPQETSMTLELRTLLLTGGEKAKKTENPLCSCELALADNIMGGIPGEGSKPHSPDLNMKTQHMISVTLIPSQGEALFLLAGKCEPVGGERGVEHYVEVLPGSLASEGLMPEGIESPTETQDRRRRICECLSPVKLP

SEQ ID NO: 920702 - protein, 176 aa, Homo sapiens
MAGRADIYCIQDKRGRDLGTEMNKTWSLSLQQLIKNWEKQSCKELTVETKHMIIRVSHSRAQYQYEQNENKMVSAAYPTGMLGNLHEIFDRQECEFLSQIDEVEIPREDTGKSAALNGRVNVHDVIASPSSASSNLCPCQSGSSFWHLTCLPGKRQLRVKEKTLSCMLGCLRIQRS

SEQ ID NO: 920703 - protein, 195 aa, Homo sapiens
MASGLIDSGLMDSGLMDSGPMDSGLIDSGLMDSGLMDSGLMDSGLIDSGLMDSGLIDSGLMDSGLMDSGLIDLKGHKEQMGWERLLKDLKLPPQALALAPAGRVRAASSSSVRMTQMPASDILPSPPAWVTSLRNCLLPKTQLTGKMKQCRTALSPHSSCPQVLFLPLHSTTPMKLPHAPLQTHLARCSGSEPLW

SEQ ID NO: 920704 - protein, 149 aa, Homo sapiens
MRTWNKAECDNALGSGVWGPEKILDFWAVLEVLIQKWKKIMSLNAVTVGGIKSCELRTKYVYSDVNPKALSCPRVSSLAGGLCRYSYVPDLGNRISNADVTWWAEVVPSHLFVMFYNGGHFPEWFSLSMAIISDQNGIKLEMNNRRKQK

SEQ ID NO: 920705 - protein, 149 aa, Homo sapiens; identical to SEQ ID NO: 920704

SEQ ID NO: 920706 - protein, 149 aa, Homo sapiens; identical to SEQ ID NO: 920704

SEQ ID NO: 920707 - protein, 149 aa, Homo sapiens; identical to SEQ ID NO: 920704

SEQ ID NO: 920708 - protein, 149 aa, Homo sapiens; identical to SEQ ID NO: 920704

SEQ ID NO: 920709 - protein, 149 aa, Homo sapiens; identical to SEQ ID NO: 920704

SEQ ID NO: 920710 - protein, 149 aa, Homo sapiens; identical to SEQ ID NO: 920704

SEQ ID NO: 920711 - protein, 149 aa, Homo sapiens; identical to SEQ ID NO: 920704

SEQ ID NO: 920712 - protein, 149 aa, Homo sapiens; identical to SEQ ID NO: 920704

SEQ ID NO: 920713 - protein, 149 aa, Homo sapiens; identical to SEQ ID NO: 920704

SEQ ID NO: 920714 - protein, 149 aa, Homo sapiens; identical to SEQ ID NO: 920704

SEQ ID NO: 920715 - protein, 149 aa, Homo sapiens; identical to SEQ ID NO: 920704

SEQ ID NO: 920716 - protein, 149 aa, Homo sapiens; identical to SEQ ID NO: 920704

SEQ ID NO: 920717 - protein, 149 aa, Homo sapiens; identical to SEQ ID NO: 920704

SEQ ID NO: 920718 - protein, 149 aa, Homo sapiens; identical to SEQ ID NO: 920704

SEQ ID NO: 920719 - protein, 149 aa, Homo sapiens; identical to SEQ ID NO: 920704

SEQ ID NO: 920720 - protein, 149 aa, Homo sapiens; identical to SEQ ID NO: 920704

SEQ ID NO: 920721 - protein, 174 aa, Homo sapiens
MQGQDHRPVASDWQEGKFQPIGEERVQGHPRTPERLATVVVAFGPQLLGCHRSACGSPSPAHTGLYRSPQGRSEWLCSSGLSWCFSWLCLLPEATSHTQATLPPSAQPTLTLSRSSQSILATFLEEVKLLTNFHHGKLTMQLALACTSPCCHHVKKDVFTSPPAMIQRENGLIR

SEQ ID NO: 920722 - protein, 146 aa, Homo sapiens
MKPSSGAAQTGMAFGPVPPHTASEACKEVSEGRTRQTQVEGKGNLSRTPQVPSTRRPSEALQTVPSDRASHFRLGLNGSPTHTSVVLEAGKKGKCADTEGRGGGLALESPRYRARDSAGVRALEMDSRALAPALPEDPARANWRCE

SEQ ID NO: 920723 - protein, 573 aa, Homo sapiens
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDESVNKMNIGNEYKIIGIPTCVKTSQTAVCIEANSITFCNSKAILANIFASQITPPGTYNLLKLCLLMSLVQTTDRNKELEDCLDILIITSDTLLIDRLLNFSINLVPRGIRHLVSTEIFPTLSRNKYGTGAVSIQAGSALLAKGGICFIGDLASHKKDKLEQLQTVLESRSITVYIPGKKFGEDIDQQMTFPVQCSFWSFVDVDSSSRRNAQKINTLIGQMDCSLIPANLVEAFGLLINCNESSPCHPFLPTVQHTLNKAINPEGLFYAASRQFTTEDFEKLLAFAKNLNVEFSLEAERMTHGYYLASRRIRTGSVCGSKLSASALKYLVFLSEAHARLNLRNKVLKEDVLIAALLFETSLTLKYGNELNY

SEQ ID NO: 920724 - protein, 848 aa, Homo sapiens
MSLFFLIRNNTGIQSRAERQWDRTTLGSSPGLRVSGKGPHWDPVQGWESVRKHTPGSTPAGSQWERTTLGSSPAGSHGKGYTGIQSSWESVRKAHTGIQSRAGSQWERTTLGSSPRLGVSGKRPHRDPVWGWESVRKDLTGIQSGAGSQTTPGSSPGLGVSGKGRHWDPVRGWESVGKDTLASSPGLRVSGKGRHWDAVRGWESVGKDDTGIQSRAGSHQWERTTLGSSPGLRVSGKGRHWDAVRGWESVGKDTLKSSPGLGVSEKGPCWDPVRGWESVGKDHTGIQSGAESQWERTTLGSSTGLGVSEKGPHWDPVRGWESVGKEHAGIHLGLRVSGKGHIRIQSGWESVGKDTPASSPGLRVSGKGHTGIQSGAGSQWERTTLGSSPGLRVSGKGHAGIQSGAGSQWERTTLGSSPGLRVSGKGHTEIQSGAESQWERTTLRSSPGLGVSGKGLHWDAVRGWESVGKDHTGMQSRAGSQWQRTHWDPVRRDTPGSSLAGSQWERTTLGSSPELGVSEKEQHWDPVWGWESVAKDTLGSTPGLGVSEKGPHWDAVRDWESVGKDTLGCSPGLGVSGKGPHWDPVRGWESVRKDHTGMQSGAGSQWERTTLGSSPGLGVSEKGPHWDPVRGWESVGKDTLGSSPGLGVSGKGPHWDPVRGWESVGKDTLGCSPGLGVSGKGPHWDAVRGWESVGKDHTGIQIRGWESVGKDTLGCSPGLGVSGKGPQWDAVQGWESVGKDHTGMQSGAGSQWERTTLGSSPGLGVSKKGPHWDPVRSWESVRNNNTGNQSGDGSQWQRTHWDPLQGWESVRKDHTGIQSGAGSQWERTPLGSSPGLRVSGKGRHWDPV

SEQ ID NO: 920725 - protein, 848 aa, Homo sapiens; identical to SEQ ID NO: 920724

SEQ ID NO: 920726 - protein, 117 aa, Homo sapiens
MTTNMKERLLQRKTIHSPGLEVFEEILRGYNTRGTYANMSARFEQAPCKTSSGTHMDLKIPWREMYPAKANPALSLVLMLTLEGSPTSVGWRWRPGSLEDCPGTEQGQLSFQSRAGM

SEQ ID NO: 920727 - protein, 705 aa, Homo sapiens
QDLFHSAGARVDRANSCQSDSSGFLEEPLEPLPLQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSKDCSFSEEGRLERVRGGPGGKGTGTQSQIPHEEEEDDDDNDDDNGSSEQMLKLRAILGCKTKGIAGKNSASHQSAGKWTGLGGAKVLSHCSQCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 920728 - protein, 404 aa, Homo sapiens
MRLEDLWNLFHAQGGGDVLAVAGVPMWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQEVQKGAREGHTEKEVTENRFDFIAHPL

SEQ ID NO: 920729 - protein, 453 aa, Homo sapiens
MWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 920730 - protein, 433 aa, Homo sapiens
NGSREGTRAEADQGQACVRSLAVAGVPMWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLGECFFLSSWKTSLPCAVMSLTVDLLFRVQAGLS

SEQ ID NO: 920731 - protein, 480 aa, Homo sapiens
NGSREGTRAEADQGQACVRSLAVAGVPMWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 920732 - protein, 392 aa, Homo sapiens
KQAGTGLGDFWAYRRPTLVVLRKGSVPLGLATVLQDLLRRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 920733 - protein, 425 aa, Homo sapiens
ILGPGHFPPFIRGLDISGSCSDWSSQSEPSEEFPPPADLLPSDEEAAPTGHTSPSGLSRLWATWGDLFSLNTRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 920734 - protein, 82 aa, Homo sapiens
ICPFVSRCKEEARRACRAGKKQLVFNAYQAGVGALKLSMKDVTVEKAESLVDQIQEVQKGAREGHTEKEVTENRFDFIAHPL

SEQ ID NO: 920735 - protein, 480 aa, Homo sapiens; identical to SEQ ID NO: 920731

SEQ ID NO: 920736 - protein, 482 aa, Homo sapiens
LQYTPEYCSEAGWRQGQACVRSLAVAGVPMWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 920737 - protein, 456 aa, Homo sapiens
NGSREGTRAEADQGQACVRSLAVAGVPMWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQEILTVKNWRRNWTSSFRIPPKNLWICLTTPAIGILPTACLTLGSQMLNLKLNLRNCPYQREVWSQAVNLQKGNWNRL

SEQ ID NO: 920738 - protein, 424 aa, Homo sapiens
GTEAGRERGRKRTRARLVFAALPWLGFRCGPRSGRPRPQPGETRRAFCPPSGRRTRSACPSCSPLSRGVASRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 920739 - protein, 310 aa, Homo sapiens
MELMSVCCHVKLFMEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 920740 - protein, 195 aa, Homo sapiens
VPSTFPLDWTLILPRMVSNSCTQAILPPQPPKVLRLQALSHCTWPTRLSEALRSLKAKQRTEKRIEALHAKLDTVQGILDRIYASQTDQMVFNAYQAGVGALKLSMKDVTVEKAESLVDQIQELCDTQDEVSQTLGRWALPLHLMEPGGPPVGERLLPRLLHSPGKRPSHYRTLRCPDPLCKEAKLLPWPHHGVT

SEQ ID NO: 920741 - protein, 209 aa, Homo sapiens
ARGSTVLTSRPSLPVAVLSIMYKYKQAAGVWGFCASTDCFSGTDLLRIFQAQACHVSRAGRMWASCSISIPFGVTYLFRYLATIRSAWIAQMSLIGLLPWYAGRVMGFEGQGLRRCNKKALNLKNDFLMEDIYHFIPCIDQIPYYQKWVIATPDFYENYSVMSENIDFGVSCPDVNPGTRYSCCGPGGLIKFTGERKAFTLMDDGSCFA

SEQ ID NO: 920742 - protein, 145 aa, Homo sapiens
LSLQAMGSSQMFTCNPSPKIGTEEDAVISTCLMPIFDQICCEEEALGQGTRESEVLPGSQAERSRPSWTIYTHTSLPTEPLQWFNTIGPPPRRNADPAHHKHHCRFLVSLSLPEKRPKETLEVIGMSYTLIVGAVSWKCTLLRSH

SEQ ID NO: 920743 - protein, 210 aa, Homo sapiens
ERVEDLRSEELEAVMRANAICGEWETRRFGGGNGDALRLGGGGGEAVLLFGGGEGEYLLCIGGEYLLGEAVEDEGREKETVAFWWVVGMDFSSVYHEGKSLFGAFVVMEKHSGKGNVSAACQPHHSSHGISWVVHLLRRRRNQSQMKTAGFVVCIGVSAEINEEGPSVPTVLGGNVCYDVNFIWIELMNPFFSLMQSVILYSKAVLTNNS

SEQ ID NO: 920744 - protein, 364 aa, Homo sapiens
YPAGRRRSWASFAMQSTDLGNKESGKIWHRKPSPATRDGIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKEEVRAQN

SEQ ID NO: 920745 - protein, 102 aa, Homo sapiens
MKLILWKKKQICGGRLGALGKSFHNTSPVWGAGAPVVGYGTPLATPAGPKGKPLAPGPTGLVSPPIKKPAGGHPRGSGQPRGGPAAYGLSHRSPKQNNRAAG

SEQ ID NO: 920746 - protein, 102 aa, Homo sapiens; identical to SEQ ID NO: 920745

SEQ ID NO: 920747 - protein, 143 aa, Homo sapiens
AAAGGSGMGACRSQALPHREAAEAPREFECSASRPALLGDPTHPPQLLAQLLSPSLPEACGPQRPLGVQGRQTHAHPELALAHKRLAQPRKGIPQCSSGLKGSSSAARVGAEAEEEPIASESCQHASFFTSLFSGPFSPNTPD

SEQ ID NO: 920748 - protein, 143 aa, Homo sapiens; identical to SEQ ID NO: 920747

SEQ ID NO: 920749 - protein, 115 aa, Homo sapiens
MWLKVFTTFLSFATGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQ

SEQ ID NO: 920750 - protein, 445 aa, Homo sapiens
QGTACMGQDAFMEPFGDTLGVFQCKIYLLLFGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVAEIYGSSQGESQHLGNYKILLSFAHKSNATWAKSGSRFGQDMVVKMLIPQLLSLTKIPILSFQARNRIQESSNIFRFHAGSSIPKRRGKEDLAGARIASLSPL

SEQ ID NO: 920751 - protein, 183 aa, Homo sapiens
MTYSNCIILFNAHNNPARFLLIFHFTDKKTEPHRVDAKPLSGRTGICTHIYVALKATLSPFHWPIKNHRDQITRACHSADSRAEVPNCSMLCILLVTGQRPSKGIKRRHRSFQDWRDWGSWPEYHSQRSQKTPCVHVSRGRNAHAGTVSLQLNTCQRSFATLKPRPGLLRMRHTNEVTCPVMA

SEQ ID NO: 920752 - protein, 161 aa, Homo sapiens
RIVEAGIMGTSPWLGVVWSPGLLGLACSDFFMQTQKQQEKNPQCTCTISIICLHNIYLYSISQNKLQDQTRPMEVEEDSTFDGRESFYHTWAVMLVLHMSGSVFDKVTGSKLKGELLDYMLAKLMLTSVQRKFGYLFFTLKIPTSITQVQMGNQKIYSKAF

SEQ ID NO: 920753 - protein, 119 aa, Homo sapiens
MFQICHYEIIGSKDGKKKNLILMRMTYQEIKHRTSDEWAFSIANPAHLTVLPRYGPDTGPYLWFGFHSEAKPGQLVTQSLESSPSCWDSGIGSLPSQISIRKTYLKIMLTNYIDDIRLI

SEQ ID NO: 920754 - protein, 119 aa, Homo sapiens; identical to SEQ ID NO: 920753

SEQ ID NO: 920755 - protein, 119 aa, Homo sapiens; identical to SEQ ID NO: 920753

SEQ ID NO: 920756 - protein, 142 aa, Homo sapiens
MYTVTEMKSRDRLSASWRTREVNSVAQSGSQRTRVQKPKNLESDVQRQRKNSIPLQKEDSTRCKLLMALPCSGLKDSGPILTAPLGSAPVETYYLTFPFCTGLAEVLCEGSVPAAGFCLGHPGISLESTTLALCTPAGLTPH

SEQ ID NO: 920757 - protein, 299 aa, Homo sapiens
SSSHHHHHCGCCCSCSCCSPSGCFFAWPAANGAMEPRLFCWTTLFLLAGWCLPGLPCPSRCLCFKSTVRCMHLMLDHIPQNSGMLHGQVNTKKNKSQDGHQWLCRLCTAQLQSVLGNVPPLQLCNTVVLEEKEGRDRGTHLPKTQEEPRRQYRLFFKREDGGHICQSSRWQRLLWFPGGPLQTWVPRASVISGGYRTAKMAAAPSPGLSVPEGHQPDAEPSGVKTKSADSWRPRLPLPTGAQSQEDQSAVPKPKAGGCWHPGLGPSGPRPRCPPPPPGPSLAHQGGQCRRELRLRHGPT

SEQ ID NO: 920758 - protein, 1341 aa, Homo sapiens
MEYNWHYFLSIAGICRVLAVSLSVPIQEWLCLNCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQVEPGKEKTEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISALCPFLSNDVGPLL

SEQ ID NO: 920759 - protein, 719 aa, Homo sapiens
MEYNWHYFLSIAGICRVLAVSLSVPIQEWLCLNCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQVEPGKEKTEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQRD

SEQ ID NO: 920760 - protein, 1980 aa, Homo sapiens
MEYNWHYFLSIAGICRVLAVSLSVPIQEWLCLNCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQVEPGKEKTEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISAQPPPPPPPPPPPPPPPPPPPPPPLPPPTSPKPTILPKKKLTVASPVTTATPLFDAVTTLETTAVLRSNGLPVTRICTTAPPPVPPKPSSIPSGLVFTHRPEPSKPPIAPKPVIPQLPTTTQKPTDIHPKPTGLSLTSSMTLNLVTSADYKLPSPTSPLSPHSNKSSPRFSKSLTETYVVITLPSEPGTPTDSSASQAITSWPLGSPSKDLVSVEPVFSVVPPVTAVEIPISSEQTFYISGALQTFSATPVTAPSSFQAAPTSVTQFLTTEVSKTEVSATRSTAPSVGLSSISITIPPEPLALDNIHLEKPQYKEDGKLQLVGDVIDLRTVPKVEVKTTDKCIDLSASTMDVKRQITANEVYGKQISAVQPSIINLSVTSSIVTPVSLATETVTFVTCTASASYTTGTESLVGAEHAMTTPLQLTTSKHAEPPYRIPSDQVFPIAREEAPINLSLGTPAHAVTLAITKPVTVPPVGVTNGWTDSTVSQGITDGEVVDLSTTKSHRTVVTMDESTSSVMTKIIEDEKPVDLTAGRRAVCCDVVYKLPFGRSCTAQQPATTLPEDRFGYRDDHYQYDRSGPYGYRGIGGMKPSMSDTNLAEAGHFFYKSKNAFDYSEGTDTAVDLTSGRVTTGQYDVAADLSLKYHYGVPHLISG

SEQ ID NO: 920761 - protein, 184 aa, Homo sapiens
MVGELWDRFQTRSFLAPVKPINLILQHTIHSGSLLYVNVPSKSSHKDLYVNVYNSFIHDLQNPETTKMPFSSGHVQSTNADDVDNPLGDIASLAKQRYSKPLYTNTSRAANIPGYTGKVHFTATHPANSNIPSTTPSPDSELHRVFQKEMAVDLFRHQAPLSRLVTTVRPYNPFNKKDKETIDY

SEQ ID NO: 920762 - protein, 636 aa, Homo sapiens
EWVHSENLENYPFDMFPVISKHYERSKLRNINIEMRLKRPGGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKVKSYVFYIAGLAQSAWNK

SEQ ID NO: 920763 - protein, 265 aa, Homo sapiens
MDQERPRSDLSINNRNDLRKVLHLEFLYKENKWFHEKTSKFTRSLDGRAVPAAILHGQRNACRVPPTVSLRVLKSSSTQPQEESRKVPELFVCTQQDILASSNSSPSRTSLGQLSELTVERQKTTASSPPHLPSKRLPPWDRARPRDPSEDTPAVDGSTDTDRMPLKLYLPGGNSRMTQERLERAFKRQGSQPAPVSLLGLSEQACEVTGKVEFVMVNQEENSARAHTPGKLKNALDRGVQPFGFPGPHWKNNCLVPRIKYTNNS

SEQ ID NO: 920764 - protein, 159 aa, Homo sapiens
WCAMKKNKTKACALAAPQSNKIRLSRDGNKAAVALKALQDVNCDHLNRALLRVLFSSPCYRDHVRRLRHHQQHRTGLKVHVEGRASQDSQTEAACQAEPSRRPPPSSLSSVSSMRLKKNAVVVPCLLTQRVKQEFSAPVCHGGPWEEVTYHSHPQAQEH

SEQ ID NO: 920765 - protein, 173 aa, Homo sapiens
MARSSSDSGSGRGAPGPGPEPGSERGHGGHGKRAKERPPRARPASTSPSPGAHGRRGGPEGKSSSRSPGPHPRSWSSSRSPSKSRSRSAEKRPHSPSRSPSPKKPLSRDKDGEGRARHSEAEATRARRRSRSYSPIRKRRRDSPSFMEPRRITSAASVLFHTTGPAPLPPPAA

SEQ ID NO: 920766 - protein, 128 aa, Homo sapiens
MGPAAGHAAPRGPPVPATTAGAALRAGASEPRQTQLGAPLALGEARGGPQDPSGEGAISPCPQGYKEVSGPVHGQMGPGKTLRVGIQWTRRSQMCCFYGCPLPPPVHPLCPGNKEPLRTQESPHPPSC

SEQ ID NO: 920767 - protein, 103 aa, Homo sapiens
SRSSLLSGLWSAWGPGGPLCTGCLGDAQRRKRPIPYYRPSPSSSSSCLSSDYSTRSHSRSPSPGHSHGSYSSRSHGTRSRTRSPSRTPSPSYHSRSSSESGGF

SEQ ID NO: 920768 - protein, 119 aa, Homo sapiens
MTSREQQDPSSENKKHLFPEPVTPAMRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 920769 - protein, 358 aa, Homo sapiens
RRCVVLDRILFCQQTPTMISAVLTATRYAKFAKRSNHTFAQRGGLHAYFIPLPFVYHLYVLMMPELLNGNSLFAQNCVGMQGKCCARGLLLGTAPATGASCVRHQLLRLAQHLDSIWKIECDPFPHLVTELPLEVDKLLTHKNSCLPDYVAIIDVFEPIDADGICRMEGSTVQGSSFCTASSQFCERQRATERDGQGLIRGLADSIMEGEKSQDRPSARRKPREAAGMARFKSKGLSTKETKVITLITYIVNYTETYRVERSHIEPHLHGDQLSEITEKSRWPVSKSHKIRWFYKGQFPCTSSLLCHHAFAVHSPFTMIVRPPSHVELCRLKAYNCYIKSRWIGFFAIIVTRLFLPRF

SEQ ID NO: 920770 - protein, 143 aa, Homo sapiens
MGFSFLLHRHAAKFPNFYGDQDKSKTSKAWIHDTKSGCDLSSVYFVPIIALHSTGSEGLECRCHETVTVSFWLTPDLSSNTVLTPEQKGVRSLNIPFLAAMPKRDTTNPSQHSSHKLCKWPCNPPLIGHSQSESAHKMKPYLN

SEQ ID NO: 920771 - protein, 532 aa, Homo sapiens
MPIPRGLCSFHGPHTTCLHAVCGPVGASHLARTKYNSFEYLGVSVLLCFQHKLWVLLLLLGRWRVEFRLVNELLIYSIHVTMLLDGGLGWCLMVFAGFLRPPSPCALSGAAPTCWWLLLPRLQVVLRGGPLSRTTAARDFRHHPGRPLDTEGCVPRSKSRRGGPAWLHSPFLRALVPAAANGTRKTPLPDTPHCHKAAYSALGRLRPGTARGPPSVSHLRGCVGSEAPASLQGHLGLCRCSLAGGRSGAQVGGVSAGSQLGLAWGNPGSQGPTPATLACLPVPVGLYVLQMLWISGEEPPFLSGFFCGGGLWASFFEGTPSKKAWEIEAAVSQDGDLRVRVSGAGGRGFSVATTAPELVWHQQRLKASDLVQEARDEGLCGCVTVNQQLLDPGSPGIVSLHVQELIHINLQFWDLLFLARGSESRRVVLGRHCPARGPGPPTQRPRAVPLSALAAAGTTSTRRAVPCAAAFGRPAGWLWLGPRLLSMLLGGEGSGGGTRGQLQHAEPPGRAWPRPAPSPPIRLPFVPVTATP

SEQ ID NO: 920772 - protein, 429 aa, Homo sapiens
PRGCWDSGRSAAAIMDFLWDKRTGLAARKMPHPRSSSDRTRRRRREDSYHVRRRCSRTFSRSSSQHSSRKAKSVEDDTEGHLIYHVGDWLQERYEIVSTLGKGTFGRVVQCVDHRRRGARVALKIIKNVEKYKEAARLEIKVLEKINEKDPGKNLCVQMFDWFDYHGHMCISLELLGLSTFDFLKDNNHLPYPIHQVHHMASQLCQAVKFLHDNKLTHTDLKPENILFVNSDYELTYNLEKKRHERSVKSTAVRVGDFGSATFDHEHHSTIVSTRHYRAPEVILELGWSQPCDVWSIGCIIFEYYVGFTLFQTHDNRQHLATMERILGPIPSRMIRKTRKQKYFYRGRLDWDENTSAGRYVRENCKPLRQYLTSEAEEDHQLFDLIESMLEYEPAQRLTLGEALQHPFFSRLWAEPPNKLWDSSQDISP

SEQ ID NO: 920773 - protein, 681 aa, Homo sapiens
MPNFCAAANCTRKSTHFPRDPARCQKWVENCRRADLEDKTPDQLNKHYRLCAKHFETSMICRTGPYRTVLRDNAIPTIFDLNSHLNNPHSRHRKRIKELSEDEIRTLKQKKIDETSEQEQKHKETNNSNAQNPSEEEGEGQDEDILPLTLEEKENKEYLKYLLEILILMGRQNIPLDGHEADEIPEGLFTPDNFQALLECRINSGEEVLRKRFETTAVNTLFCSKTQQRQMLEICESCIREETLREVRDSHVFSIITDDVVDIAGEEHLPVLVRFVDESHNLREEFIGFLPYEADAEILAVKFHTMITEKWGLNMEYCRGQAYIVSSGFSSKMKVVASRLLEKYPQAIYTLCSFCALNMWLAKSVPVMGVSVALGTIEEVCSFFHRSPQLLLELDNVISVLFQNSKERGKELKEICHSQWTGRHDAFEILVELLQALVLCLDGINSDTNIRWNNCIAGRAFVLCSAVTDFDFIVTIVVLKNVLSFTRAFGKNLQGQTSDVFFAAGSLTAVLHSLNEVMENIEVYNEFWFEEATNLATKLDIQMKLPGKFRRAHQGNLESQLTFESYYKETLSVPTVEHIIQELKDIFSEQHLKALKCLSLVPSVMGQLKFNTLEEHHADMYRSDLPNPDTLSAELHCWGIKWKHRGKDIELPSTIYEALQLPDIKFFPNVYALLKVLCILL

SEQ ID NO: 920774 - protein, 129 aa, Homo sapiens
MADSGDAGSSGPWWKSLTNSRKKSKEAAVGVPPPAQPAPGEPTPPAPPSPDWTSSSRENQHPNLLGGAGEPPKPDKLYGDKSGSSRRNLKISRSGRFKEKRKVRATLLPEAGRSPEEAGFPGDPHEDKQ

SEQ ID NO: 920775 - protein, 129 aa, Homo sapiens; identical to SEQ ID NO: 920774

SEQ ID NO: 920776 - protein, 129 aa, Homo sapiens; identical to SEQ ID NO: 920774

SEQ ID NO: 920777 - protein, 129 aa, Homo sapiens; identical to SEQ ID NO: 920774

SEQ ID NO: 920778 - protein, 176 aa, Homo sapiens
KASVWNPGMDTLRPDTMSFSPFKVPGIRYNAWNIVDTGKSDDDDGNDDSDDKNDVVGDIDDSGNGDDGCGSIDDDGVNHVSAGYELDALRVSGSDPTSAPWPSFHRCPPVQGPPVIPNTSEPKPCSVSKKGKRACSSCSKTPGPTPLFLGLIDHCSFSFDALLPTRSKRAVGEKQF

SEQ ID NO: 920779 - protein, 142 aa, Homo sapiens
EKARRFKMAEDLDELLDEVESKFCTPDLLRRGMVEQPKGCGGGTHSSDRNQAKAKETLRSTETFKKEDDLDSLINEILEEPNLDKKPSKLKSKSSGNTSVRASIEGLGKSCSPVYLGGSSIPCGIGTNISWRACDHLALYSL

SEQ ID NO: 920780 - protein, 610 aa, Homo sapiens
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGRLHRGLPPALPNQPATQHRGGPLQRGPACAWPLPGPCLRGRSAWARTLPHRLAGDRGQGSERSGEASGPAAPPELPSPGAWPAGSSVSSGSFCGLSRDSSSMLLCSSPDRPPRCPLVCVLSPPRPSGSSPSLPASGSYQALSPPSRDSPEPASELQAEEALLQEQFLDACRQIDELSVGSDTIDLPQGPSYKTNESCPVSGMSGVTGSSPLKTLLNRWEVAFHRDGTSPWENQEHPDFLAN

SEQ ID NO: 920781 - protein, 478 aa, Homo sapiens
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLALLDLLLLSAGTTRAFPLFYDAYGHRDRLPALAWLLLQDLPLPCLAAGLGLACLLLARPRPPRCPTGLAALLLLGLGLA

SEQ ID NO: 920782 - protein, 763 aa, Homo sapiens
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLEGPWPWWAFQLGLRLGEVGVALPLALLGLYPALCSPRVPPRCWAKLFRLSPGHAAPLLPGGWVTGPPDKEPLGSAIARGDAELLQLCALAGPGPDLLLQGGGCRGFEGAAANPAPSPASSPCSDYTVDFRPPSPINLRRSIEEALCSEALLAPGLFQGPAFEDALPGLGLYRTASLGTGGRASERSGEASGPAAPPELPSPGAWPAGSSVSSGSFCGLSRDSSSMLLCSSPDRPPRCPLVCVLSPPRPSGSSPSLPASGSYQALSPPSRDSPEPASELQAEEALLQEQFLDACRQIDELSVGSDTIDLPQGPSYKTNESCPVSGMSGVTGSSPLKTLLNRWEVAFHRDGTSPWENQEHPDFLAN

SEQ ID NO: 920783 - protein, 429 aa, Homo sapiens
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGRLHRGLPPALPNQPATQHRGGPLQRGPACAWPLPGPCLRGRSAWARTLPHRLAGDRGQGQ

SEQ ID NO: 920784 - protein, 159 aa, Homo sapiens
MRECRKKDTRQRDKRKGSWARGTTTTNVRRPVVAPNALHKKWRSRVFSKLPRGKGDSLSRSAKQPVFFLDTEATARPPSARQQASSQTLAILEYLSQRPEPAPSSVRTSFLAPSAPKKTVRQVMHPRPEGGQQGAVCKLVWRDWADLSIYMLMDHFMAS

SEQ ID NO: 920785 - protein, 125 aa, Homo sapiens
MRGEQMPSERPPLYKHERDPQKWHPGTHVWLHRLMCLLGNRMDPPTCAAPRRPLLASLSGMCCTQAASSGISRWDVLHPGGLFPHLSVGCAAPRRPLPASLGGMCCTQAASSRISRWDVLHPGGL

SEQ ID NO: 920786 - protein, 163 aa, Homo sapiens
GKLPTQASVMVDTPPHTKLGSPTLTSDCCAGNENFKPVVLNLLGSVGVPPTERDHLAPWLQPPLQGSECFCLTGIPGTTGLATPARSGNPLGSTSMLWKLCSFALHNKSCCCSLFGSMPSLRAVTLTAKVRGSILEVSKTMNPPEGTNSGHILATQMGLSPST

SEQ ID NO: 920787 - protein, 274 aa, Homo sapiens
MPSKKPRKQNPLFIESISEQAEVSKNNALQLREKLGNIRNQSDSEEENINLFIKKVKNFLLEENVPPEDIEKVANGVLDIHLPIPSQNLTDELVKIQKHMQLCEDYRTDENRLNEEADGAQKLLVKAKAAEKAANILLNLDKTLNQLQQAQITQGRANSTITQLTANITKIKKNVLQEFVELKKQYAILQRKTSTTGLTKETLGKVKQLKDAAEKLAGDTEAKIRRITDLERKIQDLNLSRQAKADQLRILEDQVVAIKNEIVEQEKKYARCYS

SEQ ID NO: 920788 - protein, 171 aa, Homo sapiens
MGTTDTVDHFRGEGGGTRAEKPSFRNLHTVFHNGRTNLHSPTVLKHVEIELKPNRSGLISHGPVHHQFGSEIRHNLAISSKGLGEPSKRLSNTQRPWGSGRSYHVVFHKKLVHPYQAYTFQPMRMEKKKKLMTDSIITKGCDLETMVLKGEVKEVQSYENRSKYMEVECGA

SEQ ID NO: 920789 - protein, 164 aa, Homo sapiens
MGRTSAGHAVHAKSVVITAPLSAFPNADCQLSPRHSSMDGAWISCSTKSCPALLWVNGPRNEITGIPDLILKMIHSLKSTSPIYVDKNFHAEYNLEKGLWRRNNRFCAISCVSTRSLSWNHLEDVHKHTVPGLQPGPSKPEAKECVSNLHHKVIDAISCVYAIS

SEQ ID NO: 920790 - protein, 127 aa, Homo sapiens
RTQMNNQSHPESPGPLEVGIGHKAQLLEKACTFSYELLLLEKCIQIEFQATFASHLPRPQTEVSQGSQPLGKGRRKKEEKIKGTVSHSAVCKCKKPKIKERLKYNDRKLKTRANKTERLNQHHLFCE

SEQ ID NO: 920791 - protein, 262 aa, Homo sapiens
MTAMIVILKCMAQMAPWMYNLLKAQAHGLSSCSRGKQNEPGLEPWSFENPRPPEFEELRETELEFLIWTESLWNYYKKLFGSGTTLVVTDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 920792 - protein, 262 aa, Homo sapiens; identical to SEQ ID NO: 920791

SEQ ID NO: 920793 - protein, 262 aa, Homo sapiens; identical to SEQ ID NO: 920791

SEQ ID NO: 920794 - protein, 262 aa, Homo sapiens; identical to SEQ ID NO: 920791

SEQ ID NO: 920795 - protein, 151 aa, Homo sapiens
MRSGRLLGARRWPIPCFQAVTLGTHPELGNCAKAQAPPPPEGAEAQGCAEAQVDAKAHVGAGAQEGVEAQMGEEGRGVQRLGGYRGSVGCQGTGGCRGSGGCRDSDACRGSSRCRGSEWVQRLRWVQRLSWVQRLRRVQRLIWVQGLRWMQ

SEQ ID NO: 920796 - protein, 602 aa, Homo sapiens
MAVFQDMDGAGSHCAQQTNAGTENQTPHVLTYKWELNGSSALALSCVRVERKESEREMSLYFAGCCRGPLLDGCFSLASLEMFDRLKPSSLNSSKSFSIQLCSIAGLQSWGSKNKVNLAVEEEEQIPGPFVIPSWQWEQDPALRTVGKRERAPEEDRNMWESLELPRDLLNGFDQNADSDMDNEVQDEMVSDGDKKFIGNWSKDDSCYALVERLGTFCPCPRDLWNFELERDDLGYLVEEISKWQGFQEEAEQKSLENLHPNDVIEKKSPFSGEKFKLAAKIFISNKELNVNHQDNRENVFRACQRPSWQPLPSQAWRPRRKKWFSWLGPGSPCSVQPQDMVPCVPAASAPAMVKRGQGTAWAIASEGASPKPWWFPQSVEPVGTQKSTIEVWEPPPRFQRMYGNAWMSRQKFAVGVELSWKTSARAVWMGNVGSEPSHRVPTKVLPSGAVRRGPLSSGLQNGRSTDSLHSAHGKATDTQCQPVKAARRGTVSCKATGVKIPKAVGAHFLHQHDLPRMQVQGCLAGPWAHGKWPMGLFLGLICGSMAAQLVLDMSAKVAHGAVSQFWNVGSWLLEGVGGGEECTPCAPYLGVVQLHEFLVAL

SEQ ID NO: 920797 - protein, 602 aa, Homo sapiens; identical to SEQ ID NO: 920796

SEQ ID NO: 920798 - protein, 258 aa, Homo sapiens
MGCTHSPTSPNEKNQGDSIQAGEESPFSDSVTLEQTTSNIGGTSGRVSLWMQWVLPKITIKLFAPDPENKGTEVCMVSELEDLSASIDVQDVYTKVKCKIESFNIDHYRSRPGEGWQSGHFEGVFLQCKEKSVTTTKLLDGTHQQHGFLSLTYTKAVTKNVRHKLTSRNERRSFHKLSEGLMDGSPHFLHEILLSAQAFDIVLYFPLLNAIASIFQAKLPKTQKEKRKSPGQPMRTHTLTSRNLPLIYVNTSVIRIFI

SEQ ID NO: 920799 - protein, 283 aa, Homo sapiens
MGCTHSPTSPNEKNQGDSIQAGEESPFSDSVTLEQTTSNIGGTSGRVSLWMQWVLPKITIKLFAPDPENKGTEVCMVSELEDLSASIDVQDVYTKVKCKIESFNIDHYRSSLGEECWSLGQCGGVFLSCTDKLNRRTLLVRPISKQDPFSNCSGFFPSTTTKLLDGTHQQHGFLSLTYTKAVTKNVRHKLTSRNERRSFHKLSEGLMDGSPHFLHEILLSAQAFDIVLYFPLLNAIASIFQAKLPKTQKEKRKSPGQPMRTHTLTSRNLPLIYVNTSVIRIFI

SEQ ID NO: 920800 - protein, 152 aa, Homo sapiens
MGCTHSPTSPNEKNQGDSIQAGEESPFSDSVTLEQTTSNIGGTSGRVSLWMQWVLPKITIKLFAPDPENKGTEVCMVSELEDLSASIDVQDVYTKVKCKIESFNIDHYRSRPGEGWQSGHFEGVFLQCKEKSVPWGRVLVFGAMWRCLPFLY

SEQ ID NO: 920801 - protein, 161 aa, Homo sapiens
IFQVLSVMASLGYEREFPDCLHFPENNCVAAYGEENSKRFNTRMHMLISDRCWSLGTTERGVTQNVVLSGLSETSVRLLPSPCRLVLTLHTSSAPCCGCLAPVPCLGSRSGWSRTLTHIQLRLTLVPIAHTILEDRDSLFKNMDQVATQWKALLSVPGTQR

SEQ ID NO: 920802 - protein, 99 aa, Homo sapiens
ARGHPVVPLAHTRPLSSPLASLAVSAFRSLAEAEARERSKEDYKTQAGKRGVRKRGGWRERERALLLTPGSVDYELAPKSRIRAHRGKYLQYLPRPRFS

SEQ ID NO: 920803 - protein, 174 aa, Homo sapiens
RSWSGTQLRWQCNAGKLYCMKSLSLPLPPSFTWDINLLLTLHVDSSWNYIIGCPGSPACWLQTPGLLSFHNQDANFGAICIRGIDEDQQSLGTQERSGEVSFSSPWAVARQVVNGVWRFSRWVWLKEGKKEFRSTLQEEGDCKVQAEQEGKARRKHEVVKRILKSSFLPKRKKR

SEQ ID NO: 920804 - protein, 162 aa, Homo sapiens
MLQIASVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFLDGSWEVWSEWSVCSPECEHLRIRECTAPPPRNGGKFCEGLSQESENCTDGLCILV

SEQ ID NO: 920805 - protein, 169 aa, Homo sapiens
SFYLARVLSKGLETNHLVCFPLVGMNPAISRGVVFAGKLVLWHSSWRGHWLHIAADEEQASLFSCTFRDVMSLELGDSLGVKSQSHVGPSIGGLVADEDQTPSLNFLEIYTSQRRLASDQKSTDLVVRDPGHALLPALTGASVAAGENCFLSSLSDWTAHWAQENVTSI

SEQ ID NO: 920806 - protein, 187 aa, Homo sapiens
MAPCSTGLCLSHNLHTTQREPGTAEFVGVNTMSARSPASFTSYWHWQRDFVAPSLGTKAAQRELVPDNQEEKRGNEKETETGCRGQQSREEGTAVHARDSASDQAQQCGACQARAHLEPVARQRRFRPRLSLHTSLRAEGAGSGLASPREGPSQRSRRLKGSLSAARADAEAEPRADTDSTEDKQQH

SEQ ID NO: 920807 - protein, 378 aa, Homo sapiens
LLPSHMQHQSILPVEHFRVTGHRNMLAAVVLSRSEANSILASAEETIQLRGIKIETLPPSLSSHSSPCSHHVKKDMFVSPGASPSLLNYYTECMKMPGCPWKKFTAGAEPSWRTSARTVQKENVGSEPTHRLPTGALPSGAARRGLWSFRPQNGGSTNSLNYAPGKATDTQWQPVKAVERGLLLCKATGAELPKAVGAHPLYHHDLDVRHGVKGDYLGTLRFNDCLTVFQTCMGPFVLDNFSHLEQVYLYNACTSLVSINESVLTRSDEFIRGFPFAELSLLSLLPTYEEGCVCFPFHHDGAFPEASPSLLNLDGTSLLHVLPGVEEKWHRDTSLLGDEKDREAFFIESCQDCSASRSTMKGTRRMNICIFLVHDSST

SEQ ID NO: 920808 - protein, 210 aa, Homo sapiens
MIYLHFCKNKSEVQLITDLSDDIPTKRDKHSVVFFSALIQLCCKFLFSEETPRSMTEIFFPFPFCDVHLSILDACTPELTSHSEHAQHHTLPSSPARTVHSSSCVHPWLSFLFRTAFQAPWTLTLTSYAQKRLWETEVTISGFRMAFFCSRKEPAVPQVLFLVPYSSAPLRIKEVGTVSSLYSYIIESNYFCNLLSSSGYYMNEHSVPFI

SEQ ID NO: 920809 - protein, 187 aa, Homo sapiens
MILLKSKHPDMENLSGKSLLIKSANLLPNKFFPVFERSNPPILDTFGRNEEGTLYAPDWSPTYQSPAFTLHTTILLETTKINLSMLPNLVYVNTRSPGLPDGLTVPANWVNPGLKMATYFSWGPLDSSVVWRYSACRTKVTDDQSWTGGPQKAPSGSQISCQFSGNSWSISGLQEDSALLEEFVAGN

SEQ ID NO: 920810 - protein, 187 aa, Homo sapiens; identical to SEQ ID NO: 920809

SEQ ID NO: 920811 - protein, 332 aa, Homo sapiens
RGANSSGPGASRLFCTMEPEPVQPGMLIDVCKYLGSLQYRVWKKMLASVESADPSASPSQAGSCTLVFSTLPNTSNPPGHRSYWIGDPPPVFILTNMCTTTPFPNKVTLGGTRGWDCRISSGGYSPTPATTPALGHSLHGLGASFDPNTAAGWLSVSDDLTSVTNHGYRVQVENPERFSSAPCLLGSRVFSQGSHAWEVALGGLQSWRVGVVRVRQDSGAEGHSHSCYHDTRSGFWYVCRTQGVEGDHCVTSDPATSPLVLAIPRRLRVELECEEGELSFYDAERHCHLYTFHARFGEVRPYFYLGGARGAGPPEPLRICPLHISVKEELDG

SEQ ID NO: 920812 - protein, 361 aa, Homo sapiens
MSPLPSTLPQGTSCPALPLLLPGRPCAAALFVRHPFPGVPLSFPLTLLIALLSSPLYSSPHSLSSHPQPDLTACKSHPGEMVSLLLGQFPGGPELPGLVDSQQRPGRHGESKTMASEHSAWPAPFLSCLGSQTAQASAFELASPWNLVCNHGANCRTRGREVDGEPFSWQYPEAVLVKRLDSERPERYHTNAVAWRRSGVPLPRDCRRPAAKRVRAPDPRSSPKAMAGHPKERVVTDEVHQNQILRELYLKELRTQKLHTQYHVNPLRKVHRITRKPMSWHDNLEEPADARFLNLIHHAAQGPTKKYPEAQTENQEIGWDSEALVDPERRDHRMNHFRVYSDITLYKAKMWSLGEDDRHND

SEQ ID NO: 920813 - protein, 248 aa, Homo sapiens
KAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQQPVVAVPLVMPVCRRKEDEVSIGSAPLAKQQSYQASEYASSPVKTKTVTESRPLSVPVKAMLNISESCRSPEERMKEFIGIVWNAVKHLTLQLEVQSCCVFIPNDSLPSPSTIVSGDIPGTVRSWYHGQTSMPGTLVLCLPQIKIISAGH

SEQ ID NO: 920814 - protein, 190 aa, Homo sapiens
KAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQQPVVAVPLVMPVCRRKEDEVSIGSAPLAKQQSYQASEYASSPVKTKTVTESRPLFVPFQWNEQAPLEGYEAPPGPLSFKLWLVVFWRAVLLI

SEQ ID NO: 920815 - protein, 142 aa, Homo sapiens
KSCVDSKMLLVGLQNHYDVGLAKVLNLWAVDQFHSMACYELGHTKGGAVLLCSIQGLAVNIDPILYTWLIYQPQKRTSRHMQQQPVVAVPLVMPVCRRKEDEVSIGSAPLAKQQSYQASEYASSPVKTKTVTEITTDAEYLL

SEQ ID NO: 920816 - protein, 172 aa, Homo sapiens
KAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQQPVVAVPLVMPVCRRKEDEVSIGSAPLAKQQSYQASEYASSPVKTKTVTDLPPSLYFEPMYVSAREMGFLNTAH

SEQ ID NO: 920817 - protein, 146 aa, Homo sapiens
MLIVSTSMFPHPHLQSSCICPRVYLVSPPKSSRGFSSHPESSLKNNHYLHGPARCGSGRHLGLSSQSTFPSHRAPAARCAPPYSYGIPNPLSTGALLFPVPGAHISNILTGRTAGSSSKADRLFIPGGPLKGSVIAGGQGQLCRCL

SEQ ID NO: 920818 - protein, 108 aa, Homo sapiens
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKGD

SEQ ID NO: 920819 - protein, 139 aa, Homo sapiens
MHPDPVPSAPATPNLLPVSVDLSTSVDVSCRQARHYLASFAVLVAITFLQCQCLLGILLASLGRFQREAALATAAPASSITTCLLHHHLPVTWESGPLPWRWGQTSAKVTQEPARAWEFSLMTRRQQVNILRLTLLGIR

SEQ ID NO: 920820 - protein, 140 aa, Homo sapiens
NIRTMTFKGNQSISSDVDRFVNLVLNVNTVFIMFLLQRSKKQGHQLILRKGEMLKVEEKGMSLCPQLIKQRRKSKTNSVKENVNNKVITGGTSRQQSGITTRSCNVTNQNLMNFFLQSRNSIRFDPRRGELQHMKQIRLE

SEQ ID NO: 920821 - protein, 155 aa, Homo sapiens
MNLFIYLIDFFFFLRRRQSTYLSSKITGRVFQSPSMSRHSAGSGGMLVRYSEFRISRDSWLCVCILGSTWQGSSARVVQTAEAAAGRSRALFESGLYVGNEEAVKTNGPRRATASSIFGAAFRLCLASGPLPWLLPPPVMHCPPGLLPTLRPQFT

SEQ ID NO: 920822 - protein, 722 aa, Homo sapiens
MHQTLCLNPESLKMSACSDFVEHIWKPGSCKNCFCLRSDHQLVAGPPQPRAGSLPPPPRLPPRPENCRLEDEGVNSSPYSKPTIAVKPTMMSSEASDVWTEANLSAEVSQVIWRRAPGKLPLPKQEDAPVVYLGSFRGVQKPAGPSTSPDGNSRCPPAYTMVGLHNLEPRGERNIAFHPVSFPEEKAVHKEKPSFPYQDRPSTQESFRQKLAAFAGTTSGCHQGPGPLRESLPSEDDSDQRCSPSGDSEGGEYCSILDCCPGSPVAKAASQTAGSRGRHGGRDCSPTCWEQGKCSGPAEQEKRGPSFPKECCSQGPTAHPSCLGPKKLSLTSEAAISSDGLSCGSGSGSGSGASSPFVPHLESDYCSLMKEPAPEKQQDPGCPGVTPSRCLGLTGEPQPPAHPREATQPEPIYAESTKRKKAAPVPSKSQAKIEHAAAAQGQGQVCTGNAWAQKAASGWGRDSPDPTPQVSATITVMAAHPEEDHRTIYLSSPDSAVGVQWPRGPVSQNSEVGEEETSAGQGLSSRESHAHSASESKPKERPAIPPKLSKSSPVGSPVSPSAGGPPVSPLADLSDGSSGGSSIGPQPPSQGPADPAPSCRTNGVAISDPSRCPQPAASSASEQRRPRFQAGTWSRQCRIEEEEEVEQELLSHSWGRETKNGPTDHSNSTTWHRLHPTDGSSGQNSKVGTGMSKSASFAFEFPKDRSGIETFSPPPPPPKSRV

SEQ ID NO: 920823 - protein, 639 aa, Homo sapiens
PPVHLLSHLSNSIEQPVNSVQGKFVEAVVWFMLGLGGPSSELAHSPTNSGKKLFAPVPFPSGSTEDVSPSGPQQPPPLPQKKIVSRAASSPDGFFWTQGSPKPGTASPKLNLSHSETNLSKAVATGFRQQGWRATEAAAGALASSAKGPPSASSSQLSVSSQASTGSTQLQLHGLLSNISSKEGTYAKLGGLYTQSLARLVAKCEDLFMGGQKKELHFNENNWSLFKLTCNKPCCDSGDAIYYCATCSEDPGSTYAVKICKAPEPKTVSYCSPSVPVHFNIQQDCGHFVASVPSSMLSSPDAPKDPVPALPTHPPAQEQDCVVVITREVPHQTASDFVRDSAASHQAEPEAYESARVLPASATLQRAGAPEGARRSSIRDLCLENLLLVHCTLQAGPGPAPAPAPAPAAAAPPCSSAAPPAGGTLSPAAGPASPEGPREKQLPRLIISNFLKAKQKPGGTPNLQQKKSQARLAPEIVSASQYRKFDEFQTGILIYELLHQPNPFEVRAQLRERDYRQEDLPPLPALSLYSPGLQQLAHLLLEADPIKRIRIGEAKRVLQCLLWGPRRELVQQPGTSEEALCGTLHNWIDMKRALMMMKFAEKAVDRRRGVELEDWLCCQYLASAEPGALLQSLKLLQLL

SEQ ID NO: 920824 - protein, 154 aa, Homo sapiens
MTHKHMHASLATAPAICSGRLLSPCSNSTALNVPIINPYASSSSTSLTRKMSPDVTNVSWGQNHPHENYSLERTCTLGKEVPYTPVMIEEKEGSWVTKDALHYSQGNNNSLQYKLWKSTEKAQKHASWAFSCCEAQMRKVFMKRLCKFKCYIKI

SEQ ID NO: 920825 - protein, 154 aa, Homo sapiens
SISPFMALNSLEKHSYATRQFLVKNETECGRGILKALIPSSDVRRKARPDSWEIQRLGASAQKAHKDRDHIGLNPISDRGSQHACWMSEPADSDNVNHTLESQRVFGAFTKWQEVQSGCWALNVRVFRFETLRIRWGLCPKRLFSMPKTLDFIH

SEQ ID NO: 920826 - protein, 193 aa, Homo sapiens
EYFKRINESAKADVCVCVCVCGASLSVRMPDPLLWPLSQACAVNAPVLTTSSAQRPQEHGSRKATTILMSQGKATLSDSKINTSSEGDPLSHSKGHSPKLEGTLRKQDLMQKSTQALNAGLGTICAEDPCILVLGTWECGIDSRYPSAVHLELLILGKCYAQAIVCSFAMMYLQNEDEFWGPEHQSWCDEREK

SEQ ID NO: 920827 - protein, 345 aa, Homo sapiens
MPSFVQDFLMETFIMFKDLIGKNVYAKDWMVMNMTQNRVFLRAINQFAEVLTRFFMDQASFELQLWNNYFHLAVAFLTHESLQLETFSQAKRNKIVKKYGDMRKEIGFRIRDMWYNLGPHKIKFIPSMVGPILEVTLTPEVELRKATIPIFFDMMQCEFNFSGNGNFHMFENELITKLDQEVEGGRGDEQYKVLLEKLLLEHCRKHKYLSSSGEVFALLVSSLLENLLDYRTIIMQDESKENRMSCTVNVLNFYKEKKREDIYIRYLYKLRDLHRDCENYTEAAYTLLLHAELLQWSDKPCVPHLLQKDSYYVYTQQELKEKLYQEIISYFDKGKAGLNESLTTQ

SEQ ID NO: 920828 - protein, 591 aa, Homo sapiens
SQDFMTCSMEMSKELSTSLSSLPACSEPLNLKLAMTIKRFHAKSFFLAIKEQIYQSKGQRKVFDLPFGSCLFRSDVYDNGSSFLYDNCTACTCRDSTVVCKRKCSHPGGCDQGQEGCCEECLLRVPPEDIKVCKFGNKIFQDGEMWSSINCTICACVKGRTECRNKQCIPISSCPQGKILNRKGCCPICTEKPGVCTVFGDPHYNTFDGRTFNFQGTCQYVLTKDCSSPASPFQVLVKNDARRTRSFSWTKSVELVLGESRVSLQQHLTVRWNGSRIALPCRAPHFHIDLDGYLLKVTTKAGLEISWDGDSFVEVMAAPHLKGKLCGLCGNYNGHKRDDLIGGDGNFKFDVDDFAESWRVESNEFCNRPQRKPVPELCQGTVKVKLRAHRECQKLKSWEFQTCHSTVDYATFYRSQYQTYLPAVDLGHRIGQALGSLGHNERPGDELCLCGSNWGKFFIPCAYEIPAMGFFPNSTHILEEIVATDLNPFWNKLENNIFTQQVLMRLDEVSLVNPRWNDQGVSFSSSHHQQGLVALVRTGLSAVVSGRPLKNQDIHLGARTPCKQEDLGWVSSEVALCGLVSIRPHTDWLEL

SEQ ID NO: 920829 - protein, 545 aa, Homo sapiens
LAHDSSAAQMLGQRKVFDLPFGSCLFRSDVYDNGSSFLYDNCTACTCRDSTVVCKRKCSHPGGCDQGQEGCCEECLLRVPPEDIKVCKFGNKIFQDGEMWSSINCTICACVKGRTECRNKQCIPISSCPQGKILNRKGCCPICTEKPGVCTVFGDPHYNTFDGRTFNFQGTCQYVLTKDCSSPASPFQVLVKNDARRTRSFSWTKSVELVLGESRVSLQQHLTVRWNGSRIALPCRAPHFHIDLDGYLLKVTTKAGLEISWDGDSFVEVMAAPHLKGKLCGLCGNYNGHKRDDLIGGDGNFKFDVDDFAESWRVESNEFCNRPQRKPVPELCQGTVKVKLRAHRECQKLKSWEFQTCHSTVDYATFYRSQYQTYLPAVDLGHRIGQALGSLGHNERPGDELCLCGSNWGKFFIPCAYEIPAMGFFPNSTHILEEIVATDLNPFWNKLENNIFTQQVLMRLDEVSLVNPRWNDQGVSFSSSHHQQGLVALVRTGLSAVVSGRPLKNQDIHLGARTPCKQEDLGWVSSEVALCGLVSIRPHTDWLEL

SEQ ID NO: 920830 - protein, 144 aa, Homo sapiens [sequence omitted]

SEQ ID NO: 920831 - protein, 228 aa, Homo sapiens
NVSFCFCSKMVLIQLYSPQSLLQSLFVSMNLKCKESVPGPNGELGCYFSQPNNKMQINSGGREFLFLQPVIGRSPGNYRQTNLKLQSFPELIYLPSYMFMYPLSAAEKVQPAISIGLLILQALLPAFSPTKLARLTDSKLTCAKKELLRELSRKCLEMGNMSKTTKKKGTVPSLIKMLLGLEKCINVGVCGSFLMDTVLISQDPPSHEDFPLSLCRALLSDPSQECIF

SEQ ID NO: 920832 - protein, 166 aa, Homo sapiens
TTLFNLPNSQYAKEIAGTGTMWVINQCFLTVGSHGHNSCSSERSGINNSDSRKGVRKKTSGGENIAGRQIICIKEHDAFQKCQVIKYLWNVVSYRVDPASYRVDEYKAGEGSRSQYLGHVTNISCFYAPISDFLLKLFHSYYCPQGLTELVVSNKLFMIVMKQESL

SEQ ID NO: 920833 - protein, 144 aa, Homo sapiens
MVSKDTESLSYGSAKGGDAQSSVLHKDSLLLAKVSYAIMPPTEEEGTKTEKVEPVPQFPSKWTHCYGNCPPTVDKMELVSRKGSYLAHYFWLCEKHGACIRSLLGLHKPSVIVESQVGAGISRGKSGARGCKEVPDSFKQLHVV

SEQ ID NO: 920834 - protein, 156 aa, Homo sapiens
AITFRGASARWGPMALLRIFLLREFGDVPLREAGGSLSETPDEDLEYPQSCVQGNAWKLQRSLLLKRKGQSETYKKNMCRELRAVGWGLLEEVGRWGEAPPSELGAWGVGARGGLERMECVGRAVLVPRALGFLPWQTPQRLRCGRLGGGGPKSSL

SEQ ID NO: 920835 - protein, 176 aa, Homo sapiens
VMAVCPWVPLCPPPTPNRMLFLPSVNMHNTLHLFPGKYQFHLVFEDARINVMAVHEERTGEYELTAKSTVISHCDSVVENANTISGCTYKSASPERRGHCLMVLSDASSVGDLINVVTVFFRPGPHLLLINILNHTFTSAITVSGTTIFGVKMGSTTIPRNLHVFLGIFMNLLPLG

SEQ ID NO: 920836 - protein, 409 aa, Homo sapiens
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFLFYVVILVTRYLIFFKCKDKVEFYRKLHAVAASAGMWTLVIVIVVPLVVSRYGIHEEYNEEHCFKFHKELAYTYVKIINYMIVIFVIAVAVILLVFQVFIIMLMVQKLRHSLLSHQEFWAQLKNLFFIGVILVCFLPYQFFRIYYLNVVTHSNACNSKVAFYNEIFLSERVGPLDDGEVHKGALLMELAEKPLIGVLEKAVQGEKLHLRPCWASAQGTECLWKLLSEGQGWLSTRRPHALRALGRSLLRESRYQSQGEKPILPQVLLQRLVMMKISLASHPLCEETNPRWRLTLTENHCECLERGF

SEQ ID NO: 920837 - protein, 184 aa, Homo sapiens
MFGIQDTLGRGPTLKEKSLGAEMDSVRSWVRNVGVVDANVAAQSGVALSRAHFEKQPPSNLRKSNFFHFVLALYDRQGQPVEIERTAFVDFVENDKEQGNEKTNNGTHYKLQLLYSNGVRTEQDLYVRLIDSVTKQPIAYEGQNKNPEMCRVLLTHEVMCSRCCEKKSCGNRNETPSDPVIIDR

SEQ ID NO: 920838 - protein, 184 aa, Homo sapiens; identical to SEQ ID NO: 920837

SEQ ID NO: 920839 - protein, 389 aa, Homo sapiens
MADPRDKALRDYRKKVLEHKEIDGRLKELREQLKELTKQYEKSENDLKALRSVGQIVGEVFKQLTEEKFIVKATNGPRYVVGCRQQLDKSKLKPGTRVALDMTTLTIMRYLPREVDPLIYNMSHEDPENVSYSEIGGLSEQIRELREVIELPLTNPELFQRVGIIPPKGCLLYGPPGTGKTLLARAIASQLDCNFLKVVSSSIVDKYIGESAHLIREMFNYARDHQPCIIFMDEIDAIGGRRFSEGTSADREIQRTLTELLNQMDGFDTLHRVKMIMATNRPDTLDPALLCPGRLDRKIHIDLPNEQTRLDILKIHAGPITKHGEIDYEAIVKLSDGFNGADLRNVCTEAGMFAIRADHDFVVQEDFMKAVRKVADSKKLEAKLDYKPV

SEQ ID NO: 920840 - protein, 333 aa, Homo sapiens
YLKTLSEEIAFFCNLRSQQKNLVILVAGDMEEDSLYLGGEWQFNHFSKLTSSQPDAAFPEIQRTSLPEKSPLSSETRVDLCDDLAPVTRQLAPREKLPPSSRRPAAVGAGLQNMGNTCHLNASLQCLTYTPPLANYMLSWELSQMYTFDPYLDIALDIQAAQSVKQALEQLVKPEELNGENAYHCGLCLQKAPAAKTLTLPTSAKVLILVLKRFSDVTGNKLAKNLQYPECVDMQPYMSQQNTGPLFYVLYAVLVITGWSCHNGHYFSCVKLKKASGIKWMMPRSLPLVSLLLRVNRPMSSFTSRRMNLEDPVTGCPQAENQELFVLKTIELW

SEQ ID NO: 920841 - protein, 413 aa, Homo sapiens
GSGNMAKDAGLIEANGELKVFIDQNLSSGKGVVSLVAVHPSTVNPLGKQLLPKTFGQSNVSIAQQVVIGMPQRPAASNTLVVGSSHTPSTHFASQNQPSDSSPRSAGKRNRKGENCKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLRELILQQIAFKNLVQRNRHAEQQASRPPPPNSVIHLPFIVVNTSKKTVIDCSISNDKLEYLFNFDNTFEIQGDIEVLKRMGMACWLESGSCSAEDLKMARSLVPKALEPYVTEMAQGTVGGVFITAAGSTSKGTRFSASDLTNGADGMLATSSKRSQYSGSRVETPVSYVGEDDEEDDDFNENDKDD

SEQ ID NO: 920842 - protein, 165 aa, Homo sapiens
RKTMVCLGAFAGVGCLSTGFWGTRMVSGTINQDRKSGRRGSELEGKSSFLDLLNVNACAALKKRLVLDIQCPALETRGKERSCLVNPLSVLATSQRHLAYQPQRLLAPFSQPAQREPGVTEGSVDLGDRNRLTLLPDVCASGTVLADGNPASESACAGREAEPKP

SEQ ID NO: 920843 - protein, 155 aa, Homo sapiens
MITFCQIHSLTLHIAGAHQLLFDVHPSGGKQEPHGANCIVGKPTESAQGSLSSPALPATLPSSPHQSSEVRSGFPEREPHGLLCFSSLTSSLPPCLCSPPPCSLLALGLRTNRSPGEHRVADLLVVSCWCLSITSLKSISLWSASSEHHPAVTPR

SEQ ID NO: 920844 - protein, 36 aa, Homo sapiens
MVLDVRVKGAEEGIQVRRWRGHSLTRLHECRPGEDS

SEQ ID NO: 920845 - protein, 131 aa, Homo sapiens
QANFKESPSWIPPGGMEKTYSPIDKQGHLCKCSGGLCTGRRDLNHPIKTVSDLGLTLDATSAKLYTSTVAHNIKLDQVPELDVVGQGDLVDIGSLLYGGHPTVSCNDDAEVLCRLCFSVAPTRYPMVLSIC

SEQ ID NO: 920846 - protein, 313 aa, Homo sapiens
MGCGYCCVFRQNQRFLGLRCCIHLLSPCILRWSHLRIHSNSLPEGDKKNQREQVSYTDKSWAYFINSHNSYCLSSKEQKGIYGQCHIFENLNYKDTALCGGGENTKDLKVFKKENVESVPIGNSTMMIIFLKAACPEFVPSDARMCSEFLPSGGFVVSLASGVKLQTFKVSVTTLKVGRLELFVPPGGFIVSLASGVKLQTFENPVMFSDMEVFWKLLLLVDVEVTVRILQCLVKGFLLPQLGQGHPKATVAHNIKLDQVPELDVVGQGDLVDIGSLLYGGHPTVSCNDDAEVLCRLCFSVAPTRYPMVLSIC

SEQ ID NO: 920847 - protein, 244 aa, Homo sapiens
WFNPLVLVISQPVRMNFGSLYTKRQQFSCLFQMSVVAPLVGKAPEADPVTQSPTSPVIKVYSKSSQATVLLAYLLVGIQLSLASVELPQECQPAPECPGPWEPALKDAAPTGVYPAPDLSSALQRSRGLSDQCDKNPETPNVQKDSRSMVPNLSGTRDWFHGRQFFHRDATSSSCCSSDFFLTDKRMEVALDMGNRRMEVALDMGNRSRSRSGKSQGLFVQAVQGGLITYQSELDLLSLKTKLL

SEQ ID NO: 920848 - protein, 169 aa, Homo sapiens
MQPGSFCRRLWLPGSFPRAVPHFACMPRNTFSYVSKINMSWAVVTAGHGGDTGDGAGGTEDSSLSWNTQDLSTCSTLGVVHSGNTTSRSNRPPTTASCDVTELVSAAGEDTCLAVATAWHQPAPKGLGAECRPRRRTGSSVLMAVLLNQRGVQKLQCRRKAVSVSPDLR

SEQ ID NO: 920849 - protein, 256 aa, Homo sapiens
NSASFEGDNKKMEDAKFYLTLPGTKMEMEEKELQASKNLVTFTPSKDSTKDSFQIATLICSTKLTQNGLLNWRSNSQNIKHNLKKLMEVDGGEIVKFLQDTLDALFNIMMEMSDSETYDFLVFDALVFIISLIGDIKFQHFNPVLETYIYKHFSATLAYVKLSKVLNFYVANADDSSKTELLFAALKALKYLFRFIIQSRVLYLRFYGQSKDGDEFNNSIRQLFLAFNMLMDRPLEEAVKIKVSLAASWVTLLRLW

SEQ ID NO: 920850 - protein, 144 aa, Homo sapiens
MSDTEDRRFLHFQMRYLVHLSGECQKVGAGQWVQCTEHEPKQVKERGDRWHLENRVTLTLILCFSNSLSKWHTRRLYPAPGSEGPTFTEPHLLLAQQSEIKLQGGSKAGRGATAIAWASVGKQSGWEARTGWSPLQLKEACLPL

SEQ ID NO: 920851 - protein, 863 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKAVAGKMDLKDRAVKRVPWPCIGGLISNLRAKPSELMAKLKTGDDMDGFHPSLDYIQDYVNIYGLKMEEEVSRIIHYNVEQECNNFLERRSRWQACTVHHIQYQLPGDDSHVWRSQKSRTAKGVYLDLVTNSAGTAYYPGRQDKRYNTTSEQQGPGIPVDV

SEQ ID NO: 920852 - protein, 716 aa, Homo sapiens
MLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKAVAGKMDLKDRACEARAFALHRGTDIQTFEPSQVIDAQAERLGATMDGFHPSLDYIQDYVNIYGLKMEEEVSRIIHYNVEQECNNFLERRSRWQACTVHHIQYQLPGDDSHVWRSQKSRTAKGVYLDLVTNSAGTAYYPGRQDKRYNTTSEQQGPGIPVDV

SEQ ID NO: 920853 - protein, 261 aa, Homo sapiens
MMNMKAFKNCAIVDFFTESSTLLEEGNLSPKTEDTYLPHILSPAVFGGPGTNFKMPGRSSSNSGSTGFISFSGVESALSSLKNFQACINSGMDTASSVALDLVESQRDKFELGTRFLLSFSLKVLQIIPESMFTSLLKIIKLQTHDIIEVPTRLDKDKLRDYAQLGPRYEVLCPSDFCLFMLKTNSHEISQACVTCHILGTTRPILTCCLTFAMRALASSAVAGEWSHDAPPCSQPLRSCDRLGSQGRKSGSDPLQVRDCG

SEQ ID NO: 920854 - protein, 845 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKAVAGKMDLKDRAVKRVPWPCIGGLISNLRAKPSELMAKLKTGDDMDGFHPSLDYIQDYVNIYGLKMEEEVSRIIHYNVEQECNNFLERRSRWQACTVHHIQYQLPGDDSHVWRSQKSRTAKGVYLDLVTNSAGTAYYPGRQDKRYNTTSEQQGPGIPVDV

SEQ ID NO: 920855 - protein, 137 aa, Homo sapiens
MGRMEGASLGAAALGAGTRLGGGASLRAHSSAFAADLCQQAAASPGPGLPLGSGKKSYANPGSSPNTLQHKASATFTYSNSMQGSRQNMNSQRLIVSLEKKGYENYFYVPVTYSCFKRVKPKEIKKIPILVESYAKN

SEQ ID NO: 920856 - protein, 147 aa, Homo sapiens
MVLGAGDVATVSKGRVSVSSVELVCCHHRYFEKCKGRPGVAPVHTDLNLASRRMKGTVGAVGQLPPEKTSVFSSGFMVPRWEFRAGELYQYHFKSMESLNIGCSRVAPSSSPAVLAASCVFPFLFGVPGVCFSLSQMLTLLWGSHHI

SEQ ID NO: 920857 - protein, 233 aa, Homo sapiens
MYKECNILVLLVVLKVQQHFEFEYQTKMDGLVTLKHFKTPFLKVEPFLPGHYEVFDLKPNDQVASVVMVKYHHCRDEPPHVLYYNVEKLFPGLGLQLVAATLLKQLKEAQVQYPLQTFVIGMEDSPDLLAARKVANHIGSEHHEVLFNSEEGFQALDEVIFSLETYNITTADASGEADQIMKAVWERKVEEEVEGRQIQKTVVTAGGKGIVSASLRNKEKEYKKEILQLGHWG

SEQ ID NO: 920858 - protein, 147 aa, Homo sapiens
MFPNKQNWDMKWWSVWCLFMKKKGLDCKIFPDDMGICDDMGICDMGIPDDMGIWLCVPTQISSQIVIPMCPRRDQMRSSKPIEDIQTKHWFKDVTPIIHNLFQKLEEEETYCKSFYEFVTYALGDADAGLMGTGSTEITIVIIVCQL

SEQ ID NO: 920859 - protein, 1077 aa, Homo sapiens
MAATASAGVPATVSEKQEFYQLLKNLINPSCMVRRQAEEIYENIPGLCKTTFLLDAVRNRRAGYEVRQMAAALLRRLLSSGFEEVYPNLPADVQRDVKIELILAVKLETHASMRKKLCDIFAVLARNLIDEDGTNHWPEGLKFLIDSIYSKNVVLWEVALHVFWHFPGIFGTQERHDLDIIKRLLDQCIQDQEHPAIRTLSARAAAAFVLANENNIALFKDFADLLPGILQAVNDSCYQDDDSVLESLVEIADTVPKYLGPYLEDTLQLSLKLCGDSRLSNLQRQLALEVIVTLSETATPMLKKHTNIIAQAVPHILAMMVDLQDDEDWVNADEMEEDDFDSNAVAAESALDRLACGLGGKVVLPMTKEHIMQMLQSPDWKYRHAGLMALSAIGEGCHQQMESILDETVNSVLLFLQDPHPRVRAAACTTLGQMATDFAPNFQKKFHETVIAALLRTMENQGNQRVQSHAASALIIFIEDCPKSLLVLYVDSMVKNLHSVLVIKLQELIRNGTKLALEQLVTTIASVADTIEEKFVPYYDIFMPSLKHIVELAVQKELKLLRGKTIECISHIGLAVGKEKFMQDASNVMQLLLKTQSDLNNMEDDDPQTSYMVSAWARMCKILGKDFQQYLPLVIEPLIKTASAKPDVALLDTQDVENMSDDDGWQFVNLGDQQSFGIKTSGLEAKATACQMLVYYAKELREGFVEYTEQVVKLMVPLLKFYFHDNVRVAAAESMPFLLECARIRGPEYLAQMWQFICDPLIKAIGTEPDTDVLSEIMNSFAKSIEVMGDGCLNDEHLEELGGILKAKLEGHFKNQELRQVKRQEENYDQQVEMSLQDEDECDVYILTKVSDILHSLFSTYKEKILPWFEQLLPLIVNLICSSRPWPDRQWGLCIFDDIIEHCSPTSFKYVEYFRWPMLLNMRDNNPEVRQAAAYGLGVMAQFGGDDYRSLCSEAVPLLVKVIKCANSKTKKNVIATENCISAIGKILKFKPNCVNVDEVLPHWLSWLPLHEDKEEAIQTLSFLCDLIESNHPVVIGPNNSNLPKIISIIAEGKINETINYEDPCAKRLANVVRQLM

SEQ ID NO: 920860 - protein, 980 aa, Homo sapiens
MAATASAGVPATVSEKQEFYQLLKNLINPSCMVRRQAEEIYENIPGLCKTTFLLDAVRNRRAGYEVRQMAAALLRRLLSSGFEEVYPNLPADVQRDVKIELILAVKLETHASMRKKLCDIFAVLARNLIDEDGTNHWPEGLKFLIDSIYSKNVVLWEVALHVFWHFPGIFGTQERHDLDIIKRLLDQCIQDQEHPAIRTLSARAAAAFVLANENNIALFKDFADLLPGILQAVNDSCYQDDDSVLESLVEIADTVPKYLGPYLEDTLQLSLKLCGDSRLSNLQRQLALEVIVTLSETATPMLKKHTNIIAQAVPHILAMMVDLQDDEDWVNADEMEEDDFDSNAVAAESALDRLACGLGGKVVLPMTKEHIMQMLQSPDWKYRHAGLMALSAIGEGCHQQMESILDETVNSVLLFLQDPHPRVRAAACTTLGQMATDFAPNFQKKFHETVIAALLRTMENQGNQRVQSHAASALIIFIEDCPKSLLVLYVDSMVKNLHSVLVIKLQELIRNGTKLALEQLVTTIASVADTIEEKFVPYYDIFMPSLKHIVELAVQKELKLLRGKTIECISHIGLAVGKEKFMQDASNVMQLLLKTQSDLNNMEDDDPQTSYMVSAWARMCKILGKDFQQYLPLVIEPLIKTASAKPDVALLDTQDVENMSDDDGWQFVNLGDQQSFGIKTSGLEAKATACQMLVYYAKELREGFVEYTEQVVKLMVPLLKFYFHDNVRVAAAESMPFLLECARIRGPEYLAQMWQFICDPLIKAIGTEPDTDVLSEIMNSFAKSIEVMGDGCLNDEHLEELGGILKAKLEGHFKNQELRQVKRQEENYDQQVEMSLQDEDECDVYILTKVSDILHSLFSTYKEKILPWFEQLLPLIVNLICSSRPWPDRQWGLCIFDDIIEHCSPTSFKYVEYFRWPMLLNMRDNNPEVRQAAAYGLGVMAQFGGDDYRSLCSEAVPLLVKVIKCRNDQVLPALNVCLKG

SEQ ID NO: 920861 - protein, 1105 aa, Homo sapiens
MAATASAGVPATVSEKQEFYQLLKNLINPSCMVRRQAEEIYENIPGLCKTTFLLDAVRNRRAGYEVRQMAAALLRRLLSSGFEEVYPNLPADVQRDVKIELILAVKLETHASMRKKLCDIFAVLARNLIDEDGTNHWPEGLKFLIDSIYSKNVVLWEVALHVFWHFPGIFGTQERHDLDIIKRLLDQCIQDQEHPAIRTLSARAAAAFVLANENNIALFKDFADLLPGILQAVNDSCYQDDDSVLESLVEIADTVPKYLGPYLEDTLQLSLKLCGDSRLSNLQRQLALEVIVTLSETATPMLKKHTNIIAQAVPHILAMMVDLQDDEDWVNADEMEEDDFDSNAVAAESALDRLACGLGGKVVLPMTKEHIMQMLQSPDWKYRHAGLMALSAIGEGCHQQMESILDETVNSVLLFLQDPHPRVRAAACTTLGQMATDFAPNFQKKFHETVIAALLRTMENQGNQRVQSHAASALIIFIEDCPKSLLVLYVDSMVKNLHSVLVIKLQELIRNGTKLALEQLVTTIASVADTIEEKFVPYYDIFMPSLKHIVELAVQKELKLLRGKTIECISHIGLAVGKEKFMQDASNVMQLLLKTQSDLNNMEDDDPQTSYMVSAWARMCKILGKDFQQYLPLVIEPLIKTASAKPDVALLDTQDVENMSDDDGWQFVNLGDQQSFGIKTSGLEAKATACQMLVYYAKELREGFVEYTEQVVKLMVPLLKFYFHDNVRVAAAESMPFLLECARIRGPEYLAQMWQFICDPLIKAIGTEPDTDVLSEIMNSFAKSIEVMGDGCLNDEHLEELGGILKAKLEGHFKNQELRQVKRQEENYDQQVEMSLQDEDECDVYILTKVSDILHSLFSTYKEKILPWFEQLLPLIVNLICSSRPWPDRQWGLCIFDDIIEHCSPTSFKYVEYFRWPMLLNMRDNNPEVRQAAAYGLGVMAQFGGDDYRSLCSEAVPLLVKVIKCANSKTKKNVIATENCISAIGKILKFKPNCVNVDEVLPHWLSWLPLHEDKEEAIQTLSFLCDLIESNHPVVIGPNNSNLPKIISIIAEGKINETINYEDPCAKRLANVVRQVQTSEDLWLECVSQLDDEQQEALQELLNFA

SEQ ID NO: 920862 - protein, 149 aa, Homo sapiens
MVCFAFRSTVILSHNAENWEDIKSHGPHFQNVLKTLPSSSLNRQLVLDTKISYLDYCHSFITNPIILNSSCPPVDTQQKSWNFCTRRDLWVRGKNEPLMEGGNEGKRSREQKGSMSGHSEVVLTFPEASLYKQLDSLVQTNIWIFPETS

SEQ ID NO: 920863 - protein, 89 aa, Homo sapiens
SGKKKGKNACLAKSNHKMVEIKSTLQEGLDFSQLEKGEVRAPVPRRPAEGRAAASERRWRAGLEQDVAEPRAGKSRCCSPAEGKSPSLP

SEQ ID NO: 920864 - protein, 170 aa, Homo sapiens
MGCVYFYNIQPNIKGLEKLLQAYLGDIVGLGPTLSSQPQDCVLIVQWQQHSSSFAYASSSDSAAGYMLISCDRVPVGYWVPASVQVFTTVVETAGFQRAKVSYGSKSSLGRWASLAVLYYRHSHTKSSGLHFSWHEAPTTSLSSQRPVVKVACSLPVQLTSSPGVFKGQE

SEQ ID NO: 920865 - protein, 135 aa, Homo sapiens
MEKCHIRAHVKEYADLHETQQEELGATQCSDINEERSCDEKDEEAPEEVMPAKTATNFILKELLLTSLQDCVQSWFLRWVRGLPDFKNAAVDLSENVKLRPSAVAHACNPSSLGGRGRWITSRRWRDLICVKAMK

SEQ ID NO: 920866 - protein, 134 aa, Homo sapiens
MAVIKKTKTKTKNLAITNVGKDVEKLGSSYIAGSYGVGKDVTQLDSELPQGQRKAGHKKQHLIHSVCKTKTSYLREEQHSLSVSPCLSLNAKILLSYTLTSTAELSSFAVVTSAATDIGWFHNAWPHECFMLDG

SEQ ID NO: 920867 - protein, 94 aa, Homo sapiens
SQAHFSAHILYHFGAPQAGSQMAIPCVSVRAAYCALSMNMTGQKCAWVRIQGSSGSLTVVCTCVWGLSVSFTSGSLTVVCRCVVFCLYPSLLVV

SEQ ID NO: 920868 - protein, 157 aa, Homo sapiens
ASLQLKLKMKSQQPTVVEETVREDASSPGAYGFLLTEELQVAGDVTPGSLPRGGNQSWAWKDDRQQGGDGEQPTSSQRSEEEENCQGNKAFRGQITKDLHWDQANPCNQRVEGLKQKAETMVVLRCVEQKVIPGQAHGPEEYLSPSSELFSDASINS

SEQ ID NO: 920869 - protein, 143 aa, Homo sapiens
MRKPQGGALCATKRFFAWRPVFVEPLSALCLGHEAGCQSFLLLWIRFGSVKAWPTIKTNTLQTRRRIPQELFVLQESSGPTSEKMLESFHGSSLRNEATPRYSQQEETGNERWQQSLSLERWPPWTSHPFGTPPLMPLAVARC

SEQ ID NO: 920870 - protein, 157 aa, Homo sapiens
MRMREARAVSPVTVVPTVVLETRPRGLAEQEPSVAVLGCRGSEAPASPLHGVEGNVSGCQESQRADHDDETPGRDGGSSTGSQPQACTDGVGWETRSHYIDQAGLELLALSDPPALASQSAGVTDVSLCAQSILGCSSVEPRMLRNVDTKDEVGTEV

SEQ ID NO: 920871 - protein, 122 aa, Homo sapiens
ETSPRGLAKQEPSVAVLGCRGSEDPASPLHGVDGNVSGCQESQRADHDEETPGGDGGSSTGSQPQACPDGVGWETRSHYIDQAGLELLALSDPPALASQSAGVTDVSLCAQSILGCSSVEVM

SEQ ID NO: 920872 - protein, 138 aa, Homo sapiens
MSTLQPRTRAPEELFVPQESSGSTPEKMLVSFHGSSLRNEATPRYSQQEEAGNGRWQQSLSLERWPPWTSHPLGTPPLMSVAVARCCILPGLWPLLSPPSGSASPVSQGPGCLSLWPNAFKKDDFPVRQGDTSWRSVS

SEQ ID NO: 920873 - protein, 1358 aa, Homo sapiens
AQLLESNAPIHMENLPFPLKLLSASSLNAPSSTPWVLDIFLTLVFALGFFFLLLPYLSYFRCDDPPSPSPGKRKCPVGRRRRPRGRMKNHSLRAGRECRRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSLPPPKGFTAPPLRDSTLITPSHCDSVAFPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGEGSKEAQKVKFQLERDPCPHLGQILGETPQNLSRDMKSFPRKVLGVTSEELERNLRKPLRSDSGSDLLRCTERTHIENILKAHMGRNLGQTNEGLIPVCVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSIQQSRSLGAQSSKAGETREAVPQCRVPLETCMLANLQATSEDVHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSPFGENIKQIFQWIFSKKKSKPAPVTAESQKTVKNRSRVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 920874 - protein, 1298 aa, Homo sapiens
AGMKPWWARDWALPSRGQCVCPGETNACLDAEGAGRECRRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSLPPPKGFTAPPLRDSTLITPSHCDSVAFPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGEGSKEAQKVKFQLERDPCPHLGQILGETPQNLSRDMKSFPRKVLGVTSEELERNLRKPLRSDSGSDLLRCTERTHIENILKAHMGRNLGQTNEGLIPVCVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSIQQSRSLGAQSSKAGETREAVPQCRVPLETCMLANLQATSEDVHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSPFGENIKQIFQWIFSKKKSKPAPVTAESQKTVKNRSRVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 920875 - protein, 235 aa, Homo sapiens
SVDLGSLKNCSSSLLLIHNMVSGLGECVSAVFVLHLFQFCHSVGPKFLYHIQEELAAMDGPRRSTTSSHCGPWISLGTGSLASRLQAIPGLKVGLHWGPTPFHSGTCLPPLLMPSTCFPWHPGCLSKEMPAGWHQDTLSPLQPPSHALQHPNSRGSQGGRGLVCQCFPKHGTLGWFVTGSVLHLNFAPESELVLGAGRGQAVEEGTSEPVGAVELPGTPRAQRCLSPEPWLGSCS

SEQ ID NO: 920876 - protein, 384 aa, Homo sapiens
AATSDAQAMSHTSRVGDLFLLGPSFLWRLQSVECCECASYIWAQRAPGRKESSSPGEEGADLFTPFVSVEKKFSWLSKRQDWHQFHELRKQFVEKSSCAQPLGELTSLDAHGEFGGGSGSSPSSSSLCTEPLIPTTPIIPSEEMAKIACSLETKELWDKFHELGTEMIITKSGRRMFPTIRVSFSGVDPEAKYIVLMDIVPVDNKRYRYAYHRSSWLVAGKADPPLPARLYVHPDSPFTGEQLLKQMVSFEKVKLTNNELDQHGHIILNSMHKYQPRVHIIKKKDHTASLLNLKSEEFRTFIFPETVFTAVTAYQNQLITKLKIDSNPFAKGFRDSSRLTDIERHFMHTAKFPSGKVVHSSYHSFTSLSDMIVVFSSLPVSFLL

SEQ ID NO: 920877 - protein, 378 aa, Homo sapiens
RAAPSVLGPAASVLSMPGFFCDCWPSLEIRALLYAMGCIQSIGGKARVFREGITVIDVKASIDPVPTSIDESSSVVLRYRTPHFRASAQVVMPPIPKKETWVVGWIQACSHMEFYNQYGEQGMTSPGQGIAAALIHLPSTGNKHWRPRSPEASTDCCWLHQATGSGSVTQAGVQWYDLGSLQPLPPRFKRFSCLSLPSSWDYRSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 920878 - protein, 170 aa, Homo sapiens
GSMVEGATWGQRELFKALIFWVPCQALVGPPVAEALQGLARLHHVAEANSTSAQERPSTPAGRLPPHLLGARQHRGPRSARAQGPNRAQPPDAPRGHRVGLSRACAARPLPGSTGGVKAGTWRRLRMRGLGPSRRLRAGLGEAGSGGAVVRWDRVGPGRAAEEVGTLSCR

SEQ ID NO: 920879 - protein, 134 aa, Homo sapiens
MSRRLEADNLSQFTLQNVAPLLRVKLIKVGELNELMFMTRSLLPSAPSSCLAQAGNRPPCGFPVPLAFHYGVPTQLPGGSFETCQARLWAVFDAFLSFSPNRICAYEQRGVSAHPGPEVAPGLQQVLTASLWRA

SEQ ID NO: 920880 - protein, 209 aa, Homo sapiens
MGSTSSSSTSQNSRLGFLREPSSSQAWPILSGQGPSSVPHSPELPEDRGCSLLQVPAPPADPGSAVTAGPTLEAASVIRAPERTWPQEKPQAGDCAHCPLHPSAGQSHMLGAGPFPLSSRSVALPGTGLSTIEMRPPEVGLLHAWPREEESCAESRGRQQGWLLSCPYPAHSGQVTSSSLVCSNPACLHLPLLVSGTSKDVRSQGRFAV

SEQ ID NO: 920881 - protein, 414 aa, Homo sapiens
FKLQAGSALAGARLARVPDSSLFSSSSINTTLSYSPFKPSMSLNFHGHGTDKDPVFSRTKEKVENSPGGARAMRNILAGPRPNRLTAGNSSFITSCPAATHTAPPLLSGPTTAPVCKRGLGSSAVWPQPSPVVYSFTTHELAPGDWQTLVPGTSHWLSRLMLEHCGTVNSDSWNCYQATTASSNDLAIPSTDVSNMFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVNIFTIPPTFISYYLKSNWLGLRFLRALRLLELPQILQILRAIKTR

SEQ ID NO: 920882 - protein, 213 aa, Homo sapiens
MAELPRRRPLTRSGLTSLFFIPIGPFVYSLSFLSFAVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEESKSSGFPRAS

SEQ ID NO: 920883 - protein, 196 aa, Homo sapiens
MDGSEYSLVSGAEPRSPSGTWKMLCGCKEPLVASPSLRCLDQRDSLQWKGLSLAGTFPHLTGLLFRGSPGHGTQCARPCAPIRRGTRGSHGAGVRRGSHRRARVRRWPRLQGFFRGLAFLMADETGAVGKGFPTVRAFVGLLPGVRLLMFQEIGAAVKGFPALPAFEGLLSRVSPLVFGDVRAVPEGLAALGTLEG

SEQ ID NO: 920884 - protein, 196 aa, Homo sapiens
MDGSEYSLVSGAEPRSPSGTWKMLCGCKEPLVASPSLRCLDQRDSLQWKGLSLAGTFPHLTGLLFRGSPGHGTQCARPCAPIRRGTRGSHGAGVRRGSHRRARVRRWPRLQGFFQRVAFLMADETGAVGKGFPTVRAFVGLLPGVRLLMFQEIGAAVKGFPALPAFEGLLSRVSPLVFGDVRAVPEGLAALGTLEG

SEQ ID NO: 920885 - protein, 155 aa, Homo sapiens
MALQWPEDSEHWGVKLPTVMVLTFEEIWEPSESPAAISRHFRGCFPARFQRVLPCTISEGASLHDFTGCFPARFQRVLPCTISEGASLHDFTGCFPARFHRVLPCTISQGASLHDFRGCFPARTLPHTALPGPGACCTEGGSFSSLSSAFLLLFF

SEQ ID NO: 920886 - protein, 547 aa, Homo sapiens
MKTYSFSMLEITLAHLPPLPLSWHGVRSVYFSNQCLPLIPAGAEGDDHSRVRLTQLEGEPHSDYINANLVPGYTRPQEFIASQGPLKKTLENFWRLVREQQVRIIIMPTISMENGRVLCEHYWLTDSTPDTHGHITIHLLAEEPEDEWTKREFQLQHLLRGCPCGVGMGRTGTFVALSRLLQQLEEEQMVDVFHAVYALRMHQPLMIQTLSQYVFLHSCLLNKILEGPFNISESWPISVTDLPQACAKRAASANAGFLKEYEAIKDEAGFSAPPPGYEQDSPVSSPMLIMSLPQGESRKEREVQRLQFPYLEPGHELPATTLLPFLAAVGQCCSRGNNKKPGTLLSHSNKGATQLGTFLAMEQLLQQAGSECTVDIFNVALQQSQACGLMTPTLIGAGGASLLTLCPSPEAVCLPLQLSEQRAGRRAALSQHWSRCRRVEPPGRSPPTAQPAGTGRKQLRTPRPCVCAPGRQVTQQPGRRDAQPAQAPGAVTSRRCVRLPERRLRPPARPGAYRLPGPLPLPGGRHHAVCRLLLSLGCPPYRGTWIP

SEQ ID NO: 920887 - protein, 547 aa, Homo sapiens; identical to SEQ ID NO: 920886

SEQ ID NO: 920888 - protein, 307 aa, Homo sapiens
MLLPTALFSAHTGSPGSLCLRDAAAAAAAAPAVGRALAQDARFRLEMPESVTVQEGLCIFVHCSVFYLEYGWKDSTPAYGHWFREGVSVDQETPVATNNSTQKVQKETQGRFHLLGDPSRNNCSLSIRDARRRDNGSYFFWVARGRTKFSYKYSPLSVYVTALTHRPDILIPEFLKSGHPSNLTCSVPWVCEQGTPPIFSWMSAAPTSLGPRTLHSSVLTIIPRPQDHGTNLICQVTFPGAGVTTERTIQLSVSWKSGTVEEVVVLAVGVVAVKILLLCLCLIILSFHKKKAVRAVEVEENVYAVMG

SEQ ID NO: 920889 - protein, 872 aa, Homo sapiens
LWLLDHTSDSPGQMIKNAGFGTRPIPMELVWSLGPGVCMSNKRPWGYQGTPKFKRVCCCCSALRPRYKRLVDNIFPEDPKDGLVKTDMEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 920890 - protein, 785 aa, Homo sapiens
MEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 920891 - protein, 692 aa, Homo sapiens
MEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVNKTTEDSQV

SEQ ID NO: 920892 - protein, 146 aa, Homo sapiens
DLEDPPSRIPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 920893 - protein, 785 aa, Homo sapiens; identical to SEQ ID NO: 920890

SEQ ID NO: 920894 - protein, 491 aa, Homo sapiens
MEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKIR

SEQ ID NO: 920895 - protein, 421 aa, Homo sapiens
MEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKPQKGYRA

SEQ ID NO: 920896 - protein, 890 aa, Homo sapiens
PGEEWAGGGSCRPLGCVTAGSASAPSTLRPSPFASFRPPRPSNGRHGAVGAPCAAPLSLGAAASAVEIAMPTRVCCCCSALRPRYKRLVDNIFPEDPKDGLVKTDMEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 920897 - protein, 208 aa, Homo sapiens
MNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKPQKGYRA

SEQ ID NO: 920898 - protein, 785 aa, Homo sapiens; identical to SEQ ID NO: 920890

SEQ ID NO: 920899 - protein, 785 aa, Homo sapiens; identical to SEQ ID NO: 920890

SEQ ID NO: 920900 - protein, 785 aa, Homo sapiens; identical to SEQ ID NO: 920890

SEQ ID NO: 920901 - protein, 136 aa, Homo sapiens
DHVVHRAKMKALALENGFCGTRGIPVGYPEVPWCQQRLLLGEKRELLRVAGSWKSTEKPQPQLYAASDCFSAASEAKGRRKGNAISSEWQYFVFSNPIQVVTVAKRKNRPTCRMDKNPDYYPNECQLAELNSSPDF

SEQ ID NO: 920902 - protein, 157 aa, Homo sapiens
MGALEEPFSPLLYWRCGGRGASGNRCCARRLRASWSSGWAWAWRAPHWEQPTGPAGPGNEGLSTWASGCGGCTGSPSSASPPALRSISHRALAAFPRGRARDLQPAMPEPPTHSMGSCAARASLMSATPCSTAPSPIDHPRAEECGRPAPDCSLPYC

SEQ ID NO: 920903 - protein, 186 aa, Homo sapiens
AVACYDPCLSPPQAGWILQAAVAVPWPAGQCSAAWPSSGSAAAREKRKEYCMYYNRFGRCNRGERCPYIHDPEKVAVCTRFVRGTCKKTDGTCPFSHHVSKEKMPVCSYFLKGICSNSNCPYSHVYVSRKAEVCSDFLKGYCPWVQSPEVVSAITSTSQVTQRGPATFPGLHSTNTGRGLNHGKKD

SEQ ID NO: 920904 - protein, 185 aa, Homo sapiens
SDAGSRPLLRTGRLDPAGSCSRSLASRAVQRSLAIIRQRGSAEEKRKEYCMYYNRFGRCNRGERCPYIHDPEKVAVCTRFVRGTCKKTDGTCPFSHHVSKEKMPVCSYFLKGICSNSNCPYSHVYVSRKAEVCSDFLKGYCPWVQSPEVVSAITSTSQVTQRGPATFPGLHSTNTGRGLNHGKKD

SEQ ID NO: 920905 - protein, 132 aa, Homo sapiens
MHVQGKAAWWSCQPDADVDSSTTTKGVGPDPESAPQLGHLVGPGSRAANHHKFQLLERPPVRNLEHLLYLLWPFPGPYPTQGSAQNQFSLESNTPSYFQKYRRGKRAPSSLFRKDIDPRHESSATFQKILTS

SEQ ID NO: 920906 - protein, 156 aa, Homo sapiens
LTREMITLSFRTTRSPSLLLYVSSFYEEYLSVILANNGSLQIRYKLDRHQNPDAFTFDFKNMADGQLHQVKINREEAVVMVEVNQSAKKQVILSSGTEFNAVKSLILGKVLGRSGPADEGEPLVNADRRDSAVIGGNKALNDLVLVIIALDNDTIT

SEQ ID NO: 920907 - protein, 111 aa, Homo sapiens
LTREMITLSFRTTRSPSLLLYVSSFYEEYLSVILANNGSLQIRYKLDRHQNPDAFTFDFKNMADGQLHQVKINREEAVVMVENEYVFKFKTASSIFFMDSANYRSFHYEEE

SEQ ID NO: 920908 - protein, 111 aa, Homo sapiens; identical to SEQ ID NO: 920907

SEQ ID NO: 920909 - protein, 171 aa, Homo sapiens
MAHHSGSGCWTALTGGSMYFVIVHWCQVITHWCQVITHWCQVMAHWGHVIAHWCQVITHWCQVITHWCQVITHWCQVMTHWCQVITHWCQVIVHWCQVIARWCQVMMHWCQVIKHWCQVITHWCQVITHWFQVITHRSSHTGFLVFNLVLALCEWFQSCLLNPGLRTSSVT

SEQ ID NO: 920910 - protein, 166 aa, Homo sapiens
KKISFPQYMLLSALSKISWLLFQKTCLQLLKLFLSLDLVYCGSFLMYFVFPSMHYLVSAFLFQLWNAQDPGFCALSPSGSKARWSQPGEGRSSGTWQKAQVRGDSCYTEVLARGKWGHPQWPQSRAGDTVSLSEKIINDPPRLERSDLSLGDSRTHLDHGRASKSV

SEQ ID NO: 920911 - protein, 299 aa, Homo sapiens
MDSSFGEVLLVQEVYTKEFRNNPFFLSDKDDIYPVDTVAIGRTDIEDLDLYATSRERRFRLFASIECEGQLFMTPYDFILAVTTDEPKETPPVWKGSSKLFRNLKEKEPHAGFRIAFNMFDTDGNEMVDKKEFLVLQEIFRKKNEKREIKGDEEKRAMLRADDITSLVTDTTLLVHFFGKKGKAELNFEDFYRFMDNLQTEVLEIEFLSYSNGMNTISEEDFAHILLRYTNVENTSVFLENVRYSIPEEKGITFDEFRSFFQFLNNLEDFAIALNMYNFASRSIGQGNFRTQPETYSSG

SEQ ID NO: 920912 - protein, 223 aa, Homo sapiens
MLLTERTRRLGEPSVAALTTTMPKQGLLGAEGWATSLLKLLVMSQRKPGGCKSVLKEQAPTLGLTVQDCWDQGEPSSAFPGSTQQPRLHNTLSGLLCTCLYHCPAVPCQPPWDCGGAPPPLPPALPQLVSGGERMPVGKEGGWEKEGKGKPMHLGGDFCSGNADLPAQVTDVLSSFLQALGLCLVQGPSYSQTSNTATPKLLAKCSSARKEELRNKTLGLGAT

SEQ ID NO: 920913 - protein, 174 aa, Homo sapiens
MLQGTVCKFKGARLGISTPSLTSMPFGMRLCCPGLCLFKPWTGICSTEFGQGRQWSIREESCGGGFPSPKKDPRIKTEPPISLSPLFRGPFDFGWTLDLTTWSHGNTLGEEENIYHLPITTSRVTTAAPEYNHSECPLNSDSHSCPYILIQEIWDPRNLHSLISLQMIQIHEKQ

SEQ ID NO: 920914 - protein, 135 aa, Homo sapiens
IGKMQAGQRLLLNARLSNRIPYKFSSSLFFSWWWRQEVGRVSGVGDVSWKKWKLTYTFKEGYTLSRQRKDGLVTSFIESSDGNHILEFALRHPATHCFPGWHTSHNGWKHQVALTPSPNLLTGSEPILSKNNSVC

SEQ ID NO: 920915 - protein, 130 aa, Homo sapiens
MATISVAMVMGILQSRQKLPSDHRMALGGAVICRDSLPWEPLAGLTTHFTLKICQKENYREAKQGNGQVAAKKAEPQLKPREGGTSWRKFKPRSLKPGLDNMLPSGFPFNQPHNAKLPSNGSFMVNRHGD

SEQ ID NO: 920916 - protein, 634 aa, Homo sapiens
MALSQADFGGSGKGKAWANLMLNRACFQWCLGQAPAHAITFTEPWVCLTTEGQEVNCLLDTGAAFSVLPSCPGQLFSRSVTIRGVLGQAVTRYFSQERRSSKSRGHYTPEHRRRNTVEWTPEAEAAFQALKKSLTQAPVLSLPVGQDFSLYVTEKTGIALGVLTQVLGTSLQPVAYLSKEIDVVAKSWPHCLWVVAAVAVLVSEAIKIIQGRDLIVWTSHDVNGILTAKGDLWLSDNHLLKYQALLLEGPVLRLHTCATLNPVTFLPDNEEKTERNCQQVIAQTYATRGDLLEVPLTDPYLNLYTDGSSFVEKGLRKAEYAVVSDNGILESNPLTPGTSAQLAELIALTQALELGEGKRVNIYTDSKYAYLVLHAQAAIWREREFLTSEGTPIKHQEAIRRLLLAVQKPKEVAVLHCQGHEKGKEREIGGNRQADIEAKRAARRDPPLEMLIEGPLVWGIDSTHQMAKSLFTGPGLFKTIKQIVRACEMCQRNNPLPYHQAPSGEQRTGHYPGEDWQLDFTHMRKSQGFQYLLVWVHTFTGWAEAFPCRTEKAQESHMNPPELKQRTQTCLWSYLSPKMLHPNCIPGLSWSPSWATLVAPVVWAWLQAAHLAHQCRTSSASCCMIVDTRRALAV

SEQ ID NO: 920917 - protein, 634 aa, Homo sapiens; identical to SEQ ID NO: 920916

SEQ ID NO: 920918 - protein, 147 aa, Homo sapiens
IVTLHAVMGRCPRLAKELHPLGLMTDSAKDAEYDQKSGAIRSWSSKTHSQCSQPLAPRIPKTSVLPSEIQSLEKNLCRQLMRLIENMLIDLLVLFESQNISRLSHTEGGENRVKDLKPEKRPNDSSKPRKYEVAERISNPGLQCQKR

SEQ ID NO: 920919 - protein, 146 aa, Homo sapiens
MWGYGHLRGHLCKMTVSLIVEPSLKNTHVPPVVSSGVRRLRWGRGRQLTGGPFRRRRAWTVAAGWAAPDAEPCAACVPGLPARQGRGAGQRAVSAETRIRDQVCVSVDTEVATAALSLPKPRFLSLKGFQSRSSVKSFHIHGASTN

SEQ ID NO: 920920 - protein, 516 aa, Homo sapiens
MTFQNTLIRRMQDSDWPGSSLRPTPEEEMHSAFLNPDCVTLHSYPLPSPVLSSSDRLPFGIEENGGTPFLTAASGRHHHQHQHQHQHQHHSNYSLSLTLENKEGPLRSPNSSSKSLTKLSPGTPALFSEAAAHLKKLELETVKAAGPWPPLHININKAEEKKVSEKTLQTPLLPSPVADHVKCNILKAQLENASRVNIQGGKEESPFVNINKKSSLQDASVRSPIPIRVETAQPAVEKPEIKPPRSIGSCKLDIWWTSVWEPPIPIPGLPTPAHPPSTPHSLFIIVMSRASCAFSNRSDEDDLPPDLAEAVGVTTSTTTNTTTAATQVSVPLPSPKVQNVSSPHKSEGKGLLSPGAKSPSDRGGAFTLEPGDLLMDFTEATPLAEPASNPHCAHSRCSPPLSLPMKEETTGVCMYPPIKTRLIKTFPVDTMNPFPDTFTTGPQFTADFRDSKLQCCPGPTSPLIPAATLRPLTETVSTVQTIYTTRKPVSLAASAETLRQELEREKMMKRLLMTEL

SEQ ID NO: 920921 - protein, 159 aa, Homo sapiens
FCSHGSFVFFQKTVLPIMPTSAVLFPAALLVLLFEFAPSSQFLQFSNSGSGSSPNGSSNSPSLTSWLPALPPWKCVFHLRLDPGAPLLVQRAAPSPSQMAGLLLAGVERSCASSFSVEAFREHGGDQLCLSARPELTTRVFAKEGWGPTQCEDNKDEDL

SEQ ID NO: 920922 - protein, 528 aa, Homo sapiens
HAHFTGTCTPHPPYAHLTDPAHFTGTCTHHRPSTCHRPMHTPQTQHVSQTHAHLSDPCTPHRSSILHKHMHTSQTQTQHMSQTRAHLTDPAHVTDPLHTSQIQHMSQTRAHLTDPAHVTDPCTPHRSSTCHRPMHTSQTRAHLTDTVHITGTCTPHRPMHTSQTRAHLTDLCTHHRPSTLHRHVHTSQTQHMSQTHAHLTDPYTPHRPSTSQTYAHLTDPAHFIGTCTPHRPMHTSQTRAHLTDLCTHHRPSTLHRHVHTSQTRAHLTDPAHVTDPCTPHRPVHTSQTQHVTDLCTPHRSSTLHRHVHTSQTHAHLTDPVHTSQTCAHITDPAHFIGTCTPHRPVHTSQTQHMSQTHAHLTDPYTPHRPSTSQTYAHLTDPAHFIGTCTPHRPMHTSQTRAHLTDPAHFIGTCTPHRPMHTSQTRAHLTDPAHFIGTCTPHRPMHTSQTRAHLTDPAHFIGTCTPHRPMHTSQTRAHLTDPAHLIGTCTPHRPVHTSQTRAHLTDPAHFIGTCTPHRHIHTSQTQHTS

SEQ ID NO: 920923 - protein, 156 aa, Homo sapiens
MWPVPYTSLGLDDSLNSAADGIEQMGMTWNLTLYNSDTPLSTCPSLPATGPASVPCVLRKGHWLLFYVMTDRRSRPAQQCEQTPCMVPVVGAVVSGCHGRGWGIPGLSPIVPKINWLLGGFCVPLTVLETNFLTYGKTHPGEAKVVEGTESPSRSE

SEQ ID NO: 920924 - protein, 597 aa, Homo sapiens
MEEGGEQLAGHVSLHHRKEGPGHPGGQTPPGKLNRKIHLPGRIPFSSLPSLLGRPCPQAVHAPWNVGVGTRVVQSCHWPSLLAKGQAGSWGPPEGLEGFGLKPRPLSGSVCCGVPGAEADADRPEFVDESTGPASTPQHRRCFSKESKEEQDHREPLSASSSPSTEEIHRSPFTGPRLCHLGELGWQVPRKAHRESTGNPPQPGTYAHPPHPEGNCSSQRPRNTHHTAPTMEIGGLVLPVASKLLFDHDGLSLVWPDTVAQRHEETVALRQGVGRLHTTENEREFKESGTAGTRGVSVLQTQFCDLSLLRHPQRRLGTGRGGQGRPRWQRVLGNCGWDLVFPTVAAPLRARQQSRRHSALGRLGGLEASCPQRRGALCSRWGQSWGERTQTQNRIVLVIVKGCHVRNEEWSPAVGRPGGLLHPDLQEPQILVKGHRCEREAGAGHGKGGGGAAKQTHFPWRTGAGGKRLSTPFPHLRSRGRRAASSVVLSVTQMHCVKVKIALGKARLARRTPIKACVGETGPNSARAQLPLNEGREGFSELEREGTLCIYSLIHNSQAQHVPVEQAEFQKSRHTLLGAAEDSGIVVTSPLELLSPF

SEQ ID NO: 920925 - protein, 172 aa, Homo sapiens
LSNYHRYRTSDTIVLSQKEHLPVTQIVMTDAGQPHSEADYTLGPLLCCGDTRLLKVWRRESVIFEIFPSLFGRLRWEDGLSQGVQHKPGQDESFWNSASFNTETSYLHFPAFHGELTADVCFFFKTTVSSGVFMENLGITDFIRIELRGRLATLDKSQGTHYLAIKALTQQN

SEQ ID NO: 920926 - protein, 177 aa, Homo sapiens
MVMFCKFASQPGERRVLSCVLSSGRQRPEAEIQPCSRQRWVMVFRPGLQKVTLPLGDTLCQVLKCKPLDTDSTSGDIFSGSFGWCSPTALYEQSCEAHKHRGNPSGLYYIDADGSGPLGPFLVYCNMTDSAWTVVRHGGPDAVTLRGAPSGHPRSAVSFAYAAGAGQLRAAVNLAER

SEQ ID NO: 920927 - protein, 177 aa, Homo sapiens; identical to SEQ ID NO: 920926

SEQ ID NO: 920928 - protein, 451 aa, Homo sapiens
MVMFCKFASQPGERRVLSCVLSSGRQRPEAEIQPCSRQRWVMVFRPGLQKVTLPLGDTLCQVLKCKPLDTDSTSGDIFSGSFGWCSPTALYEQSCEAHKHRGNPSGLYYIDADGSGPLGPFLVYCNMTDAQGHRLESAVRSSRPLIPLGLVTDGEADIIKPLYFNRAASYHTCESALPLAAGLCRPVMPLLCPFLLSRLRVDGGAARWPRRGDPPRCPQWAPALGCVLRVRSGRGAAAGRGEPGGALRAAAGSALRDSAAPGLTRTSDTIVLSQKEHLPVTQIVMTDAGQPHSEADYTLGPLLCCGDKSFWNSASFNTETSYLHFPAFHGELTADVCFFFKTTVSSGVFMENLGITDFIRIELRGRLATLDKSQAPTEVTFSFDVGNGPCEVTVQSPTPFNDNQWHHVRAERNVKGASLQVDQLPQKMQPAPADGHVRLQLNSQLFIVFPL

SEQ ID NO: 920929 - protein, 440 aa, Homo sapiens
MVMFCKFASQPGERRVLSCVLSSGRQRPEAEIQPCSRQRWVMVFRPGLQKVTLPLGDTLCQVLKCKPLDTDSTSGDIFSGSFGWCSPTALYEQSCEAHKHRGNPSGLYYIDADGSGPLGPFLVYCNMTDAQGHRLESAVRSSRPLIPLGLVTDGEADIIKPLYFNRAASYHTCESALPLAAGLCRPVMPLLCPFLLSRLRVDGGAARWPRRGDPPRCPQWAPALGCVLRVRSGRGAAAGRGEPGGALRAAAGSALRDSAAPGLTRWNPTELVCWKNNETHTYWGGSLPDAQKCTCGLEGNCIDSQYYCNCDAGRNEWTSDTIVLSQKEHLPVTQIVMTDAGQPHSEADYTLGPLLCCGDKSFWNSASFNTETSYLHFPAFHGELTADVCFFFKTTVSSGVFMENLGITDFIRIELRGRLATLDKSQGTHYLAIKALTQQN

SEQ ID NO: 920930 - protein, 367 aa, Homo sapiens
RPGSSGWWPTSGMDSLDPLTTMDPLRSLHAVLWADYLPWNQPRREPLRLEHKYQPASVRFDNRTTHQDDYPIKGLVKTISCKPLAMPKLCNIPLEDVTNYKMSYVAHPVEKRFVHEAEKFRPCEIPFESLTTQKQSYRGLMGEPAKSLKPLARPPGLDMPFCNTTEFRDKYQAWPMPRMFSKAPITYVPPEDRMDLLTTVQAHYTCPKGAPAQSCRPALQIKKCGRFEGSSTTKDDYKQWSSMRTEPVKPVPQLDLPTEPLDCLTTTRAHYVPHLPINTKSCKPHWSGPRGNVPVESQTTYTISFTPKEMGRCLASYPEPPGYTFEEVDALGHRIYKPVSQAGSQQSSHLSVDDSENPNQRELEVLA

SEQ ID NO: 920931 - protein, 166 aa, Homo sapiens
NSCSQLNLGISGHRMGVVLWQLNFRDEEAPIAPCPWSKTHSNIVPVPKWHNTVAMQATGEALGPAWCLHTHKNNGFSSVLPAGVTVTALIIHGKKYWNGGVPIRCHVQRVVKAKADLIRPGKNEYASCLRAIISCCTYSKVRGFLWEEAHNSKKLKREIRVTFIGY

SEQ ID NO: 920932 - protein, 833 aa, Homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLVPGPAFLALNWLGYANSAFNPLIYCRSPDFRSAFRRLLCRCGRRLPPEPCAAARPALFPSGVPAARSSPAQPRLCQRLDGSKGGRAGRRSSPKDPRCATGKRCGVPRTLASPAPLHWGCQGSRKRQDCPAQPWRKTSGQKRNTGAETHSLGSSFVSVMPTLSVFMDVPLAHKLEGSLLKTYKQDDYPNKIFLAYRGTFPQPHGVQERFVCRLSAELSPGGPNQASGAPSVVFLTVCMTNEGHPWVSLVVQKTRLQISQDPSLNYEYLPTMGLKSFIQASLALLFGKHSQAIVENRVGGVHTVGDSGAFQLGVQFLRAWHKDARIVYIISSQKADPTWLCPCDGEHYRLQVDTKWVGKVDVHDKEQADIPIFDIPCQGLYTSDLEEDTRILQYFVSQGFEFFCSQSLSKNFGIYDEGVGMLVVVAVNNQQLLCVLSQLEGLAQALWLNPPNTGARVITSILCNPALLGEWKQSLKEVVENIMLTKEKVKEKLQLLGTPGSWGHITEQSGTHGYLGLNCKGLGGWCPPFLTFGLYLSIKLH

SEQ ID NO: 920933 - protein, 831 aa, Homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLVPGPAFLALNWLGYANSAFNPLIYCRSPDFRSAFRRLLCRCGRRLPPEPCAAARPALFPSGVPAARSSPAQPRLCQRLDGSKGGRAGRRSSPKDPRCATGKRCGVPRTLASPAPLHWGCQGSRKRQDCPAQPWRKTSGQKRNTGAETHSLGSSFVSVMPTLSVFMDVPLAHKLEGSLLKTYKQDDYPNKIFLAYRVCMTNEGHPWVSLVVQKTRLQISQDPSLNYEYLPTMGLKSFIQASLALLFGKHSQAIVENRVGGVHTVGDSGAFQLGVQFLRAWHKDARIVYIISSQKELHGLVFQDMGFTVYEYSVWDPKKLCMDPDILLNVVEQIPHGCVLVMGNIIDCKLTPSGWAKLMSMIKSKQIFPFFDIPCQGLYTSDLEEDTRILQYFVSQGFEFFCSQSLSKNFGIYDEGVGMLVVVAVNNQQLLCVLSQLEGLAQALWLNPPNTGARVITSILCNPALLGEWKQSLKEVVENIMLTKEKVKEKLQLLGTPGSWGHITEQSGTHGYLGLNCKGLGGWCPPFLTFGLYLSIKLH

SEQ ID NO: 920934 - protein, 590 aa, Homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLVPGPAFLALNWLGYANSAFNPLIYCRSPDFRSAFRRLLCRCGRRLPPEPCAAARPALFPSGVPAARSSPAQPRLCQRLDGSKGGRAGRRSSPKDPRCATGKRCGVPRTLASPAPLHWGCQGSRKRQDCPAQPWRKTSGQKRNTGAETHSLGSSFVSVMPTLSVFMDVPLAHKLEGSLLKTYKQDDYPNKIFLAYRAGRISPGPVAKPPQHGCTCHHLHPLQPCSAGRMEAESKRSCREHHANQGKSEGETPAPGNPWVLGSHHRAEWDPRLSWTQLPAGGIPGQEEAHLYPQERSD

SEQ ID NO: 920935 - protein, 155 aa, Homo sapiens
MVFIAIMLHCFPGYKGTYEINKSMNEFIHLNIIYGVSGTGQTPEWSCNADTNRYNQLEVEMPLGEARDSGCIAGAHAHIATKSLGFGFNQEGKQNASCGDPPPQMRVAGRGVVVNNGVYHTVNDDDENNDNICMIRHGCFYTGGIEESNLAGSGC

SEQ ID NO: 920936 - protein, 536 aa, Homo sapiens
MERSQCGSRDRGVSGRPHLAPGLVVAAPPPPSPALPVPSGMQVPPAFLRPPSLFLRAAAAAAAAAAATSGSGGCPPAPGLESGVGAVGCGYPRTPKCARCRNHGVVSALKGHKRFCRWRDCACAKCTLIAERQRVMAAQVALRRQQAQEESEARGLQRLLCSGLSWPPGGRASGGGGRAENPQSTGGPAAGAALGLGALRQASGSATPAFEVFQQDYPEEKQEQKESKCESCQNGQEELISKSHQLYLGSSSRSNGVIGKQSIGSSISEYSNKPDSILSPHPGEQSGGEESPRSLSSSDLESGNESEWVKDLTATKASLPTVSSRPRDPLDILTKIFPNYRRSRLEGILRFCKGDVVQAIEQVLNGKEHKPDNRNLANSEELENTAFQRASSFSLAGIGFGTLAADLVEFAGGPLQTLFAWVSSAEAAEQQRLLPVLSSGSFIPEGHLPDASRSFPSGLSAVGLLEFAGGPLQTLFTWVSAAEAAEQQILVNSKQVLLPDRSSGSFVSEEYPAVNTIYKDKVYRQNGHAANILHSD

SEQ ID NO: 920937 - protein, 155 aa, Homo sapiens
MYMRVPACMRVCLGRWVKIQTFRSINLEIESGVCISFIIRNSVGKQKMIQKTRPSTAAYQSGCNFDSAKIMKAKLNCEMRHSTPFHPIFGKMRGKMAIAPVQTLSDVSRGLSIRLFSTFNHMYCVFTEREAQKQKGRGNCVSSSLANYLHLLRAT

SEQ ID NO: 920938 - protein, 167 aa, Homo sapiens
MSLFAIFGGMEERHAPECDPYDPFVAICHPLYHSAIMNPCFCGFLVLLSFFSQSLLDAQVHNLIALQMTCFKDVEIPNFFWEPSQLPHLACCDTFTNNIIMYSPAAIFGFLPISGTLFSYYKIVSSILRVSSSVMYTVVTPMPNPFIYSLRNRDIKSVLRRPHGSTV

SEQ ID NO: 920939 - protein, 109 aa, Homo sapiens [sequence omitted]

SEQ ID NO: 920940 - protein, 205 aa, Homo sapiens
ETSEWRLLPIGGCLIYTENPLFGVATFICHLNDFMSQLSLVFHVDPKCQFIYLLGNSDNFRHLVACGVCASAAVANPDPARHQEHGPLARCCRAPYSGSQPSSCRRAGAGAQPHPSGCTVPSARIPRFGRLSRRKKGVVQSSGPWGRPGPALRSWEPCQPTGPSAAGTWCRENLAQGRFFRHAQILASRGGARGQLVEVRMRTGT

SEQ ID NO: 920941 - protein, 171 aa, Homo sapiens
LVYSEDRGGFWKFCFPVKKSSGVENWLSNLSMNQKLLRVSENTDYWVPCQSFLFKPGPLSGLHGGSSMIVTLKMLDFLLVKGKDIKAEPPGTGGVVMQALLLPPPLGPCWVRPEAGLVLGLAEGPSFQCEKPFPVATTSSNLRFPENFFAQLSPLWSSVLKPLATKVSPDP

SEQ ID NO: 920942 - protein, 154 aa, Homo sapiens
MIFLDPLRHSGHGIREIGCSPLACYPAVTAGMLQVCCRYPRRRAQVTSPSRCVCEHEDSPHGGLFLCLVLRGGDNEFQWYFCIKRDFARCISGVTDSETGEAEHKETLVFSLKASGWTCTQMAIQVQFMRSWTVLTNDLGKGIGRELSVPMLRL

SEQ ID NO: 920943 - protein, 159 aa, Homo sapiens
MSGRVPLAEKALSEGYARLRYRDTSLLIWQQQQQKLESVPPGTYLSRSRSMWYSQYGNEAILVRDKNKLELCKFIRKRPRSGTAGSKCIPQMSCQRPGRQQPPAQPESLLRESWLVCSLQLGDLKSDFQDCRMELQREPSSRAVILRRAALHASLQSGS

SEQ ID NO: 920944 - protein, 871 aa, Homo sapiens
TKATLSARRRGGGVGKAMGARTGAKWPWGSSRRLDPGARTGAKWPGSGSGKRRRPARGRCPGPTQLPPAPRAPAPRPSRALQPRPGPAQRPRPLFHRRPARRREAQGCDPRRAHPARQAPWEMRGHSQGPAERAQRRSLPHPRPRRPRNRRTRAVPAGGGGATQAEGTLANFAPPEVASRRPGAHPPAARPRPGARPPQPGRLGRRRCDLRVQSARRAARTPPPRGPPARRALTWDICGRKLMSLRSMEPGERLCSSWHRRTPSRSACARSKTTAEGHTTRWLGGRTLQSMSQRPHCRHCSMAPAGPTGSGQCSSQSAAAAGHPARARAGLRAGAGLRAGCPRSPAAPPCVPSSSSSYSSGSSRAAAPAHVRPRGGQRAARRISPLHTRKCLRAPGRAPRSQSPQRSPIRAAGRRILRSGRPAAAAAPAPPETKARRGRSLRASRAWAARVAAALFAPPAVPTPGAATRRLGGSAAPRLRGAGGAGGAATAGRGRGGAGALAWHLPVSQAPPPPPHFLPRYRPRKLRWAGVAAQAQVRPTFSKGARTLGSPSPWGSDLARGVMAGRPPGCLWSSVEVRRWSLSRWAPSHGRSVTTDSGEGTGLGRSLLSPLGPSSRPGGIPEAEAEGTRAQDSQSPLPVLRPGRGPIGRPPTLHKGQDSPAFGQSPGHSQLPSGQFLASRAEMRDMSEGRKVLSGPGPEAGVRCLRAPTLDSGGILGLYELGLHCSPRTPYPVASLRRGRNGDASAERVPWAQGLRWGKKGASVLTVLGLPALAKRTSQVWDPGSRPQQCHGYLLPPGGAVTTGHLAAPRRGCTENLGLTVEKTQLRRHRLHHSGPEPLRPPWFPGPDRHRTFTGPVHLPESLEALRAGWM

SEQ ID NO: 920945 - protein, 160 aa, Homo sapiens
MPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGSSQQDRRRRQVISAFPTGVPGSSHWDWLDSGCSPWRAS

SEQ ID NO: 920946 - protein, 191 aa, Homo sapiens
TYRYRCSLCGGGVQTRRVTCQKLKASGISTPVSNDMCTQVAKRPVDTQACNQQLCVEWAFSSWGQCNGPCIGPHLAVQHRQVFCQTRDGITLPSEQCSALPRPVSTQNCWSEACSVHWRVSLWTLCTATCGNYGFQSRRVECVHARTNKAVPEHLCSWGPRPANWQRCNITPCENICANTELERPGAVFKA

SEQ ID NO: 920947 - protein, 361 aa, Homo sapiens
ELRAFVKMCKQDPSILHTEEMRFLREWVESMGGKVPPATQKAKSEENTEEEKPDSKKVEEDLKADEPSSEESDLEIDKEGVIEPDTDAPQEMGDENAEITEEMMDQANDKKVAAIEALNDGELQKAIELLTDAIKLNPRLAILYAKRASVFVKLQKPNAATQDCDRAIEINPDSAQPHKWRGKAHRLLGHWGEADHDLALACKLDYDEDASAMLKEVQHRAQKIAEHRRKYERKHEEREIKERVERVKKARKEHERAQREEEARRQSGAQYGSFPGGFPGGMPGNFPRGMPGMGGGMSGMAGMPGFNEILSDPEVLAAMQDPEVMVAFQDVAQNPANVSKYQSNPKVMNLISKLSAKFGAT

SEQ ID NO: 920948 - protein, 586 aa, Homo sapiens
MVTAITVVPSRKGSAATGQQSFTICRHPTQDGMKTPQRRADETDDLEGDVSTTWHSNDDDVYRASPIDRSILPTAPRAAREPNIDRSHLPKSPPYTAFLGNLPYDVTEESIKEFFRGLNISAVRLPCEPSNPVRLKGFGYAEFEDLDSLLSALSLKEESLGNRRIRVDVADQAQDKDRDDCSFGRDRNRDSDKTGTDWRARPATDSFDDYPPRRGDDSFGDKYRDRYDSDRYRDGYRDGYRDGQRRDMDPYGGRDRYDDRGSRDYDRGYDSRIGSGRRAFGSGYRRDDVSEEAGTTMKTDMTDGMIGLGAPEMITLWMIIGVMSTRAASIFGGAKPVDTAAREREVEERLQKEQEKLQHQLDEPKLERRPPERHPSWRSEETQERERSRTGSESSQTGTSTTSGRSKSAQDARRRENEKSLENETLNKEEDCHSPTSKPPKPDQPLKVMPAPPPKENAWVKRSSNPPARSQSSDTEQQSPTSGEGKVAPAQPSEEGPARKDENKVDGMNVPKGQTGNSSRGPGDGGNKDHWKESDRKDGKKDQDSRSAPEPKKPEENPASKFSSASKYAALSVDGEDENEGEDYAE

SEQ ID NO: 920949 - protein, 140 aa, Homo sapiens
MEVSGYWYFFPQGGSEVAGLWETVQEWVGDNARSQHSPEAPSVCLLVAESSGKWRGLREKNEKAESGLSRSALRPKTLSTGKPRTGVGAERAHEAQRLGVSQRPPPGVVFKCEGTQGFLNVRVCVCVCARVCVCVLALNK

SEQ ID NO: 920950 - protein, 113 aa, Homo sapiens
MGIFQLLRDRRISSRGPGLHTPKAEPRRRKGLTTGLMTQAERQKQAHQRQATMRETALWCTGHIRPRTHTHTGTHTQTDRERERNTQRLRDRERRENGRHTHTYTHRHTHRVL

SEQ ID NO: 920951 - protein, 113 aa, Homo sapiens; identical to SEQ ID NO: 920950

SEQ ID NO: 920952 - protein, 197 aa, Homo sapiens
MSTLQPRTRAPEELFVPQESSGSTPEKMLVSFHGSSLRNEATPRYSQQEEAGNGRWQQSLSLERWPPWTSHPLGTPPLMPVAVARCCILPGLWPLLSPPSGSASPVSQGPGCLSLWPNAFKKDDFPVRQGDKHHTHSTPKQSSEGHHIVPGAPENSGTQRAPGAIDGPRTPASWPNGENGRSPKGADKRIGRYRKTR

SEQ ID NO: 920953 - protein, 120 aa, Homo sapiens
ETSPRGLAKQEPSVAVLGCRGSEDPASPLHGVDGNVSGCQESQRADHDEETPGGDGGSSTGSQPQACPDGVGWDRIVVWLHFSEKSREKIQASSLTWVRWSPAGQRAPVGLVSSSAVCSS

SEQ ID NO: 920954 - protein, 150 aa, Homo sapiens
GRRRRTARWLAGRPMAANATSGRPPSIALRQPEATGWRRGIPAKVATKGTQAEREGDVRSGGRARGRCVRLAKRCSPSSLGLRRRRRRTGGRQGDPQIFLGSDFRLLTPANSNPVLENPARTGSRIVIGISRERNLPFCGRSNLPDVSSL

SEQ ID NO: 920955 - protein, 150 aa, Homo sapiens; identical to SEQ ID NO: 920954

SEQ ID NO: 920956 - protein, 150 aa, Homo sapiens; identical to SEQ ID NO: 920954

SEQ ID NO: 920957 - protein, 150 aa, Homo sapiens; identical to SEQ ID NO: 920954

SEQ ID NO: 920958 - protein, 150 aa, Homo sapiens; identical to SEQ ID NO: 920954

SEQ ID NO: 920959 - protein, 209 aa, Homo sapiens
MPRGSRSRTSRMAPPASRAPQMRAAPRPAPVAQPPAAAPPSAVGSSAAAPRQPGLMAQMATTAAGVAVGSAVGHTQGHAVTGGFSGGSNAEPARPDIAYQEPQGTQPAQQQQPCFYGIKQFLECAQNQGDIKLCEDFSKVLKHQPDSMHASPATQQFHFQKHNLQEFPHMSVRRLSKDVHCSPVYNRKEWKQLSSVRNRIIELEINSFL

SEQ ID NO: 920960 - protein, 508 aa, Homo sapiens
MGVAAAERSGLTRMAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFISNTGGEQINQVALEAWRSRRDREEILLQELEPVISRAVLDNPHHGFSNSGIMEERLLDAVVPFLPLQRHHVRHCVLNELAQLGLEPRDEVVQAVLDSTTFFPEDEQLFSSNGCKTSEDCVFNSDESENVTAVAEVLLYSWQIADISVSEVPVVLTRKGVPKAPIRPAAPALDSSGKRGFPISHWPVAQRLRITKGKDLQITPAQPPATQTLRGGAARALCTGAKSPLAMHKVCGLISGTGLGGDESRAAATMKCLEQASPRPGQPRNSVTPALEPLAPGHPAVSSGAERTPRPAVFDP

SEQ ID NO: 920961 - protein, 334 aa, Homo sapiens
MGVAAAERSGLTRMAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFISNTGGEQINQVALEAWRSRRDREEILLQELEPVISRAVLDNPHHGFSNSGIMEERLLDAVVPFLPLQRHHVRHCVLNELAQLGLEPRDEVVQAVLDSTTFFPEDEQLFSSNGCKTVASRIAFFL

SEQ ID NO: 920962 - protein, 286 aa, Homo sapiens
AARRPGLDGSRVPPGGHLLVLLRNDGRALEAGRGASGVVGDGRGCCGALGPQPGWRLRRAAAGPGARSSGCSGWSRPRPPPGTWLPCAAPWAPFANATSGPTCRKDLKSWVQGNLTACGRSLFLFDEMDKMPPGLMEVLRPFLGSSWVVYGTNYRKAIFIFISNTGGEQINQVALEAWRSRRDREEILLQELEPVISRAVLDNPHHGFSNSGIMEERLLDAVVPFLPLQRHHVRHCVLNELAQLGLEPRDEVVQAVLDSTTFFPEDEQLFSSNGCKTVASRIAFFL

SEQ ID NO: 920963 - protein, 207 aa, Homo sapiens
AARRPGLDGSRVPPGGHLLVLLRNDGRALEAGRGASGVVGDGRGCCGALGPQPGWRLRRAAAGPGARSSGCSGWSRPRPPPGTWLPCAAPWAPFANATSGPTCRKDLKSWVQGNLTACGRSLFLFDEMDKMPPGLMEVLRPFLGSSWVVYGTNYRKAIFIFIRWLLKLGHHGRAPPRRSGALPPAPAAPRPALRAQRAGPAGPGAKG

SEQ ID NO: 920964 - protein, 334 aa, Homo sapiens; identical to SEQ ID NO: 920961

SEQ ID NO: 920965 - protein, 206 aa, Homo sapiens
AARRPGLDGSRVPPGGHLLVLLRNDGRALEAGRGASGVVGDGRGCCGALGPQPGWRLRRAAAGPGARSSGCSGWSRPRPPPGTWLPCAAPWAPFANATSGPTCRKDLKSWVQGNLTACGRSLFLFDEMDKMPPGLMEVLRPFLGSSWVVYGTNYRKAIFIFISNTGGEQINQVALEAWRSRRDREEILLQELEPVISRAVLDNPHP

SEQ ID NO: 920966 - protein, 308 aa, Homo sapiens
MGVAAAERSGLTRMAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFISNTGGEQINQVALEAWRSRRDREEILLQELEPVISRAVLDNPHHMVLNWHHGKALERVPSPSGTVAWCQECQWLEHGEVSVVEHFLKRSFSGEKGRRF

SEQ ID NO: 920967 - protein, 118 aa, Homo sapiens
MGVAAAERSGLTRMAAATRGCRPWGSLLGLLGLVSAAAAAWDLASLRCTLGAFCECDFRPDLPGEAPGSPERGAGGRGQTRERWEPWEPGWRRPEKLRTQRVGPRGGARRLGRVEGTR

SEQ ID NO: 920968 - protein, 266 aa, Homo sapiens
MGVAAAERSGLTRMAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFIRWGPALQWAQWGGHFSEVQLYSLSLCSQQNPVPHGLSWAFPVPSATLRDDIVIPPG

SEQ ID NO: 920969 - protein, 206 aa, Homo sapiens; identical to SEQ ID NO: 920965

SEQ ID NO: 920970 - protein, 113 aa, Homo sapiens
KAKTGGGPPGEDPPFKELGTRVISPGFLDNPHHGFSNSGIMEERLLDAVVPFLPLQRHHVRHCVLNELAQLGLEPRDEVVQAVLDSTTFFPEDEQLFSSNGCKTVASRIAFFL

SEQ ID NO: 920971 - protein, 334 aa, Homo sapiens; identical to SEQ ID NO: 920961

SEQ ID NO: 920972 - protein, 156 aa, Homo sapiens
MTGLQRHLECCILGGWGEVRNRMLFLTWQKRERGKRGPNLPFYNSTNPTHEGDALCGNEESSPKSISNSGMSGSNPFWGLSSFLELFETRTEGATVTHAENLGPLGYDMTLHIWVISSVVLRKILSLTKLYSDSSELFYKLILARILLSQKPVWKL

SEQ ID NO: 920973 - protein, 228 aa, Homo sapiens
MGQGTIHQSRPGRWARLPAAGTDRVSPYRISVGRGLSAALAAEGEAPILCCYYCCCFHLILIVLCFLNKKYTYMVQNSKGTKSYTVTNSDRSPHGNLWIYGISMDMPPHGNCPFPFIAYITLNYSCLFMYVSSAPATLGVVVDAVRSFLPYSTSCPNLLMAKQNMVAKSQSPGIPPIAHSQLRFDVPASGTAQASEHSIPSACKLFPPALSAWGIAVPLSKPTQFHPK

SEQ ID NO: 920974 - protein, 172 aa, Homo sapiens
EDSKDCLWVGRSEKQMMGSGSGLITAIFAKQDLDSCHLKKCGKDWPSGSLPRDARGLTEEYPARSALSLWPASSPRGRQVPRMLEDARRPPIPGYRPEPPVPYLTQQQAAAAPLYGTHSNRRKSRRQVLSGGGWLGSCWDVPTVQPQPRLSCDSCRILTARSSLSPGDSSLL

SEQ ID NO: 920975 - protein, 172 aa, Homo sapiens; identical to SEQ ID NO: 920974

SEQ ID NO: 920976 - protein, 120 aa, Homo sapiens
RDMTLSLSKPVSAGLGRSDKPGTLGFHACLRQGSFFGLLVSPHRPGYRREGGGQRRGDGHPQSFHPPHSSRGTRIPYSLFPLSLRHWQGPLPTPVGRCGSKASWADVPDTGLTRQLKRHP

SEQ ID NO: 920977 - protein, 140 aa, Homo sapiens
MSRWKMQVEASSLSPLVCLVETCNKCGCRLGFRAVSLPYLCWDSILAQPDFAAKSFNYKEPTGNSFSMADLHQPHKSLSVGLEQGHLETRPWEARAELEKDLPGEAHLNLSYGNPLPLSLSMFPSCLCPQPVVWKLSAST

SEQ ID NO: 920978 - protein, 152 aa, Homo sapiens
MGVKRRMGRQGTNAGGDFKLKPTLIYYFQSPRAVKNSAKSTLPVLCKWNNDTWTAAYLVYTMVQGVHVQVYYMGKLHVTGVWCTDNFVTQVVKILIFSEVWKKLVPTLTNDFERFNTSVEEVTAHVVETARELELEVVPQDVTELPQSHDQT

SEQ ID NO: 920979 - protein, 284 aa, Homo sapiens
MLLNFTLILKRERKKKRKQKALKRMYVQRALSSPTTTAGLATITPREEPQLPQPAPVTITTTLSSEAETQQPPAACRSPPPALSAGDTTPGTTGSGTGNGGPGGFTSAAPAGGDKKVIATKVLGTVKWFNLRNGYAFINRNDIKEDTFVPQTAKTKNNPRRCYPRRRGPPPNYQQNYQNSESGGKNEGWERAPQGQAQPRRPYSRDIDHDSAGALLAKDSLERTAMKRIKKINEVRPKVSSHLNVGTAATYRRRHTENPKPARKENPKPQGGKETKAADPPADN

SEQ ID NO: 920980 - protein, 182 aa, Homo sapiens
AAAFGVEGGEQQDIMLCTKAHAQLVVVTALTLASLDSYMPGYGEPVLHVMSATGLAMFPPSMVCYIGIRVSWRFAAPIDASSKFLPLIPQPSTGPGVCCSPRCVHELVLNVQLPLMTTGLGKFRLLFLSVIYGRRVGPGLVHLPAEFKVSEAQRNTMTWIKQPKWEEGHFCCIKEAVKLLLS

SEQ ID NO: 920981 - protein, 228 aa, Homo sapiens
MEDSPLPDLRDIELKLGRKVPESLVRSLRGEEPVPRERDRDPCGGSGGGGGGGGGCSSSSSYCSFPPSLSSSSSSSPTSGSPRGSHSSALERLETKLHLLRQEMVNLRATDVRLMRQLLVINESIESIKWMIEEKATITSRGSSLSGSLCSLLESQSTSLRGSYNSLHDGSDGLDGISVGSYLDTLADDVPGHQTPSDLDQFSDSSLIEDSQALHKRPKLDSEYYCFG

SEQ ID NO: 920982 - protein, 114 aa, Homo sapiens
MRQLLVINESIESIKWMIEEKATITSRGSSLSGSLCSLLESQSTSLRGSYNSLHDGSDGLDGISVGSYLDTLADDVPGHQTPSDLDQFSDSSLIEDSQALHKRPKLDSEYYCFG

SEQ ID NO: 920983 - protein, 228 aa, Homo sapiens; identical to SEQ ID NO: 920981

SEQ ID NO: 920984 - protein, 228 aa, Homo sapiens; identical to SEQ ID NO: 920981

SEQ ID NO: 920985 - protein, 160 aa, Homo sapiens
MVLAGPVSSGASLLGLTTHLPAKLHPRRVQKTLYQGSEKYNCKGSHSILKGILSEALLCTPVMTVRTVATELKLPESNWMLGCRVVRAIGNLTYVQTLKGIFRSKRSGSLKSVLARIRLQMPKQEMSAMSCRSLPNRASSGSERRAEEGILKSSCTLPTT

SEQ ID NO: 920986 - protein, 139 aa, Homo sapiens
MGSQKVKMPEKALGVTGDSQMKVQFWCRVPEEGALWTGSVAHAPGACLAPVQGSRCDKHKEERARHHSRRAQHQRDRGKIQNLCGSHLIRYTRAPGALTGQRFLGGVFTLLTGGLECHSLTSGIYTHKLLWLLVSLIAD

SEQ ID NO: 920987 - protein, 138 aa, Homo sapiens
MNALRGGGKYRKKTGTLKDMGSFSDLREQKKELNGDLSYNKPGTEQTTAAAVAGKQNLCWRAGSRQRLQSSAGNHNREASNRRSRRSPGTSTVDSEQVRFELHGSTHMKISFNESYPECACLSCLPFHLLHLYHPCHP

SEQ ID NO: 920988 - protein, 158 aa, Homo sapiens
MRNFVQLAAWAAVATFSLLLVLAGFASSSMSYPSYVRYCVSKIEEPLPPNNEFHPAEATAKAQRHEVSCRLCIVFPSSKPQGMEPPPFGVWLVTAARVRRAAESHSGYKSSHPTVTQVTSTHHPSTVEDMPDFKEGGAGRRGTEMGGDQPCCVSRKSE

SEQ ID NO: 920989 - protein, 672 aa, Homo sapiens
MATDFAPNFQKKFHETVIAALLRTMENQGNQRVQSHAASALIIFIEDCPKSLLVLYVDSMVKNLHSVLVIKLQELIRNGTKLALEQLVTTIASVADTIEEKFVPYYDIFMPSLKHIVELAVQKELKLLRGKTIECISHIGLAVGKEKFMQDASNVMQLLLKTQSDLNNMEDDDPQTSYMVSAWARMCKILGKDFQQYLPLVIEPLIKTASAKPDVALLDTQDVENMSDDDGWQFVNLGDQQSFGIKTSGLEAKATACQMLVYYAKELREGFVEYTEQVVKLMVPLLKFYFHDNVRVAAAESMPFLLECARIRGPEYLAQMWQFICDPLIKAIGTEPDTDVLSEIMNSFAKSIEVMGDGCLNDEHLEELGGILKAKLEGHFKNQELRQVKRQEENYDQQVEMSLQDEDECDVYILTKVSDILHSLFSTYKEKILPWFEQLLPLIVNLICSSRPWPDRQWGLCIFDDIIEHCSPTSFKYVEYFRWPMLLNMRDNNPEVRQAAAYGLGVMAQFGGDDYRSLCSEAVPLLVKVIKCANSKTKKNVIATENCISAIGKILKFKPNCVNVDEVLPHWLSWLPLHEDKEEAIQTLSFLCDLIESNHPVVIGPNNSNLPKIISIIAEGKINETINYEDPCAKRLANVVRQVQTSEDLWLECVSQLDDEQQEALQELLNFA

SEQ ID NO: 920990 - protein, 672 aa, Homo sapiens; identical to SEQ ID NO: 920989

SEQ ID NO: 920991 - protein, 196 aa, Homo sapiens
MAATASAGVPATVSEKQEFYQLLKNLINPSCMVRRQAEEIYENIPGLCKTTFLLDAVRNRRAGYEVRQMAAALLRRLLSSGFEEVYPNLPADVQRDVKIELILAVKLETHASMRKKLCDIFAVLARNLIDEDGTNHWPEGLKFLIDSIYSKNVVLWEVALHVFWHFPGIFGTQERHDLDIIKRLLDQCIQDQEHPA

SEQ ID NO: 920992 - protein, 162 aa, Homo sapiens
MKTSECTGDESCWDWALPFKTVGSLLAQHVSRNVQELEPGMEASGLCLVPYHIMAELASKLQDKVLFTLPSSLLKQSKGISPRAASCTAWSILFASPAGVSLHHVPPSPLALNPAQYQDLPRNYSPYGLDCLASLFRTQRTLVHRGHKRSFQVIYVALELAI

SEQ ID NO: 920993 - protein, 614 aa, Homo sapiens
KSPGGSDMRLASEVEIQSLKILLFPKRRTQKRIKWSLFVPILSPVAVRQGTVAATRSRKRQGTDYPPEPLKGAQPCQHLDLRLLASRTVREQIPILSHQGYGNLLQLPEEDESALDKIIERCLRDDDHGLMEESQQYCGSSEEDHGNQGNSKGRVAQNKTLGSGSRGKKFDPDKSPFGHNFKETSDLIKHLRVYLRKKSRRYNESKKPFSFHSDLVLNRKEKTAGEKSRKSNDGGKVLSHSSALTEHQKRQKIHLGDRSQKCSKCGIIFIRRSTLSRRKTPMCEKCRKDSCQEAALNKDEGNESGEKTHKCSKCGKAFGYSASLTKHRRIHTGEKPYMCNECGKAFSDSSSLTPHHRTHSGEKPFKCDDCGKGFTLSAHLIKHQRIHTGEKPYKCKDCGRPFSDSSSLIQHQRIHTGEKPYTCSNCGKSFSHSSSLSKHQRIHTGEKPYKCGECGKAFRQNSCLTRHQRIHTGEKPYLCNDCGMTFSHFTSVIYHQRLHSGEKPYKCNQCEKAFPTHSLLSRHQRIHTGVKPYKCKECGKSFSQSSSLNEHHRIHTGEKPYECNYCGATFSRSSILVEHLKIHTGRREYECNECEKTFKSNSGLIRHRGFHSAE

SEQ ID NO: 920994 - protein, 470 aa, Homo sapiens
KSPGGSDMRLASEVEIQSLKILLFPKRRTQKRIKWSLFVPILSPVAVRQGTVAATRSRKRQGTDYPPEPLKGAQPCQHLDLRLLASRTVREQIPILSHQGYGNLLQLPEEDESALDKIIERCLRDDDHGLMEESQQYCGSSEEDHGNQGNSKGRVAQNKTLGSGSRGKKFDPDKSPFGHNFKETSDLIKHLRVYLRKKSRRYNESKKPFSFHSDLVLNRKEKTAGEKSRKSNDGGKVLSHSSALTEHQKRQKIHLGDRSQKCSKCGIIFIRRSTLSRRKTPMCEKCRKDSCQEAALNKDEGNESGEKTHKCSKCGKAFGYSASLTKHRRIHTGEKPYMCNECGKAFSDSSSLTPHHRTHSGEKPFKCDDCGKGFTLSAHLIKHQRIHTGEKPYKCKDCGRPFSDSSSLIQHQRIHTGEKPYTCSNCGKSFSHSSSLSKHQRIHTGEKPYKCGECGKGFTLGPHLIKHQRF

SEQ ID NO: 920995 - protein, 738 aa, Homo sapiens
MEDCLHTSSENLSKLVSWAHSHGTICSLIPNLKHLLSEGSHGNLTAMWGCSAGHAYHWPLTATCRAGSQERVCFQDNRSFNSDSPSIIGVPSETQTSPVERYPGRPVKAKLDCNRTRDSCDFSYCSEPSELDETVEEYEDENTLFDMVCESSVTDEDSDFEPQTQRPQSIARKRPGVVPSSLHSSSQTQMVDECSNDVIIKKIKQEIPEDYYIVANAELTGGVDGPALSLTQMAKPKPQTHAGPSCVGSAKLIPHVTSAISTELDPHGMSASPSVISRPIVQKTARVSLASPNRGPPGTHGTNQQVAMQMPVSTSHPNKQISIPLSALQLPGQDEQVASEEFLSHLPSQVSSCEVALSPSVNTEPEVSSSQQQPPVAPAITTEATAQCIPDQDERAAELSREQNEKTIRSTQTALRNFREFLISKYPSETREIYVIPCKELDAYLASFFVDARQKDGSEYEPNSLANYQCGLERYLKEHRYGYSITRDKEFKRSQEALKQKQIELRCKGKGNKPHKSMKLTFADELILRKRGLLSRYNPEGLLNLVWLNNTKAFGHCTGFHGSTLKWGDIRLRVTETGLEYLEWMGQDTGDLNAKTKRGGTDSRVYATQHAPQTCPVQDYKEYAQRRPPAMRYEDAPFYLSIKPVVNLAALHWYNCQALGKNKLAKMVKTMCEKGNIPGRKTNFSVYQSCSTLSEAQSNQLVLICNNLSQQAAQSVAGHSNNGNFIVSASYDSSSDTA

SEQ ID NO: 920996 - protein, 145 aa, Homo sapiens
MRPRLMDLESMWERWKRIIWHPHDEALHPKWLKHQEGSRRHLRHYQDQPLRSSPVIIPQSDDQILNGIKAGNPQPAAGNLLGSPSTLWKLCPCSLHSKPCYHSLFGSVPSLRAVTLTAKVHSFILEVSETMNPPAGTDSGHNGGS

SEQ ID NO: 920997 - protein, 507 aa, Homo sapiens
MSESTGWLVEAQTAGSVSAINYVYRFAYVEPALHLRDEANLIMVQEKVKLTKLNDESKVVQRGGGRSRLQARSPTPLVVVNVYDSPAVFKAPIRPDIVNFVHTNLRKNNRQPYAASELAGHRTSTESWGTGRAVARIPRVRGGGTHRSGQGAFGNMCRGGRRFAPTKTWRRWHRRVNTTQKRYAICSALAASALPALVMSKGHRIEEVPELPLVVEDKVEGYRKTKEAVLLLKKLKARNDIKKVYASQRMRAGKGKMRNRRRIQRRGPCIIYNEDNGIKAFRNIPAITLLNVSKLTISKLAPGGHVGRFCIWTGSAFRKLDELYGTWRKAASLKSNYNLPMHKMINTDLSRILKSPEIQRALRAPSKKIHRRVLKKNPLKNLRIMLKLNPYAKTMRRNTILRQARNHKLRMDKAAAAAAALEAKPDEKAAVAGKKPVVGKKGKKAAVGVKKQKKPLVGKKAAATKKSAPEKKPAEKKPTVEEKKPAALTLKFDYSIKVKSLWTASFE

SEQ ID NO: 920998 - protein, 377 aa, Homo sapiens
MSESTGWLVEAQTAGSVSAINYVYRFAYVEPALHLRDEANLIMVQEKVKLTKLNDESKVVQRGGGRSRLQARSPTPLVVVNVYDSPAVFKAPIRPDIVNFVHTNLRKNNRQPYAASELAGHRTSTESWGTGRAVARIPRVRGGGTHRSGQGAFGNMCRGGRRFAPTKTWRRWHRRVNTTQKRYAICSALAASALPALVMSKGHRIEEVPELPLVVEDKVEGYRKTKEAVLLLKKLKARNDIKKVYASQRMRAGKGKMRNRRRIQRRGPCIIYNEDNGIKAFRNIPAITLLNVSKLTISKLAPGGHVGRFCIWTGSAFRKLDELYGTWRKAASLKSNYNLPMHKMINTDLSRILKSPEIQRALRAPRASRCATQCAPQ

SEQ ID NO: 920999 - protein, 129 aa, Homo sapiens
LLSHQGWSAMTAYIEQSTYYMILFMSPEQAKRTDGDGGQNSSQQDSLCSNITLTEAPAPYGTFLIKAIARKDAVLPQIVNVTYKCRNARVWKWKGQDRSLSGLEHLRSSGKNLSGKQRLQQDPLAKERG

SEQ ID NO: 921000 - protein, 147 aa, Homo sapiens
MTASRTLSERDSTPNLTLFEENVWKLCEYIKNHDQYPLEECYAVFISNERKMTAPLVSHSFCGITALPRMFTNPEHRRLSSPVVLHEVQEPCGKEAKWSVFSFRVHTCIGLSRGLEVLKDVFARGEKNMNRSLRENQYKHFYNSNLG

SEQ ID NO: 921001 - protein, 270 aa, Homo sapiens
MQAQDGLQVSPAQDGHQVTLAQDGLQVTQTQDELHVTQAQDWLQLHIDALCDEGLTDDLEGADWASAIRVAALDCMEEKNQAVCHDYDIHFYPTFRYFKAFTKEFTTGENFKGPDRELRTVRQTMIDFLQNHTEGSRPPACPRLDPIQPSDVLSLLDNRGSHYVAIVFESNSSYLGREVILDLIPYESIVVTRALDGDKAFLEKLGVSSVPSCYLIYPNGTAEPWQALCLCVGCPCAPHEDKPFAPAWGACVPLMRISPLPLRGVPVCPS

SEQ ID NO: 921002 - protein, 455 aa, Homo sapiens
MQAQDGLQVSPAQDGHQVTLAQDGLQVTQTQDELHVTQAQDWLQLHIDALCDEGLTDDLEGADWASAIRVAALDCMEEKNQAVCHDYDIHFYPTFRYFKAFTKEFTTGENFKGPDRELRTVRQTMIDFLQNHTEGSRPPACPRLDPIHVKPLRAFFSSYLKSLPDVRKKSLPLPEKPHKEENSEIVVWREFDKSKLYTVDLESGLHYLLRVELAAHKSLAGAELKTLKDFVTVLAKLFPGRPPVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLAGHLSEDPRFPKLQWPTPDLCPACHEEIKGLASWDEGHVLTFLKQHYGRDNLLDTYSADQGDSSEG

SEQ ID NO: 921003 - protein, 433 aa, Homo sapiens
MQAQDGLQVSPAQDGHQVTLAQDGLQVTQTQDELHVTQAQDWLQLHIDALCDEGLTDDLEGADWASAIRVAALDCMEEKNQAVCHDYDIHFYPTFRYFKAFTKEFTTGENFKGPDRELRTVRQTMIDFLQNHTEGSRPPACPRLDPIHVKPLRAFFSSYLKSLPDVRKKSLPLPEKPHKEENSEIVVWREFDKSKLYTVDLESGLHYLLRVELAAHKSLAGAELKTLKDFVTVLAKLFPGRPPVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLAGEKPLGMGGSARAEGGPGPGTARTARLPWGLSLSFAASCHPLC

SEQ ID NO: 921004 - protein, 178 aa, Homo sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKGEIYRWREEAGDIASKSESKFLKRRQFTAKEESEVRSWDWV

SEQ ID NO: 921005 - protein, 265 aa, Homo sapiens
MSRETLGSSAGRMMQGHTERLLCVTCWVRNRRIRASMLRLPGPGREKLTQPSAWKTWASQARGSAHVGQPVTPGFSSHLPEENALRPPCRLWAGALPPPPKDPASPDFTLLQLPSSPPAPLGPAAPSHPTCSNAPSTQRECVTIHASWCHCPAGSRRRLALFSGCAVLCQPHRSCPQVLASAPWVLYSMFTVPTPTVRHGFRVPCAQNSSPRGSAHPQDLSHSHFPRVGLLTLESVRCSGTRSLGSRVVMPVSWWAARVNPNVTP

SEQ ID NO: 921006 - protein, 478 aa, Homo sapiens
LVQVRRFKDLQPGLSGSVGTAARDDSLGSESGLWLRLSACVSSPVGWGIPWHPHDEQDAMGLSPGQTSVSFLWPLLEVRDHNTGRGLVPATVLTPGSPETLLELRQAFLGSRQARHGHDAAPSSGQQGCSVDRTAGRPVLGWRLRNSLTGQEGRQHLHLSGIRTSRKAKEYKPVFFGATEISVLMAVAESLREPPPPQWGWFLSSLFLKIFLKCLEETLGSSAGRMMQGHTERLLCVTCWVRNRRIRASMLRLPGPGREKLTQPSAWKTWASQARGSAHVGQPVTPGFSSHLPEENALRPPCRLWAGALPPPPKDPASPDFTLLQLPSSPPAPLGPAAPSHPTCSNAPSTQRECVTIHASWCHCPAGSRRRLALFSGCAVLCQPHRSCPQVLASAPWVLYSMFTVPTPTVRHGFRVPCAQNSSPRGSAHPQDLSHSHFPRVGLLTLESVRCSGTRSLGSRVVMPVSWWAARVNPNVTP

SEQ ID NO: 921007 - protein, 143 aa, Homo sapiens
MTAGEDARATGRSGHVETEAEAGVKWPKARARLGHQKPDEYRKQPRNMDLSPERFLDVGDPPSVLGGCCCQASETILEFSSVRALPGWAMVYSGCHLDTALSPGHDAVPKAQRRQRPHPTLELQRRFAHFTLPEAQEPGAKTR

SEQ ID NO: 921008 - protein, 123 aa, Homo sapiens
MEPPKQKLSMLIRRKLAGLSLKEESEKPLIERGSRKWPGIKPTEVTIQNKILLQPTSSISTTKTTLGHLAAVEARDAVYLKYLASFEEELKRIQDDCTSQIKEAQRWKDSWKQSLHTIQGLYV

SEQ ID NO: 921009 - protein, 2352 aa, Homo sapiens
ALAEATVASRDGGGCNRTCSIPEELTKALEQKPDDAQYYRQRAYCHILLGNYCGADANFSDWIKRCRSSEWYVISHVCGEYETLVFYWPSLLCLAFLLGRFLHMFVKALRVHLGWELQVEEKSVLEVHQGEHVKQLLRIPRPQEKKKSWFQTRIYEWDPCFQFPSRMIGTIVLAFICLYLFIVIEFCVFVYVRDELDVLENNLESYITFTNHSGVLTPVILQVKELISVTKGVWVATILPAYLTCVSYLFHILVCYRKHMKRLWAGDKHFLPLKFHNPASSESMVAIARYSGWQIAYILWGYLIIHMVQSLCGMAIMYSLVLPIVQTRAWKCCKGWALGCKCWAGILSLTCSESWVPPTAMWTHGLGPDPEMGHDSNSWWGETAFTKGCLSHHSTMPSQPCMGWGIHMSIFQLGKLRFRKVKGEARQYDGRKQGILAKLLDLLCDLGLSFLLCTMGVGMPCKCKDMELTLPLSCRVVNLSPLSHWASEKDLAEGKRLPQDGPTLCFSLTISIVVGLMILQMCIAASFFLQPKLGTADKQKPLALNNRKAFHNFNYFLFFYNVLLGLGACLSRLLISCLLGMWLIARIDRTIMQSGYEGADMGFSAWIGMLYMDHYHINPVLVSFCHILITNHREKKLQQSTKYWCLNQSAESLRICAMRGGENRPPARVQSSSESTFPSRLPPSRESFPGESCPGVPPRGQTSSRLDLNLSLGRAISQPQELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAARERVTSPHPNPPPVNPRGIRLSTWIKGTAEHMAGAQTWKQVAQIPAQLLANLVLQPPMTEFPHMQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQLKKLRKKQGSKEDMTRSEESISSGTSTARSVEEVEEENDQEMESFITEEVLGQQKKSPLHAKMDESKEGSIQGLEEMQVEREGSLNPSLNEENVKGQGEKKEESEEEDEKEEEEEEEKLEEEKEEKEAQEEQESLSVGEEEDKEEGLEEIYYEDMESFTISSGNTYFVFVPLEEEHCRKSHSTFSAMFINDTSSAKLRAGFFEHLEKWFDQCSLNTRVTVATKINELDSELELHLHLHQPRAQQIEKDIHNVRAAELLLHQEQLDSHCAGVTETLKKKRLMFCQFQEEQNVRSKNFRLKIYDMEHIFLNATRSQKLVTLSNTLHQELLSYVDVTQVSLRSFRQYLEESLGKLRYSNIEFIKHCRLFSEGGNFSPKEINSLCSRLEKEAARIELVESVIMLNMEKLENEYLDQANDVINKFESKFHNLSVDLIFIEKIQRLLTNLQVKIKCQALLSGLQNTILKDQEEDSDILTSSEALEEEAKLDVVTPESFTQLSRVGKPLIEDPAVDVIRKLLQGRGAWACGSRGSSEAGAGGAVCSPPVLCSCPGPSSPKGFKRHRCQPENSGKKAVPSASATSAGRNPGRDPAGSDLPCSVHSLQTTHPPLSHSFTPHPKPNKMERKYRVLGDKPPPAAEQRPPLISPLTLETSSLGVMNLAEKDGCDIRQPRCGLQLAANRGTARYRHCHGAGDSMVNKYRQVHVLDFKGIILTLLWESSENLLTVAEAPRPSGKLTDLAGAQKEVGQWDQAPDKLPSALFPHALHRRNNEGWPWLHSLQVGPGRRHGQTGKEECLLVSLPQGMPRAKARECGGEGRLVDPRSKGQSPMESSPAHGHPLWQEFYRKEKRPVTRPDCMCDTFDQCAENISKKILEYQSQANKYHNSCLIELRIQIRRFEELLPQVCWLVMENFKEHHWKKFFTSVKEIRGQFEEQQKRLEKRKECTRRNGQVFITNLATFTEKFLLQLDEVVTIDDVQVASKRHHQPCVMALGGW

SEQ ID NO: 921010 - protein, 445 aa, Homo sapiens
MILLNSELPNTKWPTHHCDKDPSQTGRGAWACGSRGSSEAGAGGAVCSPPVLCSCPGPSSPKGFKRHRCQPENSGKKAVPSASATSAGSFTPHPKPNKMERKYRVLGDKPPPAAEDFKGIILTLLWESSENLLTVAEEFYRKEKRPVTRPDCMCDTFDQCAENISKKILEYQSQANKYHNSCLIELRIQIRRFEELLPQVCWLVMENFKEHHWKKFFTSVKEIRGQFEEQQKRLEKRKDKNAQKLHLNLGHPVHFQEMESLHLSEEERQEELDSMIRMNKEKLEECTRRNGQVFITNLATFTEKFLLQLDEVVTIDDVQVARMEPPKQKLSMLIRRKLAGLSLKEESEKPLIERGSRKWPGIKPTEVTIQNKILLQPTSSISTTKTTLGHLAAVEARDAVYLKYLASFEEELKRIQDDCTSQIKEAQRWKDSWKQSLHTIQGLYV

SEQ ID NO: 921011 - protein, 123 aa, Homo sapiens; identical to SEQ ID NO: 921008

SEQ ID NO: 921012 - protein, 1443 aa, Homo sapiens
ALAEATVASRDGGGCNRTCSIPEELTKALEQKPDDAQYYRQRAYCHILLGNYCGADANFSDWIKRCRSSEWYVISHVCGEYETLVFYWPSLLCLAFLLGRFLHMFVKALRVHLGWELQVEEKSVLEVHQGEHVKQLLRIPRPQEKKKSWFQTRIYEWDPCFQFPSRMIGTIVLAFICLYLFIVIEFCVFVYVRDELDVLENNLESYITFTNHSGVLTPVILQVKELISVTKGVWVATILPAYLTCVSYLFHILVCYRKHMKRLWAGDKHFLPLKFHNPASSESMVAIARYSGWQIAYILWGYLIIHMVQSLCGMAIMYSLVLPIVQTRAWKCCKGWALGCKCWAGILSLTCSESWVPPTAMWTHGLGPDPEMGHDSNSWWGETAFTKGCLSHHSTMPSQPCMGWGIHMSIFQLGKLRFRKVKGEARQYDGRKQGILAKLLDLLCDLGLSFLLCTMGVGMPCKCKDMELTLPLSCRVVNLSPLSHWASEKDLAEGKRLPQDGPTLCFSLTISIVVGLMILQMCIAASFFLQPKLGTADKQKPLALNNRKAFHNFNYFLFFYNVLLGLGACLSRLLISCLLGMWLIARIDRTIMQSGYEGADMGFSAWIGMLYMDHYHINPVLVSFCHILITNHREKKLQQSTKYWCLNQSAESLRICAMRGGENRPPARVQSSSESTFPSRLPPSRESFPGESCPGVPPRGQTSSRLDLNLSLGRAISQPQELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQNLAGEVIFKFRQPEAHEKPSQKRVKKLEEEKEEKEAQEEQESLSVGEEEDKEEGLEEIYYEDMESFTISSGNTYFVFVPLEEEHCRKSHSTFSAMFINDTSSAKFIEQVTIPSRLILEIKKQ

SEQ ID NO: 921013 - protein, 1659 aa, Homo sapiens
ALAEATVASRDGGGCNRTCSIPEELTKALEQKPDDAQYYRQRAYCHILLGNYCGADANFSDWIKRCRSSEWYVISHVCGEYETLVFYWPSLLCLAFLLGRFLHMFVKALRVHLGWELQVEEKSVLEVHQGEHVKQLLRIPRPQEKKKSWFQTRIYEWDPCFQFPSRMIGTIVLAFICLYLFIVIEFCVFVYVRDELDVLENNLESYITFTNHSGVLTPVILQVKELISVTKGVWVATILPAYLTCVSYLFHILVCYRKHMKRLWAGDKHFLPLKFHNPASSESMVAIARYSGWQIAYILWGYLIIHMVQSLCGMAIMYSLVLPIVQTRAWKCCKGWALGCKCWAGILSLTCSESWVPPTAMWTHGLGPDPEMGHDSNSWWGETAFTKGCLSHHSTMPSQPCMGWGIHMSIFQLGKLRFRKVKGEARQYDGRKQGILAKLLDLLCDLGLSFLLCTMGVGMPCKCKDMELTLPLSCRVVNLSPLSHWASEKDLAEGKRLPQDGPTLCFSLTISIVVGLMILQMCIAASFFLQPKLGTADKQKPLALNNRKAFHNFNYFLFFYNVLLGLGACLSRLLISCLLGMWLIARIDRTIMQSGYEGADMGFSAWIGMLYMDHYHINPVLVSFCHILITNHREKKLQQSTKYWCLNQSAESLRICAMRGGENRPPARVQSSSESTFPSRLPPSRESFPGESCPGVPPRGQTSSRLDLNLSLGRAISQPQELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQLKKLRKKQGSKEDMTRSEESISSGTSTARSVEEVEEENDQEMESFITEEVLGQQKKSPLHAKMDESKEGSIQGLEEMQVEREGSLNPSLNEENVKGQGEKKEESEEEDEKEEEEEEEKLEEEKEEKEAQEEQESLSVGEEEDKEEGLEEIYYEDMESFTISSGNTYFVFVPLEEEHCRKSHSTFSAMFINDTSSAKFIEQVTIPSRLILEIKKQLFSEGGNFSPKEINSLCSRLEKEAARIELVESVIMLNMEKLENEYLDQANDVINKFESKFHNLSVDLIFIEKIQRLLTNLQVKIKCQVAKSNSQTNGLNFSLQQLQNKIKTCQESRGEKTVSVQ

SEQ ID NO: 921014 - protein, 199 aa, Homo sapiens
DHGRPAAVVAGPALAASRESLRICAMRGGENRPPARVQSSSEELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPPCSYFRLESAMY

SEQ ID NO: 921015 - protein, 290 aa, Homo sapiens
MILLNSELPNTKWPTHHCDKDPSQTGRGAWACGSRGSSEAGAGGAVCSPPVLCSCPGPSSPKGFKRHRCQPENSGKKAVPSASATSAGSFTPHPKPNKMERKYRVLGDKPPPAAEDFKGIILTLLWESSENLLTVAEEFYRKEKRPVTRPDCMCDTFDQCAENISKKILEYQSQANKYHNSCLIELRIQIRRFEELLPQVCWLVMENFKEHHWKKFFTSVKEIRGQFEEQQKRLEKRKECTRRNGQVFITNLATFTEKFLLQLDEVVTIDDVQVASKRHHQPCVMALGGW

SEQ ID NO: 921016 - protein, 445 aa, Homo sapiens; identical to SEQ ID NO: 921010

SEQ ID NO: 921017 - protein, 368 aa, Homo sapiens
ALAEATVASRDGGGCNRTCSIPEELTKALEQKPDDAQYYRQRAYCHILLGNYCGADANFSDWIKRCRSSEWYVISHVCGEYETLVFYWPSLLCLAFLLGRFLHMFVKALRVHLGWELQVEEKSVLEVHQGEHVKQLLRIPRPQEKKKSWFQTRIYEWDPCFQFPSRMIGTIVLAFICLYLFIVIEFCVFVYVRDELDVLENNLESYITFTNHSGVLTPVILQVKELISVTKGVWVATILPAYLTCVSYLFHILVCYRKHMKRLWAGDKHFLPLKFHNPASSESMVAIARYSGWQIAYILWGYLIIHMVQSLCGMAIMYSLVLPIVQTRAWKCCKGWALGCKCWAGILSLTCSESWGPPNCYVDPWSWP

SEQ ID NO: 921018 - protein, 1347 aa, Homo sapiens
ALAEATVASRDGGGCNRTCSIPEELTKALEQKPDDAQYYRQRAYCHILLGNYCGADANFSDWIKRCRSSEWYVISHVCGEYETLVFYWPSLLCLAFLLGRFLHMFVKALRVHLGWELQVEEKSVLEVHQGEHVKQLLRIPRPQEKKKSWFQTRIYEWDPCFQFPSRMIGTIVLAFICLYLFIVIEFCVFVYVRDELDVLENNLESYITFTNHSGVLTPVILQVKELISVTKGVWVATILPAYLTCVSYLFHILVCYRKHMKRLWAGDKHFLPLKFHNPASSESMVAIARYSGWQIAYILWGYLIIHMVQSLCGMAIMYSLVLPIVQTRAWKCCKGWALGCKCWAGILSLTCSESWVPPTAMWTHGLGPDPEMGHDSNSWWGETAFTKGCLSHHSTMPSQPCMGWGIHMSIFQLGKLRFRKVKGEARQYDGRKQGILAKLLDLLCDLGLSFLLCTMGVGMPCKCKDMELTLPLSCRVVNLSPLSHWASEKDLAEGKRLPQDGPTLCFSLTISIVVGLMILQMCIAASFFLQPKLGTADKQKPLALNNRKAFHNFNYFLFFYNVLLGLGACLSRLLISCLLGMWLIARIDRTIMQSGYEGADMGFSAWIGMLYMDHYHINPVLVSFCHILITNHREKKLQQSTKYWCLNQSAESLRICAMRGGENRPPARVQSSSESTFPSRLPPSRESFPGESCPGVPPRGQTSSRLDLNLSLGRAISQPQELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQNLAGEVIFKFRQPEAHEKPSQKRVKK

SEQ ID NO: 921019 - protein, 126 aa, Homo sapiens
MSPGLLTTRKEALMAFRDVAVAFTQKEWKLLSSAQRTLYREVMLENYSHLVSLGIAFSKPKLIEQLEQGDEPWREENEHLLDLCPGEWEALGKRGCRAVRSSAGKEGGAIFEVLGGSSSSGLLGHW

SEQ ID NO: 921020 - protein, 111 aa, Homo sapiens
MSPGLLTTRKEALMAFRDVAVAFTQKEWKLLSSAQRTLYREVMLENYSHLVSLGIAFSKPKLIEQLEQGDEPWREENEHLLDLCPESRSVTQAGVQWHDLGSLQPLPPVFK

SEQ ID NO: 921021 - protein, 145 aa, Homo sapiens
MAGRRADASRQLFVLWKVVLARDETGYFTEEISKQNVEEVTWFLPVDCSKMQEERNELKKELLSKNEPEFKDLENSLSVHMTKNEKVCTEENTKGVVDQPFHKEISVAVYHELNQPFQQRPGIQMGLHLQRHCWLGLKKTEHGME

SEQ ID NO: 921022 - protein, 219 aa, Homo sapiens
MGSTECVLLAVMAYDRYVAICNPLRYSIIMNRCVCARMATVSWVTGCLTALLETSFALQIPLCGNLIDHFTCEILAVLKLACTSSLLMNTIMLVVSILLLPIPMLLVCISYIFILSTILRITSAEGRNKAFSTCGAHLTVVILYYGAALSMYLKPSSSNAQKIDKIISLPALTQGTEQIGMEPSVLEWDIDQNGTTKWMRNNPDVRRGLRTEPGNYHNL

SEQ ID NO: 921023 - protein, 187 aa, Homo sapiens
AGRSPQKPPRPSQMLSFSYTSLPPFSLVQSLLCILLSYPPTLTHKYEPLFAFTWAGPDTHQPQQLTWAVLPQAFTDSPHYFSKAQIPSSSVTYLGIVLHENTCALPADHIPGFAILTEPLYKLTKPNLADPIDPKSVCHSSFRSLKTALETVPTLALPDSSQPFSLHTAEVQGCAVGILTQEPDHTL

SEQ ID NO: 921024 - protein, 303 aa, Homo sapiens
MSWLCFGPSLPWPHHGPSCPAPAAALALAWNLVLSRTCPDSAMALALLCLVPGPDPDPDPFLALHWSFPGPELAVAQHRPGSDPGPGLCPAIALALKWTWRCPGPGVTWLCIGLSLPCPYHRLALLCPVPVLTRPRYFPALPCLGYDPGPAPALALALALALDMSVVLTLALPWSCHCLGPALALALPRPWPCPGPSHRPALHRPGPICGLGLALTPAPDPGPAMALALPMTLAALTLALNWPCPGPEVDLQVSYLAMALRLPWTGAGTGMDPGPGPSLLKAIPWPSPGPNLAWLYPGMLFWP

SEQ ID NO: 921025 - protein, 124 aa, Homo sapiens
MARNKNACTYLTGWHDSCLGQVDSLNASTKEQIKEIAEAMQGQRPGRENGCRSRRLQLLLRLLSQAWLGLGTLQSPKGSTITGTHSLKGNLSLSKYRHTHASYRSVSLESPHTVVTSLFLGGAC

SEQ ID NO: 921026 - protein, 209 aa, Homo sapiens
MLPLAALGMASLSALRNSPRNFQAGRRAHRIDEGNGGSTEPPDPVPRVVKRPSCLAAQLQEIVAALESDAPSGAVHGGRRVKAEEEPSHWRVGVGAGIKDNFLEEGLFEPNSENKAATLSCSYKQSCQSEPPPESASNGLNAKEKRPQSSSGACPQSRALDQWLDRHEARSTVTPTYAAGHSWAPQGPWAGSSSPDEKDSKVKSGVLCS

SEQ ID NO: 921027 - protein, 142 aa, Homo sapiens
MLASWWSALPRYTGCRWEIPALATRAFSSFALSHLVPAFIVRAGERGSGGIRFCRAVCPLPIFLCAAKGTSTCPTVGGKPLSGLPLLWDEGTVITWACVTFYHWVKEENDVRDWEKERNLNIQVTENEVAVERRAAITEMEQ

SEQ ID NO: 921028 - protein, 338 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKFLNASNFKMYFEEVAKSLLQRHFEIGRTKTAAGAWETKISHREKRQQRKRDKVLTDSGSLDSTIPGIENTITVTTEQLTTASFPVGSKKNKVSSGLNENLTVNGGGWNEKSVKLSSQISAGEEKWNSVSPASAGKRKTEPSAWSQDTGDANTNGKDWGRSWSDRSIFSGIGTKIPRC

SEQ ID NO: 921029 - protein, 296 aa, Homo sapiens
GRVVDHASGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVLQMMIKKGRGSSSLGHPQKKQRRAGEILYGRNLRIERDKETQENYNGKRKGT

SEQ ID NO: 921030 - protein, 586 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKFLNASNFKMYFEEVAKSLLQRHFEIGRTKTAAGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 921031 - protein, 582 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 921032 - protein, 549 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIDGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 921033 - protein, 582 aa, Homo sapiens; identical to SEQ ID NO: 921031

SEQ ID NO: 921034 - protein, 582 aa, Homo sapiens; identical to SEQ ID NO: 921031

SEQ ID NO: 921035 - protein, 582 aa, Homo sapiens; identical to SEQ ID NO: 921031

SEQ ID NO: 921036 - protein, 582 aa, Homo sapiens; identical to SEQ ID NO: 921031

SEQ ID NO: 921037 - protein, 582 aa, Homo sapiens; identical to SEQ ID NO: 921031

SEQ ID NO: 921038 - protein, 337 aa, Homo sapiens
VDDSRPCGTSLEVRLGALDDSRPLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 921039 - protein, 415 aa, Homo sapiens
STAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQISSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 921040 - protein, 582 aa, Homo sapiens; identical to SEQ ID NO: 921031

SEQ ID NO: 921041 - protein, 149 aa, Homo sapiens
MEIFYRESFLKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 921042 - protein, 431 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIDGLSSADPNSDWNAPAEEWGNWVDEERASLLKSQEPIPDDQKVSDDDKEKGEGALPTGKSKKKKKKKKKQGEDNSTAQTQKN

SEQ ID NO: 921043 - protein, 386 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLSMSF

SEQ ID NO: 921044 - protein, 435 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSIRDSWVFIC

SEQ ID NO: 921045 - protein, 357 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIVVRSVRKI

SEQ ID NO: 921046 - protein, 214 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKHVKDTYEEIKADAKAANQLRLMEEFEELELIVQGNGGGTGGGRLAGHHSGKNH

SEQ ID NO: 921047 - protein, 214 aa, Homo sapiens; identical to SEQ ID NO: 921046

SEQ ID NO: 921048 - protein, 582 aa, Homo sapiens; identical to SEQ ID NO: 921031

SEQ ID NO: 921049 - protein, 582 aa, Homo sapiens; identical to SEQ ID NO: 921031

SEQ ID NO: 921050 - protein, 582 aa, Homo sapiens; identical to SEQ ID NO: 921031

SEQ ID NO: 921051 - protein, 582 aa, Homo sapiens; identical to SEQ ID NO: 921031

SEQ ID NO: 921052 - protein, 582 aa, Homo sapiens; identical to SEQ ID NO: 921031

SEQ ID NO: 921053 - protein, 582 aa, Homo sapiens; identical to SEQ ID NO: 921031

SEQ ID NO: 921054 - protein, 473 aa, Homo sapiens
ERGKLSHLPGVKTLEMLIQMEKTGEGVGGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 921055 - protein, 327 aa, Homo sapiens
RRLQRTPSIGGQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIDGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 921056 - protein, 234 aa, Homo sapiens
MLIQMEKTGEGVGVTVQYFLALNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 921057 - protein, 582 aa, Homo sapiens; identical to SEQ ID NO: 921031

SEQ ID NO: 921058 - protein, 477 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVLQMMIKKGRGSSSLGHPQKKQRRAGEILYGRNLRIERDKETQENYNGKRKGT

SEQ ID NO: 921059 - protein, 409 aa, Homo sapiens
MAARSWQDELAQQAEEGSARRAGNALGRPRLSAHRAGPRPGAGAETVPRLGDPGGHWRARAAAAVSAGLRLGRGLRRRPQKAEEPAPQAGGGGGRAGRGPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPIPSHMAEKKIIIKWLYFLV

SEQ ID NO: 921060 - protein, 357 aa, Homo sapiens; identical to SEQ ID NO: 921045

SEQ ID NO: 921061 - protein, 132 aa, Homo sapiens
SVDSFSFPGMFLWQFLEQKFMVCVYTCHSVRPSGGCKLVLPPIRHFPSIGSTLEVRVPLEKIGDSWNWVPGKAMDTQCQPMNAAGREAVPCKATGVELPKTMGTHLLHQHDLDVRPGVKGDHLAALRFDCPA

SEQ ID NO: 921062 - protein, 115 aa, Homo sapiens
MQAGSGGRGPCTGASLTAPGSIIFTADPAISFPVAPAQAWALALPGLNWVRGPSLSQSLALGGCGISIGQACIKHLGVELPCPHRREAKPPSAIVSPGLGKRISSPLHQKQPEDL

SEQ ID NO: 921063 - protein, 166 aa, Homo sapiens
ALHGTMSCTPGTPRALHPHQYCFLRSSQLPVQSFPKYPQLVTAAALGGQDEEPQAPGSTSDPQSEAARWGPGAPAPVHCEGPRLQAPASSGIRCPADHHPYRTLALQIPSPINLQSYRSLALQSLVLWTEHSTDGGEVWVRGAPLGDAQTAHGQQAEVPSPPHDHH

SEQ ID NO: 921064 - protein, 121 aa, Homo sapiens
MKLSDPAGPGLPCGRTHSLTLNRQVPRAISSSPVQLGPGHGKERNVALPRAPQTHQALHVESARDTHVNAEGGKRARLKPEVEEDPTKEGHFCNKRKEKRRREGQFHITSSRKLPSSPQCN

SEQ ID NO: 921065 - protein, 125 aa, Homo sapiens
MKYCRLAGLSNRNLFAQSSGVWQSNMECFNEDAAKAPTWDSALQEYGTVIQDAVYALDQGCLCSALPLTRKIHGSMDQEDGSRSDPTYHHCQTHLVPLGTSLSNYGYEWTNITTKEEYGYKNTDL

SEQ ID NO: 921066 - protein, 226 aa, Homo sapiens
FWQLRSHLMAEGSRTQAPGKGPPLSIQFLRAQYEGLKRQQRTQAHLLVLPKGGNTPAPAESMVNAVWINKERRSSLSLEEADSEVEGRLEEAAQGCLQAPKSPWHTHLEMHCLVQTSPQDTSHQVHHRGKLVGSDQRLPPEGDTHLFETNQMTQQGTGIPEAAQLPCQVGNTQTKAVESGLKFSTQCPLSIKNPHRSGKPAYYPFPQRKTPRISQAARNLGLYGSA

SEQ ID NO: 921067 - protein, 139 aa, Homo sapiens
MGRARPRTAVCTGPVAAALGVQRIDRRQTSLAVIARALDREGWGRRGLWAGDSGRPEGAAGTSASRTDCAPLPQGGPASTRSSVTVLLLPGRRLPKVAPESTNGSGGSAAGAGAALPTCSFRLIYFSTTMPGTGTLCQA

SEQ ID NO: 921068 - protein, 107 aa, Homo sapiens
MGGCGLTRIPPKDSLYTPRACEQDLFWRWVFADVVELRQGHAGVGPALIQRLGPLAGEGEPWEGARSCDTQILDFWPSELREHTFLRFEATKFLVICSGQEINTRDK

SEQ ID NO: 921069 - protein, 107 aa, Homo sapiens; identical to SEQ ID NO: 921068

SEQ ID NO: 921070 - protein, 163 aa, Homo sapiens
MQSRGVRAVSSPPSPVGSTGRRSPAHSVTKTTFLIISVISTKTEHASNRDHSSFPVYFYPRLTQRLHPRLSRRPLVPHRSTQGCQPPGPSPAPPAPVPPGGRSEGASAGREAQELSPYPSPTPTPSKTRDQYLTTLTLKIRIVLFQGQTQRLNVKVPGLRGVT

SEQ ID NO: 921071 - protein, 188 aa, Homo sapiens
MEPQARPPPRRSQASRQPQQPGPRHRLRGSPGRRKCGARWGRGRGGALGWRRATAGLSFSVTRECLCVLIRSSSPGRYFRREDSERGRGEASRGPGDPCSPVLRPLASRPWAGAASRGWRRAVGRWGGALAPPRAARRFAEAAAVAFLKGWGLEVSFATRKSPLPPAPRWIILDLSAPPPPLSFALAD

SEQ ID NO: 921072 - protein, 142 aa, Homo sapiens
MLNFNNMVQRWTSLTQRAIQEFIYSSMHKVIYSCIYEALIHSFIHEFLNVFINLFSKLPFKAYHAKTAKLSCVWNEDDSPSSQNASLRGEGKDLRIKIVNIRSLQNMCYKSSVKVQKQDLLLFGAEVWGIGSILVRRRRSLS

SEQ ID NO: 921073 - protein, 158 aa, Homo sapiens
AYEYFKMYRTTLELMWFIKMTFCEEGGLQGGTKQSPKRTLAHEKKHTLKNEVFPVISFQSSFPSGNFCIRCDWTLRGDACYAGPGPPVSWNRWFLHTHLNKAVMVLAHKHGTGEPFYTKRKVFLGCCVKINFYSATGFHFRHSLSSFLDISSIDCCSS

SEQ ID NO: 921074 - protein, 133 aa, Homo sapiens
MLITGQAAPARVRASGPTARKGQEKHGHPCDPHAPLCPAGTPVPRTHPCALHAPLCPAHTPVPCTRPCAPQAKPHFAVFDMLSSQKRFCFETTRARRRRGVRVVGLVVQEAALGVESVDHLEACGVPWEAVLT

SEQ ID NO: 921075 - protein, 137 aa, Homo sapiens
MCCPGWPLLDRWTGSRGSSLDFLYQHVDLFSKIEDSFLNYILKNVFQVAHFLFFSVRNASAEVTKCQKRPVPVGTSLQQGQSCWRNLRSSLFQPTFLGSQQDDHCWICSSALGRGQRARDDHLSKSVPRLWCAPFSS

SEQ ID NO: 921076 - protein, 457 aa, Homo sapiens
MSYKPTTPAPSSTPGSSTPGPGTLVPTGSVPSPSGSGPGATAPFRPLFKDFGPPTIGCVQAMKPPGAQGSQSTYTELLLVTGEMGKVIRPTYAGSKSAAERLKREEALKATEDLREEAAQALAQSDRKCHEFNRQVTVQWKEKDFQGMLKCHKEGEALLILNLVTDLKPQMLLDTVPCIPAYILYMCIRLADQTNDDLKVHSLMTSTTNGIKEVLKKHSDDFEMTSFLLSNTCHLLHCLKRYSGDEGFMTQNTAKHNEHCLKNFDLTEYRQVLSDLSIQIYQHLFKIAEGVLQPMIVSAMLENESIQGLSGVKPTGSQKHSSSMADEDNSYRLEAIIRQMNAFHTVMCDQGLDPEIILQVFKQLFYMINAVTLNDLLLRKDVCSWSTGMQLRYNISQLEEWLWGRNLHQSGVVQTMEPLIQAAQLLQLKKKTQEDAEAICSLCASLSTQQIVKILNL

SEQ ID NO: 921077 - protein, 457 aa, Homo sapiens; identical to SEQ ID NO: 921076

SEQ ID NO: 921078 - protein, 2295 aa, Homo sapiens
YLPASCLYQSEMTEPDPPPGGLRRQQKNCLFHSNITSDLKAFTDKFGFDVLILFSSYLSEEQQPRRQIAVYSENMELCSQICCELEECQNPCLELEPFDCGCDEILVYQQEDPSVTCDQVVLVVKEVINRRCPEMVSNSRTSSTEAVAGSAPLSQGSSGIMELYGSDIEPQPSSVNFIENPPDLNDSNQAQVDANVDLVSPDSGLATIRSSRSSKESSVFLSDDSPVGEGAGPHHTLLPGLDSYSPIPEGAVAEEHAWSGEHGEHFDLFNFDPAPMASGQSQQSSHSADYSPADDFFPNSDLSEGQLPAGPEGLDGMGTNMSNYSSSSLLSGAGKDSLVEHDEEFVQRQDSPRDNSERNLSLTDFVGDESPSPERLKNTGKRIPPTPMNSLVESSPSTEEPASLYTEDMTQKATDTGHMGPPQTHARCSSWWGGLEIDSKNIADAWSSSEQESVFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGKKHSILPLPRNCCVD

SEQ ID NO: 921079 - protein, 153 aa, Homo sapiens
MGQPYWDTAITLLPLTFRLGPVLQGFHHVLHTSEATPGSLALLWLLLGPARRASQGRGRGRMTLSPPSPEKRGVRAAMSGEGGRCHSCARFLLLQGEPELVFWKMRTDALSARFESWILSLLDSAAACSYLGKEGSFRGPSEMSLPATGAQEG

SEQ ID NO: 921080 - protein, 1334 aa, Homo sapiens
MKCDIYVTWGETLSCTYEGMDSFLLLHSTPAPCTPYSSLTPNRTLTSQASADLHTYYQMYRVLSEMVTVAMERNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSDPRSYHTYGRTSAAAVSSKLLQARVMSSSNPDLAGTHSAADEEVKNIMSSKIADRNCSRMSYYCSGSSDAPSSPAAPRPASKKENEQAEKMNISLAFFLYDLLSLMDRGFVFNLIRHYCSQSGTSSLSFLQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKNIQFIGTVQGFNDAVLPFPQASSALDCKDSLLGGVLRVLVNSLNCDQSTTYLTHCFATLRALIAKNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEKFEIKVPALLVPSEGCEERVCSRPLSLTCGQPSSPCVSSHHLPSVFVSRFPLLFVLTPIEVAIEDMKKKTLQLAVAINQEPPDAKMLQMVLQGSVGATVNQRNWISPQKF

SEQ ID NO: 921081 - protein, 1753 aa, Homo sapiens
AWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVRRETNICLKSGWAAHPCHFTQVRDSSVYKVRLFQANTAQHVQGLLCPGYQWGNRVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 921082 - protein, 1557 aa, Homo sapiens
MPVRRETNICLKSGWAAHPCHFTQVRDSSVYKVRLFQANTAQHVQGLLCPGYQWGNRVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 921083 - protein, 1401 aa, Homo sapiens
MHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 921084 - protein, 1753 aa, Homo sapiens; identical to SEQ ID NO: 921081

SEQ ID NO: 921085 - protein, 1755 aa, Homo sapiens
AWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVRRETNICLKSGWAAHPCHFTQVRDSSVYKVRLFQANTAQHVQGLLCPGYQWGNRVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRTLCCLSAYVYQLQNIFNFDFF

SEQ ID NO: 921086 - protein, 791 aa, Homo sapiens
AWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVRRETNICLKSGWAAHPCHFTQVRDSSVYKVRLFQANTAQHVQGLLCPGYQWGNRVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQVIKELFN

SEQ ID NO: 921087 - protein, 257 aa, Homo sapiens
AWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVRRETNICLKSGWAAHPCHFTQVRDSSVYKVRLFQANTAQHVQGLLCPGYQWGNRVSLT

SEQ ID NO: 921088 - protein, 103 aa, Homo sapiens [sequence omitted]

SEQ ID NO: 921089 - protein, 222 aa, Homo sapiens
AWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNK

SEQ ID NO: 921090 - protein, 146 aa, Homo sapiens
NCWFFLPEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQDAS

SEQ ID NO: 921091 - protein, 1667 aa, Homo sapiens
MKCDIYVTWGETLSCTYEGMDSFLLLHSTPAPCTPYSSLTPNRTLTSQASADLHTYYQMYRVLSEMVTVAMERNLLYVYPQRLNFVNKLASARNITIKIQFMCGEDASNAMPVRRETNICLKSGWAAHPCHFTQVRDSSVYKVRLFQANTAQHVQGLLCPGYQWGNRVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 921092 - protein, 1278 aa, Homo sapiens
MRPRVERNSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 921093 - protein, 1753 aa, Homo sapiens; identical to SEQ ID NO: 921081

SEQ ID NO: 921094 - protein, 257 aa, Homo sapiens; identical to SEQ ID NO: 921087

SEQ ID NO: 921095 - protein, 140 aa, Homo sapiens
MYLNQIHLLLKELATIYLHQRCPVFTIKDVNLAAPPSKAWGACPGRRSRPRGPGQPPRCPPLLHLLPSSPGPPAPTLKGRSSHSRLLLLQPRLRHGLVPLLRISYVQVHCRLLHHPLQLPGLATGGSFVDLPEIPMVNHL

SEQ ID NO: 921096 - protein, 140 aa, Homo sapiens; identical to SEQ ID NO: 921095

SEQ ID NO: 921097 - protein, 339 aa, Homo sapiens
MTHLNSLDVQLAQELGDFTDDDLDVVFTTKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKAILFAVVRKPDPFSVHQNDWLEINKHQIEKVLQQGEIGDCAEPYTVIKESDGGKQGLTA

SEQ ID NO: 921098 - protein, 182 aa, Homo sapiens
MTHLNSLDVQLAQELGDFTDDDLDVVFTTKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEVRD

SEQ ID NO: 921099 - protein, 187 aa, Homo sapiens [sequence omitted]

SEQ ID NO: 921100 - protein, 436 aa, Homo sapiens
SFHGKIMEHVDWIIREGLYLERRHLGRILNELDGHLKEKYSSQKEHCSPVEISSRPAPVAPVTFRNHCPGLFQPPKHSVFTPQFYDPVEPVDFEGLLMTHLNSLDVQLAQELGDFTDDDLDVVFTTKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKAILFAVVRKPDPFSVHQNDWLEINKHQIEKVLQQGEIGDCAEPYTVIKESDGGKQGLTA

SEQ ID NO: 921101 - protein, 191 aa, Homo sapiens
MTHLNSLDVQLAQELGDFTDDDLDVVFTTKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRRMLWKYVQYQNVPRNTWATEYWSSC

SEQ ID NO: 921102 - protein, 162 aa, Homo sapiens
MIYLSNNSPFHWTLCAIKLSFQLTVNNILLILLLQLCRLSDMVFVPPAINESPKLKSRYIITSKLCDLEQVTSTISGSISSFQTEGAGIWEMTVPVAALQGSSAGSANKQCICKIKRVRVERIMASGSGRQVSRLQQALERRFQPHVPGVFLQGVHLSAAGS

SEQ ID NO: 921103 - protein, 147 aa, Homo sapiens
NCRGWQGGLSYADGPRSDRTPESACPCVCAARRTCFRRCSQDCGTGGPSTLQYRLLPLPLGVRAHHDVARLTAFSEVGVPANRTELSMLEPDPRSPFALRPLRAGLGAVYTRRALTRAGLYRLTVRAAAPRHQSVFVLLIAVSPYPY

SEQ ID NO: 921104 - protein, 785 aa, Homo sapiens
APVFQVEPQDMTVRSGDDVALRCQATGEPTPTIEWLQAGQPLRASRRLRTLPDGSLWLENVETGDAGTYDCVAHNLLGSATARAFLVCASHAIVGSRHFRDPQVFCEFVVPPPHFTGEPQGSWGSMTGVINGRKFGVATLNTSVMQEAHSGVSSIHSSIRHVPANVGPLMRVLVVTIAPIYWALARESGEALNGHSLTGGRFRQESHVEFATGELLTMTQVARGLDPDGLLLLDVVVNGVVPESLADADLQVQDFEEHYVQTGPGQLFVGSTQRFFQGGLPSFLRCNHSIQYNAARGPQPQLVQHLRASAISSAFDPEAEALRFQLATALQAEENEVGCPEGFELDSQGAFCVDRDECSGGPSPCSHACLNAPGRFSCTCPTGFALAWDDRNCRDVDECAWDAHLCREGQRCVNLLGSYRCLPDCGPGFRVADGAGCEDVDECLEGLDDCHYNQLCENTPGGHRCSCPRGYRMQGPSLPCLDVNECLQLPKACAYQCHNLQGSYRCLCPPGQTLLRDGKACTSLERNGQNVTTVSHRGPLLPWLRPWASIPGTSYHAWVSLRPGPMALSSVGRAWCPPGFIRQNGVCTDLDECRVRNLCQHACRNTEGSYQCLCPAGYRLLPSGKNCQDINECEEESIECGPGQMCFNTRGSYQCVDTPCPATYRQGPSPGTCFRRCSQDCGTGGPSTLQYRLLPLPLGVRAHHDVARLTAFSEVGVPANRTELSMLEPDPRSPFALRPLRAGLGAVYTRRALTRAGLYRLTVRAAAPRHQSVFVLLIAVSPYPY

SEQ ID NO: 921105 - protein, 155 aa, Homo sapiens
AGVMKILSFNRSSGDRVECATQKPDFSPFSVKSYLFSYMPGPQRRRDTEPSVSVIIFHENRSSGHMVVAGFCRQGAAATARRGMELDPGPRRTSHDTTPHLGSRVERLLQGIYTLPEPAASYGKGSPVTSHEETRPTASLRWPQGEESGPTWCNE

SEQ ID NO: 921106 - protein, 66 aa, Homo sapiens
ALEALAAAAMGPLALPAWLQPRYRKNAYLFIYYLIQFCGHSWIFTNMTVRFFSFGKGKTPKQFFYF

SEQ ID NO: 921107 - protein, 66 aa, Homo sapiens; identical to SEQ ID NO: 921106

SEQ ID NO: 921108 - protein, 183 aa, Homo sapiens [sequence omitted]

SEQ ID NO: 921109 - protein, 145 aa, Homo sapiens
MMLGRGIRPQLPVGRMIRKEFFTCTMKKEVNNLHLTSKCCINLGYNPVFSSYICIFNPRDTDSMVDTFYAIGLVMRLCQSVSLLELLHIYVGIESNHLLPRFLQILAENDVYELLISFQLTQCILTGIFPLMQRGKVEEGSSSAQ

SEQ ID NO: 921110 - protein, 183 aa, Homo sapiens [sequence omitted]

SEQ ID NO: 921111 - protein, 151 aa, Homo sapiens
QVIKVDIMYLHGEEQSITFALSCQEGMAWTLPETHSTECQASLFKTIMAMKKRKEIKAKADKHPPTFKAYYGQVKISPSHNMRAKKQNNCDFQRAGSQVSGKLPSALKGLHTLAGKEPRSCCREFIYTHLEFPDELTACWPRGLIPGLLAS

SEQ ID NO: 921112 - protein, 190 aa, Homo sapiens
MGAHTRIPTRAHTRAPITALARKRAATSEWDSACGGSARYFTISHLRVRLLPCWLHLQPQRFPAGAPELSRPKELLLRHKAQLHTVLQARGDPGRSRALAVPPPRCSGHRETAGARGRDLEARTTFPSSRCKFSLRPPRRPVTSAGTCCPRHHLPHPPGGHAGKLQLPTLRTGAPRRRADGPSHPAGRQP

SEQ ID NO: 921113 - protein, 230 aa, Homo sapiens
CPRQTLLINRSSSKQLHCSILISTAADWPSLILANDLEPLVWLLEGANRFSFSKAQMPSFPSAPLVDQSHSTQQKAGAASQGGTANASSPDLCNAPHSNRTSSFANRDKASRSPGSQGCWRLAVGLANHSGVVNPGLDSRQAPCGCPRHGSCFILNPLQSLWLLLQIQTGPALPTLYLAAASPHKVELSWTPGPAATLPPFALESQPILRDPLWAATLIRSPRRPIAREH

SEQ ID NO: 921114 - protein, 624 aa, Homo sapiens
MLHTAISCWQPFLGLAVVLIFMGSTIGCPARCECSAQNKSVSCHRRRLIAIPEGIPIETKILDLSKNRLKSVNPEEFISYPLLEEIDLSDNIIANVEPGAFNNLFNLRSLRLKGNRLKLVPLGVFTGLSNLTKLDISENKIVILLDYMFQDLHNLKSLEVGDNDLVYISHRAFSGLLSLEQLTLEKCNLTAVPTEALSHLRSLISLHLKHLNINNMPVYAFKRLFHLKHLEIDYWPLLDMMPANSLYGLNLTSLSVTNTNLSTVPFLAFKHLVYLTHLNLSYNPISTIEAGMFSDLIRLQELHIVGAQLRTIEPHSFQGLRFLRVLNVSQNLLETLEENVFSSPRALEVLSINNNPLACDCRLLWILQRQPTLQFGGQQPMCAGPDTIRERSFKDFHSTALSFYFTCKKPKIREKKLQHLLVDEGQTVQLECSADGDPQPVISWVTPRRRFITTKSNGRATVLGDGTLEIRFAQDQDSGMYVCIASNAAGNDTFTASLTVKGFASDRFLYANRTPMYMTDSNDTISNGTNANTFSLDLKTILVSTAMGCFTFLGVVLFCFPSPFLCGAEGKGKHKNSIDLEYVPQKKQWCCCGRGGSWTQEVQHENDLKAHPSHYCLFVNVGNQ

SEQ ID NO: 921115 - protein, 186 aa, Homo sapiens
MRKTHRGACLVLFIFWVLTECGSTNHPSCAVNQFQVLESSGDFASTFLGNWIGRTTLMFIGNKVKTKVWQDADSECSNTQAFRPCPIPQVVGLQGCVQWDTGMTLTGLIWEVNHGKEGARPECLEEVTPEGINFLGLPGGIYSSGQIMLSGREIQEATGLSTQAEKAGVRCTQTLKFEVFRTEIKH

SEQ ID NO: 921116 - protein, 160 aa, Homo sapiens
SYHTVQMMEDGSTRSLRDFFTVSFSWNSPWSCLLVTSIPGQVSTSLPAFRFTPVLVPQTLTIPISQSCTVAQMGQYVSLGPLHFSLANVPVLVHFIFQTAVQKKEWLWQLYEQRAFRKEEQMQGDKMKKPRHRLMSRTLKPVHGGASIQTQHTGRQSPCS

SEQ ID NO: 921117 - protein, 422 aa, Homo sapiens; identical to SEQ ID NO: 852230

SEQ ID NO: 921118 - protein, 146 aa, Homo sapiens
MERLRGSVSLGYFLLPQDLIQCLVRMKQEGTICEPENRPFPGTESDLILDSPDTQFTGFCYSSPNGLRQGDNLLTSHWVAGGDGVVSRKGKDRVPDSLLMKVLSQRLDQQDCIQKGWVLHGVPRDLDQAHLLNRLGYNPNSTLAFS

SEQ ID NO: 921119 - protein, 225 aa, Homo sapiens
LRLYLGKEEQKWVRMKVELLATERTEPEKQGVMKKKQLYSSATTWEMARLMLLKDNFIFGADGAVTTPSRSRALYCSTKVAWSGTVFGNRSLYGAAKASWAKRLVQTLKGLLGQCFAPSPSPPDPPTITNRNRVITTKADQKSKQRVHVIESGFPGALWLTYKVLEAHHLPICCFPYTNKALQTPDAMGEVGETNGKISKAKASSAAAVSPLEFPAVGLYILLQC

SEQ ID NO: 921120 - protein, 225 aa, Homo sapiens; identical to SEQ ID NO: 921119

SEQ ID NO: 921121 - protein, 158 aa, Homo sapiens
MLKTNYLLSLKDSLKAESSQFSFILLGLLHANSLQPAMLSGFSFLFPFSPFPSLSCCQSLTPLLTSSFLLTCCGIRSEVTKLAIILIYQQNKQTPVNTGNALPFAKYEMSFLNTRMPFSAYVILIHFILSVNFGESSVSLFCSVATFKWPLTLIISAE

SEQ ID NO: 921122 - protein, 232 aa, Homo sapiens
MNVSQQAEHKSSENLQPDNVIEEKNPFSEEKFKLAAEICISNKELNVNPQDNGENVSWHVRSLHSSPSHHSLRGLEENGFAGPRGGSPKPWQLPCGVEPVDAQKSRIEVWEHLLRFQKIYGNTWMPMQKFAAGMGPSLTTSARAVRKGNVGWEPPHRVPTGAPPGGPVGRGPPSSRPQNVRSTNNTMCLGKPQTLNTSPQKQPEGRLYPAKPQGQSCPIPWEPTSCICMIRM

SEQ ID NO: 921123 - protein, 82 aa, Homo sapiens
PRSPAGTPKLLLHREPKQKTDQGGPDDRTPMGPTLGLPQAPLVVLFPPTAWGCTAAAAASSSTATPVPAAAASPPFFKGSAA

SEQ ID NO: 921124 - protein, 347 aa, Homo sapiens
MDRYGSTNPIANCTCKGSRLHFPYENLMPDDLRWNSRIQKPSSTVPSMKKIVFRKAGPWCQKSWGPLAWTTEIGYSQIWKLGSPRSRWCVRSWFLQMFVASLTSGVKLHTLAVSVTQLLKVAHPELLIPLAGFVVSLTSGVKLQTFTVSVTALKGGTSGVVCSSVWVRGLSGFKSAAADLHGWQVPPGPLACPEMLSGSKDLEPKALAVYLMYSTAAKLAPTPQYKVLPTLLSPLHRQRGLPLWPPPPLVHGGDWFLPGHHDVRLKPKGSSVSLWSMLQGLELTCKGSGIPSGPAAVPRTLDMTLSPNKIMCENRAHLKRAATEKHYALTERCKSGLNMPGNLNIEK

SEQ ID NO: 921125 - protein, 179 aa, Homo sapiens
MTEQYPLSKQDELYHRFLECGSKIFIPAVGSQPCFSYLLARKQSWPLGYNKPCVHSCRREQGGGCAWRPGVLPTIMGHLWHHVAGRNSFGVGFCPAVMSLKRKALLNICIALKPVPWRYCDLLPVRGKAECALRLPWEKSPRGLSCGRKEGSIPAHTSFSPDREIAHIFGAYSVLGTVL

SEQ ID NO: 921126 - protein, 146 aa, Homo sapiens
PKWMLLPLRGISFNSHVEKGAKWTLVHCHSHTCTDPRVHTDTDPRPPPCPSTKGCGKPYTQRCLFPVFSVKNKNKTPEKAKLPWVAECQPLSSVVHGGLADYCKKGTGQKDYVVSLRKKFVWGLWAVNALGTIWKTGSCLGIYRAG

SEQ ID NO: 921127 - protein, 197 aa, Homo sapiens
METAVIGVVVVLFVVTVAITCVLCCFSCDSRAQDPQGGPGRSFTVATFRQEASLFTGPVRHAQPVPSAQDFWTFMDARVPRICSPAHKRDKHWQRDGPRRAAGRRHWSSGLQSQLCSSGSYDEGCIQCVDVPSPQAGNPLSQSLIFASFISSVSQVVFFHLLLCVHPFEIISIQEKTRWNPVTGHHGHMQGRRRSPQ

SEQ ID NO: 921128 - protein, 321 aa, Homo sapiens; identical to SEQ ID NO: 887525

SEQ ID NO: 921129 - protein, 168 aa, Homo sapiens
MPQGARPHALLFIPQEEASSALFLPLLTLNSEYWLVQFWNFPLDHWPEDWLDEYWLQQIRLPGFFMAVSASTTAESERSLPRGGTRRSGPGKQMFPLLALSNRDSFMVTLEIWAYRSTAQQSGGENTQHKQREKIVTLFIKSCNFQIGLEKQLSNRGTSSTICIQACS

SEQ ID NO: 921130 - protein, 1385 aa, Homo sapiens
MSVTRLRPGAETAHLNSPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 921131 - protein, 376 aa, Homo sapiens
MTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 921132 - protein, 582 aa, Homo sapiens
NATLYWGLNTLLRKPPAFGFCLNKSSCRRPGYATTLGYVSGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 921133 - protein, 1077 aa, Homo sapiens
MSVTRLRPGAETAHLNSPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKYVSVTVISNS

SEQ ID NO: 921134 - protein, 85 aa, Homo sapiens
KDFSRGLNVRVIDQDTAKILESERFDTHEYRNESRRLQEFLRFQDPGRIVAIAVGDSAAKSLLQGTIQMIQERLGSELIQGLGYR

SEQ ID NO: 921135 - protein, 1385 aa, Homo sapiens; identical to SEQ ID NO: 921130

SEQ ID NO: 921136 - protein, 217 aa, Homo sapiens
MAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 921137 - protein, 1003 aa, Homo sapiens
MSVTRLRPGAETAHLNSPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVGLANV

SEQ ID NO: 921138 - protein, 1151 aa, Homo sapiens
MSVTRLRPGAETAHLNSPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGDGVSLCCPGWSAVHRHSCGTLQP

SEQ ID NO: 921139 - protein, 234 aa, Homo sapiens
MYSELFVEIVDPVDIYLNLLQTIFDFHAIKSLLTGPSQLKIRVDAMHGVMEPYVRKVLCDELGAPANSAINCVPLEDFGGQHPDPNLTYAMTLLEAMKGGEYGFGAAFDADGDRYMILGQNGFFVSPSDSLAIIAANLSCIPYFHQMGVRGFGRSMPTSMALDRRSREGLLEEIRHRTKDQKQVSGPDCDAGIRNDTHTCENTYSSEERVTAVIRTQLMAKGYDLANFTANKMC

SEQ ID NO: 921140 - protein, 108 aa, Homo sapiens
MVTRAGGAAGSQTRVPGSRPEFDRGPCARQRGSETKDRGRRGTKPGGGVRVARAGMGPALLLRAGHPLFLFILKEREKRNCYGKRGGRGTQSISPAPLPPGRIGYAGI

SEQ ID NO: 921141 - protein, 108 aa, Homo sapiens; identical to SEQ ID NO: 921140

SEQ ID NO: 921142 - protein, 1335 aa, Homo sapiens
MLSPTFVLWEVGYPLYIYGSIFIVIVIIWQVKRSHHELSSEPKRSCCRCHQKVRQRARDAASTARRRSREEAEKPQKLLSIIKSQGWLPLERSVRRILCADPCCQICNSVALEIQQLLVGENNQISLTLSGPLQGSSCLEMLSTSSMSLDQSLEFHSWHTRELSLSSVTPTLSQLTDQKSLTQSAAQSTYADGIQDYWADHLQLGQEFQVPDVLRGPNTIASSRIEKPRAPLNQEEMTQSNPSLVQGNQGQHHLNSQVSLLSLNPETLNRMHPMALHMVLPAHLPFLSPEVLRLLEVHVKKWMHFQRWGLPRRVEESLRQLMPNPPLYYQPGNDQPVSFNLKNTPQVSLHRFETISLQTWCSCVAGQPIQTFWVSEWSTMNPEQRHHCQQTPNPMALALPSPALKALSGPHPQSGGQDNDSGSDLQQKYSQLFCGLPSLHSESLVATFMGSQGLPKIENVPKPPLKDPFLFNELSFPQLLPKTSPQSAPPSSPLSPNWMSPSDHQRAQINVPFLTLAEYEALEWHLLQRQLQLQWGWPAALQRSQHTQCLMQHEPCGKAQSPETTTASQTGKSISVLTRELLFFPEHARKLLEFHIQKQLIRHRWGLPQKIQQSIQLLLTSTDQQTVSSSSTALANVSIPQPVALEANGACDVLSPIAAPVSIPRPHLLTQVKAILQSHIDSKCGQIHQGKIPACVHRSWDCRISGVLAVAPFPCIPESQFLELQTASDPDLHHKVMPWMPTALDQQQQALPGTVTEHPKLLRVLSVEAIEKLETTLRHKHLAFLSGLPALYYVALPRALAPAVTSQSVITEMEPSPVEIPAEPLIQMVSFEEQCISLGPCPQGNNESCTDVAKEFQPAVPVKGTMETLPLESQTHPTSPHSLQTHILTKLNFHLRKKVLEIQWGIPIRARKSREQTVAAPENISTQKSLESLNHQGETLLQELPIPPDTLPAPNPEGVHLKEQLANDLKAVQQNQKQSNSKAVPQGSAHSVSKISQPSGDMTEAHMPCVQVEANVNKPSLEEPCGPEPQSPSKSKDPAHVPMLAGNREDPEETKAARDHREGDAGFGRSSTREERRPAEDQRPAGMLPNKTPRGSWRWSRSFHLADPCQHSPQHHPQLKLPQLPPRVPGEKESEKDLQDSQTKLTVILEPATIPENAQTVLPQASQGQPFLSQPTQAKPLQGQTLQGQVLHGLVMPVHAQKKPSLTESSFRNKIKCFLQHINPKTKGKGHEDSMFSAAAKVAKTRKENVAKSLAPAKSPVGRSKTEKPTGCSKAQSRPAQKLVGPAFLDGPQSLDDKLRLHSRQPGSASALGYPRHCPRHCPREACANKPGHPT

SEQ ID NO: 921143 - protein, 287 aa, Homo sapiens
MLATKMMRLAERAAPSPAQPHVLLSNLSLMDICGTSSFVPLMLDNFLETQRTISFPGCALQMYLTLALGSTECLLLAVMAYDRYVAICQPLRYPELMSGQTCMQMAALSWGTGFANSLLQSILVWHLPFCGHVINYFYEILAVLKLACGDISLNALALMVATAVLTLAPLLLICLSYLFILSAILRVPSAAGRCKAFSTCSAHRTVVVVFYGTISFMYFKPKAKDPNVDKTVALFYGVVTPSLNPIIYSLRNAEVKAAVLTLLRGGLLSRKASHCYCCPLPLSAGIG

SEQ ID NO: 921144 - protein, 657 aa, Homo sapiens
MTQGVISSRNTASYSVGSLLCTINVPFLTLAEYEALEWHLLQRQLQLQWGWPAALQRSQHTQCLMQHEPCGKAQSPETTTASQTGKSISVLTRELLFFPEHARKLLEFHIQKQSIRHRWGLPQKIQQSIQLLLTSTDQQTVSSSSTALANVSIPQPVALEANGACDVLSPIAAPVSIPRPHLLTQVKAILQSHIDSKCGQIHQGKIPACVHRSWDCRISGVLAVAPFPCIPESQFLVLQTASDPDLHHKVMPWMPTALDQQQQALPGTVTEHPKLLRVLSVEAIEKLETTLRHKHLAFLSGLPALYYVALPRALAPAVTSQSVITEMEPSNNESCTDVAKEFQPAVPVKGTMETLPLESQTHPTSPHSLQTHILTKLNFHLRKKVLEIQWGIPIRARKSREQTAAAPENISTQKSLESLNHQGETLLQELPIPPDTLPAPNPEGVHLKEQLANDLKAVQQNQKQSNSKAVPQGSAHSVSKISQPSGDMTEAHMPCVQVEASVNNPSLEEPCGPEPQSPSKSKDPAHVPMLAGNREDPEETKAARDYREGDAGFGRSSTREERRPAEDQRPAGMLPNKTPRGSWRWSRSFHLADPCQHSPQHHPQFKLPQLPPRVPGEKESEKDLQDSQTKLTVILEPATIPENTQTVVPQLHRVSLS

SEQ ID NO: 921145 - protein, 257 aa, Homo sapiens
MKRKKANSISALCHVKIQQEGGHLQTKKRALTKTLAPSLWELERGGYRRDGRRQRGQSPPDPLDSLWRSQSGEIPGNVTPCDFETTACGLWPVACGQWKEQLHPPFSVMAPGPAGTREPQEAGAAELGKPRERSYSLPGINFNYGLYIRGLDGGVPEAIGRWNVFKQQPTCPHELTRNYIAMNRGAVKAGLVTARENLLYRQLNDIRISDQDDRRMKKEPPPLPPNMTFGIRARKLSKQIEKFRSNITNSREPTTWI

SEQ ID NO: 921146 - protein, 178 aa, Homo sapiens
TANTAERQMLLPDRSSGSFISDGYLAVLQRFLLTFVQLCPAPIGGVYRGRQASLICGGLHTVPASRPLCLPTQASAMVGALPPASLLPCSSISDHCASNVQGSLGMGPSEPCAGYNLLVCHLLRPLEKRSIRVGVTQFSRCLSQLSLARKGNSLTPCTSQFCYLLQDFGYAHNIQGLK

SEQ ID NO: 921147 - protein, 222 aa, Homo sapiens
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDRSTYGLSIILPQTELSFYLPLHRVCVDRLTHIIRKGRIWMHKERQENVQKIILEGTERMEDQGQSIIPMLTGEVIPVMELLSSMKSHSVPEEIDIADTVLNDDDIGDSCHEGFLLK

SEQ ID NO: 921148 - protein, 222 aa, Homo sapiens; identical to SEQ ID NO: 921147

SEQ ID NO: 921149 - protein, 1051 aa, Homo sapiens
HLLLWGMVLQRGHIPLGLVCPWLLSTYKTLHNFFSSSELVACLSNWHIPGESDSAEDVVARVPGSQLTLGYMEEHGFTEPILVPKKDGLGLAVPAPTFYVSDVENYVGPERSVDVTDVTKQKDCKMKLKEFVDYYYSTNRKRVLNVTNLEFSDTRMSSFVEPPDIVKKLSWVENYWPDDALLAKPKVTKYCLICVKDSYTDFHIDSGGASAWYHVLKGEKTFYLIRPASANISLYERWRSASNHSEMFFADQVDKCYKCIVKQGQTLFIPSGWIYATLTPVDCLAFAGHFLHSLSVEMQMRAYEVERRLKLGSLTQFPNFETACWYMGKHLLEAFKGSHKSGKQLPPHLVQGAKILNGAFRSWTKKQALAEHEDELPEHFKPSQLIKDLAKEIRLSENASKAVRPEVNTVASSDEVCDGDREKEEPPSPIEATPPQSLLEKVSKKKTPKTVKMPKPSKIPKPPKPPKPPRPPKTLKLKDGGKKKGKKSRESASPTIPNLDLLEAHTKEALTKMEPPKKGKATKSVLSVPNKDVVHMQNDVERLEIREQTKSKSEAKWKYKNSKPDSLLKMEEEQKLEKSPLAGNKDNKFSFSFSNKKLLGSKALRPPTSPGVFGALQNFKEDKPKPVRDEYEYVSDDGELKIDEFPIRRKKNAPKRDLSFLLDKKAVLPTPVTKPKLDSAAYKQSDDSSDEGSLHIDTDTKPGRNARVKKESGSSAAGILDLLQASEEVGALEYNPSSQPPASPSTQEAIQGMLSMANLQASDSCLQTTWGAGQAKGSSLAAHGARKNGGGSGKSAGKRLLKRAAKNSVDLDDYEEEQDHLDACFKDSDYVYPSLESDEDNPIFKSRSKKRKGSDDAPYSPTARVGPSVPRQDRPVREGTRVASIETGLAAAAAKLSQQEEQKSKKKKSAKRKLTPNTTSPSTSTSISAGTTSTSTTPASTTPASTTPASTSTASSQASQEGSSPEPPPESHSSSLADHEYTAAGTFTGAQAGRTSQPMAPGVFLTQRRPSASSPNNNTAAKGKRTKKGMATAKQRLGKILKIHRNGKLLL

SEQ ID NO: 921150 - protein, 515 aa, Homo sapiens
PILEDPLAIHRHPKSKSEAKWKYKNSKPDSLLKMEEEQKLEKSPLAGNKDNKFSFSFSNKKLLGSKALRPPTSPGVFGALQNFKEDKPKPVRDEYEYVSDDGELKIDEFPIRRKKNAPKRDLSFLLDKKAVLPTPVTKPKLDSAAYKQSDDSSDEGSLHIDTDTKPGRNARVKKESGSSAAGILDLLQASEEVGALEYNPSSQPPASPSTQEAIQGMLSMANLQASDSCLQTTWGAGQAKGSSLAAHGARKNGGGSGKSAGKRLLKRAAKNSVDLDDYEEEQDHLDACFKDSDYVYPSLESDEDNPIFKSRSKKRKGSDDAPYSPTARVGPSVPRQDRPVREGTRVASIETGLAAAAAKLSQQEEQKSKKKKSAKRKLTPNTTSPSTSTSISAGTTSTSTTPASTTPASTTPASTSTASSQASQEGSSPEPPPESHSSSLADHEYTAAGTFTGAQAGRTSQPMAPGVFLTQRRPSASSPNNNTAAKGKRTKKGMATAKQRLGKILKIHRNGKLLL

SEQ ID NO: 921151 - protein, 226 aa, Homo sapiens
ACLARGTGWGGGRVAPNQEGWTGCGLQLEGAVPFFSTARVGPSVPRQDRPVREGTRVASIETGLAAAAAKLSQQEEQKSKKKKSAKRKLTPNTTSPSTSTSISAGTTSTSTTPASTTPASTTPASTSTASSQASQEGSSPEPPPESHSSSLADHEYTAAGTFTGAQAGRTSQPMAPGVFLTQRRPSASSPNNNTAAKGKRTKKGMATAKQRLGKILKIHRNGKLLL

SEQ ID NO: 921152 - protein, 1051 aa, Homo sapiens; identical to SEQ ID NO: 921149

SEQ ID NO: 921153 - protein, 1051 aa, Homo sapiens; identical to SEQ ID NO: 921149

SEQ ID NO: 921154 - protein, 1051 aa, Homo sapiens; identical to SEQ ID NO: 921149

SEQ ID NO: 921155 - protein, 1051 aa, Homo sapiens; identical to SEQ ID NO: 921149

SEQ ID NO: 921156 - protein, 1051 aa, Homo sapiens; identical to SEQ ID NO: 921149

SEQ ID NO: 921157 - protein, 1051 aa, Homo sapiens; identical to SEQ ID NO: 921149

SEQ ID NO: 921158 - protein, 331 aa, Homo sapiens
GGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 921159 - protein, 331 aa, Homo sapiens; identical to SEQ ID NO: 921158

SEQ ID NO: 921160 - protein, 488 aa, Homo sapiens
RRPHGPSAYQGTRMRIGSGSPEDLAEPSADGGLRVAGAERAASWGHVRGGRRLEEGQAAATTLSVAERRKRARPRAAAAMQRRRRPPPPTSRLPEGCGGGGGGSEEVEVQFSAGRWGSAAAVSAAAAAATRSTEEEEERLEREHFWKIINAFRYYGTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKERWDPSKVNILVPGAGLGRLAWEIAMLGYACQGNEWSFFMLFSSNFVLNRCSEINKYKLYPWIHQFSNNRRSADQIRPIFFPDVDPHSLPPGSNFSMTAGDFQEIYSECNTWDCIATCFFIDTAHNVIDYIDTIWKILKPGGIWINLGPLLYHFENLANELSIELSYEDIKNVVLQYGFKVEVEKESVLSTYTVNDLSMMKYYYECVLFVVRKPQ

SEQ ID NO: 921161 - protein, 84 aa, Homo sapiens
YSRIKDSEKTTSMHERVNRTERQFRSLPANQQKLLPQFLLHLDKIRKCIDHNQEILLTIVNDCIHMFENKEYGEDDGYSWATPV

SEQ ID NO: 921162 - protein, 275 aa, Homo sapiens
RRPHGPSAYQGTRMRIGSGSPEDLAEPSADGGLRVAGAERAASWGHVRGGRRLEEGQAAATTLSVAERRKRARPRAAAAMQRRRRPPPPTSRLPEGCGGGGGGSEEVEVQFSAGRWGSAAAVSAAAAAATRSTEEEEERLEREHFWKIINAFRYYGTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKER

SEQ ID NO: 921163 - protein, 349 aa, Homo sapiens
YVLRLQLESDRHDLLRSTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKERWDPSKVNILVPGAGLGRLAWEIAMLGYACQGNEWSFFMLFSSNFVLNRCSEINKYKLYPWIHQFSNNRRSADQIRPIFFPDVDPHSLPPGSNFSMTAGDFQEIYSECNTWDCIATCFFIDTAHNVIDYIDTIWKILKPGGIWINLGPLLYHFENLANELSIELSYEDIKNVVLQYGFKVEVEKESVLSTYTVNDLSMMKYYYECVLFVVRKPQ

SEQ ID NO: 921164 - protein, 488 aa, Homo sapiens; identical to SEQ ID NO: 921160

SEQ ID NO: 921165 - protein, 488 aa, Homo sapiens; identical to SEQ ID NO: 921160

SEQ ID NO: 921166 - protein, 140 aa, Homo sapiens
MKDSCALRVLNHNLLPRLKVTHIVFWPLLFCARNNEFNFMDKKRPGHSYVSCLSFLISLVLFKLSGFWTVTPKPFSLPIPSPPKDQVFFKGFLILESSMHPKSIVVIMGIVGVEQGTSAEADAGTMLLVQPAEPFTFFSG

SEQ ID NO: 921167 - protein, 140 aa, Homo sapiens; identical to SEQ ID NO: 921166

SEQ ID NO: 921168 - protein, 174 aa, Homo sapiens
PSLSGMPQGCLAHAKPSVLSSFSREAPSPIDHPRAEECGRTAQDWQAAPPVALVWDPLGEASWAPKSSGDLENLYVCSFTPEAIETMNPPGGMNNSRRTTLRAVTLTAKVCSFTPEPVRPRTHQKEETLNTSEHQNEQTPDTLPLRTVTLTTRVRSFILDVSETKNPPIPDTKG

SEQ ID NO: 921169 - protein, 174 aa, Homo sapiens; identical to SEQ ID NO: 921168

SEQ ID NO: 921170 - protein, 159 aa, Homo sapiens
EKLMVSLLYLILPFSGIWALNWSRWRGQELEMKSTSFQHSGLLFSALLECENTIEATRTTAFLWAGNQGLEKGVGSREVTVQGGGVGSCQMNAFPSSIILLSECSIYSYSWFPSLCIAPRPASFSHFIFLSFLEFHFDLLKISGLLLNKDQLIETGGSW

SEQ ID NO: 921171 - protein, 407 aa, Homo sapiens
MFSSCFRTRLPHTWHFSHLAQSKKFAGWKAPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPDDSLNPVLYILELRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEEQDLEPEKVKSGCLNEMWEPQKCESPQKTESTVCGYNPELMLLYPVTLQCVAPLPLFVYR

SEQ ID NO: 921172 - protein, 387 aa, Homo sapiens
MHFDFVGNLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPDDSLNPVLYILELRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEEQDLEPEKVKSGCLNEMWEPQKCESPQKTESTVCGYNPELMLLYPVTLQCVAPLPLFVYR

SEQ ID NO: 921173 - protein, 162 aa, Homo sapiens [sequence omitted]

SEQ ID NO: 921174 - protein, 133 aa, Homo sapiens
KPFMNNHPHDPITSHQAPPPTLGITIQHEIQLTGCTTPTVNPNVNYGLGAIMMHQCRFIHCGECSNLELAAAYHESSQQLNEESFDNFGTDISISLDGYLNGDLDETVSSPLGPHCSQCPQAAAAESGSLLDM

SEQ ID NO: 921175 - protein, 734 aa, Homo sapiens
GPQWTGRCHTGSYSMLAVVSGFSYGTVYRVHPRDSFSWLGAEDYEASQKWPREAGKGPQSLHHRPPQKITCLMLRRSPANTPTPWRCHEERSVLRELPGKPALCSPPRSPGVHRSCGQAGKERWPQAGSVSVPDAKRSPSPARWSPLWRWVDKAAVRRPGKAEEPPRRGPSCLVASVWTPGHVTASAHSTSNSHSSQVARERGPPTRQELPEPAQWMEQTDLEIKVMPRRSKRQPRTSPRATPAHQPGPGPAEACWELALCCFPRQLLASSRAHWSANCFHLFEMEIFSSLYTYCHLYFSPQKWGFGREGGLCVRFRVREQTHLFPLWVGGVGAGRGLQSEPTESTEAETEACGGGRAWAEAAPAGGAEARVPLHQPLTAASGVGVLGTSAPSHGFGGCQSLPQPPPGSWLSLSPPSPCLCTQVPPTPLSGSLGTPLSFQAQLQLASPLQKPPCQSLLYARVPRGLLQTWPCVWGEHRLQSPAASGHLVPCPSPRVLPPRPGSHRCFVGGVEMKTKVTTRIVPPPGAPACTARTRRWNDLQQRPGPGTAGVVRVCFPEVAGPEPQGLKGSGRATWKKLHPKRDTKDGRSYADDKKEEEEEEERKSRQVDEESRSLPKGQSTEWSGWAEEELGLCPLGSDISVCQAWVEGALETSRSPYSLQGTDQGHLPAALKSQCRCPEPGVEEDAEVHSSSAGGTAERHGHGGSVEWTQQNMRLWSTGRGLNMNSGLPACIT

SEQ ID NO: 921176 - protein, 719 aa, Homo sapiens
NGHPCGWAAGYAMLSLLLILSGLGADLRGPTPLIPSKLRGNHTFLLEKQSFLHPHFLVYLYNKSGTLYADSSFSKGHCFYQGYAADIPKSVVALRTCSGLRGLLQLDNISYGIEPLESSPTYKHVVYRIKNDAIGHSSFQENYPVAQYIDQSYRILVKSDINSGAMLSKRTLKIQIIMDKAMYAYMGSTVAVAVEKVFQIFGLINTMFSQLNMTVMLSSLEIWSDQNKISTSGHADEILQRFLPWKEKFLFQRSHDMTYLLIYRNHSTYVGATYHGMACDPKFATGIALYPKKITAEAFSVVMAQLLGINLGLTYDDIYNCYCPGTTCIMNPDAIRSHGMKFFSSCSMDGFKRIVLQPELKCFQDKTVSKMTYRKSSTCGNGILEPTEQCDCGYKEACTHKKCCNPADCTLVRSAECGTGSCCNNKTCTIHERGHVCRKSVDMCDFPEYCNGTSEFCVPDVKAADLEYCSNKTSYCFKGVCRERDRQCSQLFGKFAKSANLLCTEEVNFQNDKFGNCGSRCDFFDILCGKIVCHWIHSELVPMTDLDIQYTYLRGHVCLSAHARNGSKQSETYTEDITACGQHKVCHSRECRNFSELNITKYTTNCGQNGICNEHFHCQCDPGYAPPDCEPAMSSPGGSINDGFWLTVEKSVPLLPKRRAAPKNNGLLISFYIFSPLLILIAIVSLKWNKMKRFWSKVGTVSSRSISEDSSSNSSQSQS

SEQ ID NO: 921177 - protein, 745 aa, Homo sapiens
NGHPCGWAAGYAMLSLLLILSGLGADLRGPTPLIPSKLRGNHTFLLEKQSFLHPHFLVYLYNKSGTLYADSSFSKGHCFYQGYAADIPKSVVALRTCSGLRGLLQLDNISYGIEPLESSPTYKHVVYRIKNDAIGHSSFQENYPVAQYIDQSYRILVKSDINSGAMLSKRTLKIQIIMDKAMYAYMGSTVAVAVEKVFQIFGLINTMFSQLNMTVMLSSLEIWSDQNKISTSGHADEILQRFLPWKEKFLFQRSHDMTYLLIYRNHSTYVGATYHGMACDPKFATGIALYPKKITAEAFSVVMAQLLGINLGLTYDDIYNCYCPGTTCIMNPDAIRSHGMKFFSSCSMDGFKRIVLQPELKCFQDKTVSKMTYRKSSTCGNGILEPTEQCDCGYKEGQDFTMLARLVSNFGPQVIHLPQPLKACTHKKCCNPADCTLVRSAECGTGSCCNNKTCTIHERGHVCRKSVDMCDFPEYCNGTSEFCVPDVKAADLEYCSNKTSYCFKGVCRERDRQCSQLFGKFAKSANLLCTEEVNFQNDKFGNCGSRCDFFDILCGKIVCHWIHSELVPMTDLDIQYTYLRGHVCLSAHARNGSKQSETYTEDITACGQHKVCHSRECRNFSELNITKYTTNCGQNGICNEHFHCQCDPGYAPPDCEPAMSSPGGSINDGFWLTVEKSVPLLPKRRAAPKNNGLLISFYIFSPLLILIAIVSLKWNKMKRFWSKVGTVSSRSISEDSSSNSSQSQS

SEQ ID NO: 921178 - protein, 553 aa, Homo sapiens
MTVMLSSLEIWSDQNKISTSGHADEILQRFLPWKEKFLFQRSHDMTYLLIYRNHSTYVGATYHGMACDPKFATGIALYPKKITAEAFSVVMAQLLGINLGLTYDDIYNCYCPGTTCIMNPDAIRSHGMKFFSSCSMDGFKRIVLQPELKCFQDKTVSKMTYRKSSTCGNGILEPTEQCDCGYKEGQDFTMLARLVSNFGPQVIHLPQPLKFKMGHKAAETVNINSAFGPGTANKHTHSGGSRFAEDRRNLQRSIVATIGNQIATCKEKWIVCDNWQQPAQCLIHYNFLNPGKTIKSEKYAQQIDELHKTCNACSRRWSTERARVFSMTTPGHTSHNQHFKKEAKGQLGLLLQRVEAPSLGSCHMVWSLQVHRSQELRFGSLCKDFRRCMEMPGCSGRSLLQGQGSHGEPLLGQCGRDMWGWSPHRVPTGTLLSGAESRQPQSSRPQNGRSTNGLHRVTGKAADTQHQPVKAVRKKAVSCNATGVELPKTMGTYLLHQHDTSLIHGVKENHFGSLRFDYSAGFWTCMGLVSPLFWPISPIGMSVFTQCLYPHCI

SEQ ID NO: 921179 - protein, 834 aa, Homo sapiens
NGHPCGWAAGYAMLSLLLILSGLGADLRGPTPLIPSKLRGNHTFLLEKQSFLHPHFLVYLYNKSGTLYADSSFSKGHCFYQGYAADIPKSVVALRTCSGLRGLLQLDNISYGIEPLESSPTYKHVVYRIKNDAIGHSSFQENYPVAQYIDQSYRILVKSDINSGAMLSKRTLKIQIIMDKAMYAYMGSTVAVAVEKVFQIFGLINTMFSQLNMTVMLSSLEIWSDQNKISTSGHADEILQRFLPWKEKFLFQRSHDMTYLLIYRNHSTYVGATYHGMACDPKFATGIALYPKKITAEAFSVVMAQLLGINLGLTYDDIYNCYCPGTTCIMNPDAIRSHGMKFFSSCSMDGFKRIVLQPELKCFQDKTVSKMTYRKSSTCGNGILEPTEQCDCGYKEGQDFTMLARLVSNFGPQVIHLPQPLKVLGLQTHKESLAGRLPICLLGDTLRTCKINTSYLLKSTAYTTPFWKRRNRQEEMGNRPQASLKPKRANDGHSDSWIISFDDMSCIFYKQACTHKKCCNPADCTLVRSAECGTGSCCNNKTCTIHERGHVCRKSVDMCDFPEYCNGTSEFCVPDVKAADLEYCSNKTSYCFKGVCRERDRQCSQLFGKFAKSANLLCTEEVNFQNDKFGNCGSRCDFFDILCGKIVCHWIHSELVPMTDLDIQYTYLRGHVCLSAHARNGSKQSETYTEDITACGQHKVCHSRECRNFSELNITKYTTNCGQNGICNEHFHCQCDPGYAPPDCEPAMSSPGGSINDGFWLTVEKSVPLLPKRRAAPKNNGLLISFYIFSPLLILIAIVSLKWNKMKRFWSKVGTVSSRSISEDSSSNSSQSQS

SEQ ID NO: 921180 - protein, 191 aa, Homo sapiens
FSSFSPKMLNRGVKGESRLSHSAGVRSSPWQALAGLFSTQGETGQVSHAGPGCLFPSSFLLWTVDLILILTELSPWRQGRRSWGIFPAPPSPVGPSSQGFPQPQDLGALNFPPRLSQGQNKVICAHCWHLHFSPKIPAEPSASSLTCLGLQYTLSQAGWPLGELVLTKTPQPACAVDWGAPGLSACSPPMS

SEQ ID NO: 921181 - protein, 162 aa, Homo sapiens
MSKITCRQQALPARAPTVLRSLPPMPPALARTSSPGSRLAGHQEPKYPPRTSHTETRCQAGQRQQGPRSSSGSSSRGCWAGGQGSAHPQKRRRRPTRTSACLVLEAWAVRMPRRSGRGSASPPSAAARSCHIPSRRRLSARGGLEVPLPFIDQESEPWAGRV

SEQ ID NO: 921182 - protein, 162 aa, Homo sapiens; identical to SEQ ID NO: 921181

SEQ ID NO: 921183 - protein, 156 aa, Homo sapiens
MHLMCICFGHPLDSVCQGAFVLVTPAVNLWLLPWSSAHPQKESLYVHWGTASRTFSHPTPPSASKAVFPDSGFHVTQSYSFWNVSPKQPRWTLCGRRGSSECKIRMYAKKQTCQPCALLVSVPETEPATSGQSSAQELGQAANIINNSNSNNNNLY

SEQ ID NO: 921184 - protein, 156 aa, Homo sapiens; identical to SEQ ID NO: 921183

SEQ ID NO: 921185 - protein, 187 aa, Homo sapiens
MLLCGFYIKISPSPKWISKFSKYSLPDSMERLSQNCSIKPKVQLCAMNAHITKKFLRILLCSFYLSIVPFPPQTTKGSKYPLQMIQKERFKTAQTKDCTKREIQDWSLKREVQLCELKANLTKMFLRRLLHSVYMTIFAFPQYASNLHNYPLADSTRRVFQNCSIQINFQLCEINAHITKKFLRMLL

SEQ ID NO: 921186 - protein, 149 aa, Homo sapiens
AAGTTVHFLNPHRGMLLKDFSNAGSWTSDNYEINNLDKMRDKETRGEAPQETDIQMGIKIQTGPFYKVLLTHSWSRAEGVEQKVNYRFAEVSPAQLAGYTKIKTFTGKWSGSFPPRIGLEVEVCGEEDLSSMDQHGECRGVLGVTGNSQ

SEQ ID NO: 921187 - protein, 149 aa, Homo sapiens; identical to SEQ ID NO: 921186

SEQ ID NO: 921188 - protein, 184 aa, Homo sapiens
WRTMVSVVSGRTEASSLPSPTRPSCAGSPKAPVGLPCPHLPLRSWRRGKPHVILTDSCAVFRRSEHPPLTLAFCLSSSFTVGMFFIVETHTGQKPYECNECERAFSLGSTIMKHQGNTTGSGARIEVLFGLQLSLRLPWLESYCNKRTPLSLKEKASLCQWARVEQASHGVYLEDSWVFCMSCP

SEQ ID NO: 921189 - protein, 184 aa, Homo sapiens; identical to SEQ ID NO: 921188

SEQ ID NO: 921190 - protein, 184 aa, Homo sapiens; identical to SEQ ID NO: 921188

SEQ ID NO: 921191 - protein, 82 aa, Homo sapiens
MRPNTDASHKQAGGTSTRAKSAAEDIEKYKPPGHGVGDDPTDAQQHGGTHRPRTDTRRNTRQQEPKNHTPTERITEHTHQKQ

SEQ ID NO: 921192 - protein, 144 aa, Homo sapiens
MDVCTKLDISTVTSWDKGLPGCLRRGKPAWVGDKAGHNSQFDQQGVMPVDSHAAGRSCPWTAPQQGDRACKQPRSRGSCLWTVPHQGFVPVDSPAAGRLCLWMAPQQGIVPVDSPAAGGRACGQLPSRGIMPINSPCTPGWETE

SEQ ID NO: 921193 - protein, 147 aa, Homo sapiens
MQSLHLSCTHSRTRIKSEKNKNTKRIHSIPEVLIMKPYFTAVAKPSLLSHKWLPLEKPENPCCYSSDHRTAVPKLLLYRRSTRRKTELTNKELTSAHFTGDLPRRAVWVLGDRTAPHDLPWPTDADEVRVCYYRAEAFNDLPRKPKP

SEQ ID NO: 921194 - protein, 146 aa, Homo sapiens
AVPVSQVVMAPGGGAHKLVAWHLVHRKSRPWDVVLVGTLRELHRGTSLKGGTHVLAHSTGAESSSKVIDADKAFPGFLLSLENRQTLTRAGPEPSRRAAGREAAYQSSWQARKKLSPARRRSISPRREGGGGGREKVFASALNHGI

SEQ ID NO: 921195 - protein, 591 aa, Homo sapiens
CKAACSPAEGVCVGSTPHVAAAFLPPEPYTCGACGIQFQFYNNLLEHMQSHAADNENNIASNQSRSPPAVVEEKWKPQAQRNSANNTTTSGLTPNSMIPEKERQNIAERLLRVMCADLGALSVVSGKEFLKLAQTLVDSGARYGAFSVTEILGNFNTLALKHLPRMYNQVKVKVTCALGSNACLGIGVTCHSQSVGPDSCYILTAYQAEGNHIKSYVLGVKGADIRDSGDLVHHWVQNVLSEFVMSEIRTVYVTDCRVSTSAFSKAGMCLRCSACALNSVVQSVLSKRTLQARSMHEVIELLNVCEDLAGSTGLAKETFGSLEETSPPPCWNSVTDSLLLVHERYEQICEFYSRAKKMNLIQSLNKHLLSNLAAILTPVKQAVIELSNESQPTLQLVLPTYVRLEKLFTAKANDAGTVSKLCHLFLEALKENFKVHPAHKVAMILDPQQKLRPVPPYQHEEIIGKVCELINEVKESWAEEADFEPAAKKPRSAAVENPAAQEDDRLGKNEVYDYLQEPLFQATPDLFQYWSCVTQKHTKLAKLAFWLLAVPAVGARSGCVNMCEQALLIKRRRLLSPEDMNKLMFLKSNML

SEQ ID NO: 921196 - protein, 133 aa, Homo sapiens
MDVCLSPFQKELEVAENKEIVACILDSYFLLKLLLPCPLCRNDPEKLDAFIMDKALLDYEVSIDADCKLLTVGKPFAIEGYGIGLPPNSPLTANISELISQYKSHGFMDMLHDKWYRVVPCGKRSFAVTELSV

SEQ ID NO: 921197 - protein, 175 aa, Homo sapiens
GVLLKEAVWPRFGKAAMLCWGEPTSLRPFGLFKALWLECLELTEKGMVAHPSLLGFCPVSGRPHLVASGWLEFQASEFYLVRCCGSGARGPTLLRPLGSAPFLGVYMDLPPCLSCRHLFRGSWGWNVKLLSLCACLRSCSAEIPHSCVCQTQGTGGVGPQVDLLICGLQRSMGEA

SEQ ID NO: 921198 - protein, 175 aa, Homo sapiens; identical to SEQ ID NO: 921197

SEQ ID NO: 921199 - protein, 742 aa, Homo sapiens
MAAGVLPQNEQPYSTLVNNSECVANMKVSGADSSCLRLLPPSAMQVQDATRRPSAVRFLSSFLQGRRHSTSDPVLRLQQARRGSGLGSGSATKLLSSSSLQVMVAVSSVSHAEGNPTFPERKRNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCCDPKAHAVTLPQYLIRQRHLLHGYEARLLKHVPKIIHLVCKLLLDLAENRPVMMKDVSEGPGLSAEIEKTMSEMVTMQLDKELLRHDSDVSNPPNPTAVAADFDNRGMIFSNEQQFDPLWKRRNVECLQPLTHLKRRLSYSDSDLKRAENLLEQGETPQTVPAQILVGHKPRQQKLISHCYIPQSPEPDLHKEALVRSTLSFWSQSKFGGLEGLKDNGSPIFHGRIIPKEAQQSGAFSADVSGSHSPGEPVSPSFANVHKDPNPAHQQVSHCQCKTHGVGSPGSVRQNSRTPRSPLDCGSSPKAQFLVEHETQDSKDLSEAASHSALQSELSAEARRILAAKALANLNESVEKEELKRKVEMWQAFGVLEKLSSYLPYVKFQDSGLIVKSYIGC

SEQ ID NO: 921200 - protein, 849 aa, Homo sapiens
MAAGVLPQNEQPYSTLVNNSECVANMKVSGADSSCLRLLPPSAMQVQDATRRPSAVRFLSSFLQGRRHSTSDPVLRLQQARRGSGLGSGSATKLLSSSSLQVMVAVSSVSHAEGNPTFPERKRNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCCDPKAHAVTLPQYLIRQRHLLHGYEARLLKHVPKIIHLVCKLLLDLAENRPVMMKDVSEGPGLSAEIEKTMSEMVTMQLDKELLRHDSDVSNPPNPTAVAADFDNRGMIFSNEQQFDPLWKRRNVECLQPLTHLKRRLSYSDSDLKRAENLLEQGETPQTVPAQILVGHKPRQQKLISHCYIPQSPEPDLHKEALVRSTLSFWSQSKFGGLEGLKDNGSPIFHGRIIPKEAQQSGAFSADVSGSHSPGEPVSPSFANVHKDPNPAHQQVSHCQCKTHGVGSPGSVRQNSRTPRSPLDCGSSPKAQFLVEHETQDSKDLSEAASHSALQSELSAEARRILAAKALANLNESVEKEELKRKVEMWQKELNSRDGAWERICGERDPFILCSLMWSWVEQLKEPVITKEDVDMLVDRRADAAEALFLLEKGQHQTILCVLHCIVNLQTIPVDVEEAFLAHAIKAFTKVNFDSENGPTVYNTLKKIFKHTLEEKRKMTKDGPKPGL

SEQ ID NO: 921201 - protein, 742 aa, Homo sapiens; identical to SEQ ID NO: 921199

SEQ ID NO: 921202 - protein, 742 aa, Homo sapiens; identical to SEQ ID NO: 921199

SEQ ID NO: 921203 - protein, 145 aa, Homo sapiens
PASILLQMIRQSWEPLPSAVLAEGIQIVKSLITGSYSSSSILQVLMSHLNFLLQFSLIYSSAEAPKPAMPTVGHFLPTLTSLTFGLFCLNKLWYYGHNFEGCRVLTEKRENRLNINKEELWHWSKKQDKLNLCIYSGHQNGAGTI

SEQ ID NO: 921204 - protein, 781 aa, Homo sapiens
MGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQGTCCTGTGDRLETGPGGASGVTSRSPISVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 921205 - protein, 412 aa, Homo sapiens
PQDGGAAAVSLARAAGRGETYGKKGVCESVLRGLAAAPVKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 921206 - protein, 225 aa, Homo sapiens
FEPKYSHCKMGVIILHPQSCYKMRNEGLLIRGKLTPTVSWRVPDHLYLSSVKKKRQEQPLDRPKPCALASHTQHPHPAAIVTTMPKRKGEGDAKGDKSKVKDEPQRKSTKLSAKPAPPKPEPKLKKAPAKKGEKTSFTSRIQSKLLGLAHEPSIIWHLAAHMLEPHGFAHRPLNTCGLLTPLCLCTSFPQPHARPLHCDPGSVFVLLRGITVPYLKLNQDCSLRL

SEQ ID NO: 921207 - protein, 225 aa, Homo sapiens; identical to SEQ ID NO: 921206

SEQ ID NO: 921208 - protein, 598 aa, Homo sapiens
MTTNPGPPELLAPAVVDRQRDRRGSAGPLGPWHRPQGWQNGSVVGVGSTGPSVSWGTVGWEGSGCPHPVPITAEGCAVAGAATERLGCIRLDGDISPPLNETALCCSGTRTQLGLLAPWPQEKLVQISDTKPCEQTRRQGTVHPARPHHPPYHPPPCHLPLLPDLETSGQAEKEPSTAPQQIPGTHAHFYGDRPSKEREEREGLPLKRTDLALDSGSQPGDVWQGLETSVIVTAGEGVLLAPHPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHRDEIQYIFGEPFATPLRATGPKTGQDPNMGHSAVPTHWEPYTTENSGYLEITKKMGSSSMKRSLRTNFLRYWTLTYLALPTVTDQEASDSEAPPYPLRVTLRPVPTLGDTEAAPVSPTDDSEEAQMLQSLVSSAKLQEGVDLSYPYSTRWEDKAQGRQVLWPHAAELSRDEPCPLEKQGTPWLAVTTLATLGFLGGCEL

SEQ ID NO: 921209 - protein, 168 aa, Homo sapiens
MKVPPWTFQTRRGSKDTRPIHRVIRANKSPQQNSMASLHPRAHTGEGLLDGSEVSRTGIRQMKKRKGPDTSEEGTKGEHFERVSGVWDGEKKGEGKREKGGEKRGGGIGLHESQIAVTVIALLGLATYQGYWAPGWCWGMSAESCDVIHLQVFQSWIPAPVLVEVAGE

SEQ ID NO: 921210 - protein, 255 aa, Homo sapiens
AGSAAAAAADSGSHCHAPPTTARRAFPIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWTWNECCWCLSEDSAPRFRD

SEQ ID NO: 921211 - protein, 255 aa, Homo sapiens; identical to SEQ ID NO: 921210

SEQ ID NO: 921212 - protein, 220 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWTWNECCWCLSEDSAPRFRD

SEQ ID NO: 921213 - protein, 255 aa, Homo sapiens
LTPSGANKRGWVNPQEAILTPKRQIFLFHANSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWTWNECCWCLSEDSAPRFRD

SEQ ID NO: 921214 - protein, 77 aa, Homo sapiens
KNRLVEAACNLAEAPPTTARRAFPIPFGSKSNMATLKDQLIYNLLKEEQTPQNKITVVGVGAVGMACAISILMKTIM

SEQ ID NO: 921215 - protein, 221 aa, Homo sapiens
LTPSGANKRGWVNPQEAILTPKRQIFLFHANSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPTDGGKAGSSPIKLSWVGPWGTWRFQCACMDVE

SEQ ID NO: 921216 - protein, 255 aa, Homo sapiens; identical to SEQ ID NO: 921210

SEQ ID NO: 921217 - protein, 261 aa, Homo sapiens
FGYYERGLIGRGRAADSGSHCHAPPTTARRAFPIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWTWNECCWCLSEDSAPRFRD

SEQ ID NO: 921218 - protein, 237 aa, Homo sapiens
DGVGRPTRPPRVRSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWTWNECCWCLSEDSAPRFRD

SEQ ID NO: 921219 - protein, 267 aa, Homo sapiens
AGSAAAAAADSGSHCHAPPTTARRAFPIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWTWNECCWCLSEEGRLKKSADTLWGIQKELQF

SEQ ID NO: 921220 - protein, 150 aa, Homo sapiens
LCARTWLRQEAGQGSGLLMELASWKSGKGKANMSAFGLRGQKGESLSDQSSWETEAEDCPHSVRSRGMGGSSGHSRDQAGSGRRPRGTPSPAPLVLGWLAYRGRLAKASGKGTFSAGCWIPNYKRQSTLCKDEYRFVTAGGNTPTALKGV

SEQ ID NO: 921221 - protein, 2499 aa, Homo sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 921222 - protein, 619 aa, Homo sapiens
MRPFGHLEEVPKIKERKVVGYKCKFCVEVHPTLRAICNHLRKHVQYGNVPAVSAAVKEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 921223 - protein, 463 aa, Homo sapiens
MQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 921224 - protein, 423 aa, Homo sapiens
TGRLYSTGRLYSTGRLYSTGRLYSTGRLYSTGRLYSTGRLYSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 921225 - protein, 271 aa, Homo sapiens
VTERIPLDSSVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 921226 - protein, 2354 aa, Homo sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKMICIIMGKA

SEQ ID NO: 921227 - protein, 2429 aa, Homo sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKVGPSSSFCSGKGRVSIWFPSTRIVWWQQKVQDSRSRRLREADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHADSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKFGNEGPVYKSSGENDGMWEQRAAPSPKESKRRKRPLRPRSCLVLVAKPQSQENDVSRNFELVGRVNLDQLEQMKEKMESSSSDDEDKEEEMNSKAEDRVNKDKPVSKRK

SEQ ID NO: 921228 - protein, 1101 aa, Homo sapiens
ACEHLLIDPERQLLTILHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 921229 - protein, 399 aa, Homo sapiens
MQTHHGHHKPFRCKLCSFKSSYNSRLKTHILKAHADSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 921230 - protein, 2299 aa, Homo sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHRGNLSNLVFLDAAGGRQQRWPSRDALSEWQ

SEQ ID NO: 921231 - protein, 2472 aa, Homo sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEDSEVRRDTLESP

SEQ ID NO: 921232 - protein, 548 aa, Homo sapiens
MQISAAGLNFSSENGIIDDAWWFGTVESQQPFQPEYPDSSFQCYSVQRISALMWEVRYIEHNARTFNEPDSPIVKAAKIVTDVLLRFIGDQSCTDILDTYNKIKAEERNSTDAEEDTEIVDLDSDGPGTSSGRKDYQDVIDTPVDFSTVKETLEAGNYGSPLEFYKDVRQIFNNSKAYTSNKKSRIYSMMLRLSALFESHIKNIISEYKSAIQSQKRRRPRYRKRLRSSSSSLSSSGAPSPKGKQKQMKLQPKNDQNTSVSHARTSSPFSSPVSDAAEGLSLYLLDDEPDGPFSSSSFGGYSRSGNSHDPGKAKSFRNRVLPVKQDHSLDGPLTNGDGREPRTGIKRKLLSASEEDENMGGEDKEKKETKEKSHLSTSESGELGSSLSSESTCGSDSDSESTSRTDQDYVDGDHDIANSYKPDLKENSESNMAMEKEIGRPEAQEEEADGEDGVDGVEEAEEEEAGDEGVEEEVEVALGGGEEGEEEEVLLEELPEPNEHVLQMMNLIPCFQDVSVDCLELKQETKAGGLFYIMMILIMTILCPLRIL

SEQ ID NO: 921233 - protein, 135 aa, Homo sapiens
MEENGEKGGRFQACLIADSVTAVLSLSPSSDWDMSLLFTVHWPELNALVQAVTKKAERPRGAHGQSVPRRVPWCLLQEKPASMLCRCSSSAWRGSLWKGAEASADNQHQTIPFSPTGSCEGSSPTFFIDTAISNK

SEQ ID NO: 921234 - protein, 189 aa, Homo sapiens
MRLLWLKYKVPEKTFPNLNGIAVTSKLFLFNTFHLFQTLALSPPASSQLIEKSLESSSAVKAHLISSISGSFKKEQKGRWPPHYWCFAHLHPVLVSDVCPVALDMKSLAISLRKCKPWSQGKPRKGSVGTNHGTEAAEGACFLVGERWNGDSTSESSQVDDLAKSKIQKLFFQIEECRKSNPEDLLPVG

SEQ ID NO: 921235 - protein, 189 aa, Homo sapiens; identical to SEQ ID NO: 921234

SEQ ID NO: 921236 - protein, 255 aa, Homo sapiens [sequence omitted]

SEQ ID NO: 921237 - protein, 78 aa, Homo sapiens
YGHMSTHGVADAWVTHASVTLADPSVSSRLPPLGLHCGDRAKGLGLQFSRLAKMLSAGLVGNCRQAEAAPGLCLCLAQ

SEQ ID NO: 921238 - protein, 255 aa, Homo sapiens [sequence omitted]

SEQ ID NO: 921239 - protein, 147 aa, Homo sapiens
MSAGSGGWALGSSLLSCKMGITETVPGTMRSRCSRKVVSAEGKSQSQKVAYSHSVYLFLFLRQGLALSPRLEYSGAIWAHCNLHLLGSSDPPISDPQGAGATGTCHRVRLIFVFYVETGFHHVAQAGLKLLSSGDPPALACDKIAQK

SEQ ID NO: 921240 - protein, 255 aa, Homo sapiens [sequence omitted]

SEQ ID NO: 921241 - protein, 147 aa, Homo sapiens; identical to SEQ ID NO: 921239

SEQ ID NO: 921242 - protein, 96 aa, Homo sapiens
MSAGSGGWALGSSLLSCKMGITETVPGTMRSRCSRKVVSAEGKSQSQKVAYSHSVYLFLFLRQGLALSPRLEYSEPRSRHYTPVRATEQESIPPPP

SEQ ID NO: 921243 - protein, 255 aa, Homo sapiens [sequence omitted]

SEQ ID NO: 921244 - protein, 255 aa, Homo sapiens [sequence omitted]

SEQ ID NO: 921245 - protein, 255 aa, Homo sapiens [sequence omitted]

SEQ ID NO: 921246 - protein, 90 aa, Homo sapiens
SHSRPAGRSDRGRRRSCLTCALTTVLSGLKPAPTLPFPVLRGPPAPESRLGAAEAGGMARAESAGRKGLTGSAALGCPSRGEPANERAPR

SEQ ID NO: 921247 - protein, 147 aa, Homo sapiens; identical to SEQ ID NO: 921239

SEQ ID NO: 921248 - protein, 255 aa, Homo sapiens [sequence omitted]

SEQ ID NO: 921249 - protein, 255 aa, Homo sapiens [sequence omitted]

SEQ ID NO: 921250 - protein, 199 aa, Homo sapiens
ACCSTLPRVVYSTDTSLLLLCSPSSSAMEEATSKMTEIISEPTVTLENENSDVNPSAGKSGPGLFLVEHLGEGEAVGAASADLNVPARRLCREQRILTRRILPAQNGSSTKGQTASLSGSLTPVPPDWETAPSRGQQTPYTRELQLASGRCLSETKLPDEGAGSSLCCSAASAGDTQANRVWSGPPANYSRHAEKGPDC

SEQ ID NO: 921251 - protein, 150 aa, Homo sapiens
MTGKEGGHKDRFSSSHDLGKRYWFKVLSLESEWLQQVLDGSLGQMTYFLPRNNTLTIYILCLSLATKKIPPALQTAEVCQILHPHQSSFKCQQHDPMNKGAPFVYKQRLSKTDRRSPTWGEVCSSICFSGRGGKRWDEGSKNWIQKRGTI

SEQ ID NO: 921252 - protein, 163 aa, Homo sapiens [sequence omitted]

SEQ ID NO: 921253 - protein, 163 aa, Homo sapiens [sequence omitted]

SEQ ID NO: 921254 - protein, 163 aa, Homo sapiens [sequence omitted]

SEQ ID NO: 921255 - protein, 135 aa, Homo sapiens
VSGKMRHNIYCQVVKSTCSRDGPKETQTRAGCPGQDGTLWSHCIVCCVLAPFGQSALKCLLLSLREQSLYWLAIQQLPTDPIEEQFPVLNVTRYYNANGDVVEEEENSCTYYECHYPPCTVIEKQVGVLQCGRVP

SEQ ID NO: 921256 - protein, 207 aa, Homo sapiens
TLIDEQDIPLVESYSFEARMEVDADGNGAKIFAYAFDKNRGRGSGRLLHELLWERHRGGVAPGFQVVHLNAVTVDNRLDNLQLVPWGWRPKAEETSSKQREQSLYWLAIQQLPTDPIEEQFPVLNVTRYYNANGDVVEEEENSCTYYECHYPPCTVIEKQLREFNICGRCQVARYCGSQCQQKDWPAHKKHCRERKRPFQHELEPER

SEQ ID NO: 921257 - protein, 898 aa, Homo sapiens
CEKDMIMGGAEGKLSTSGGTAALGCLVKDYFPEPVTVSWNSGALTSGVHTFPAVLQSSGLYSLSSVVTVPSSNFGTQTYTCNVDHKPSNTKVDKTVAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESCAEAQDGELDGLWTTITIFITLFLLSVCYSATITFFKVGRTLSPAVLDIVPHAVTHCPHAVPTMSLTLSPMLSPPVPDTLLRTVSTCAQHCPPRYPPIPNNVPHTVSSCPLSPTLSSTLSPPLPVTVAHAAPTCPNTFLQAVLTCPQHSPPHSLHLSLTLSPMLSPPVPDAVLHTVPTFSLSLSPCCPLSLTLSSMLSSPVPNTLPHCLHLSLTLSPTLSPPVPDAVVCAVHILLVTWLCSPSSSLRAGSGEAVAPGWPEGWGGPWGQGCGLAHPCAVPCLQVKWIFSSVVDLKQTIVPDYRNMIRQGAWATLCGVSRAAQTPTQEPWAMLSHHPGHTCPRPHRPQPHGSLASQSPSDPDTPPFQTLCIAGLPQTSAAWCMQGAGGQDTLLQPRGGVRETAPGVQGGQLLHHRLYPKPKDGVPEMQESFVQRRCQPSGTLLERSPPSALQGALRASRCSGGVGSSPLSEDGRPGQDKERKPRTVPGSGSFRALSRLSWEEADASCSCCPLQGLAPGPGSPGEIGPLPEPPGAHLPLSTWDRASSRGSALLREHHAQPQDPPSTLQQGCPCTPPSSPCCDVT

SEQ ID NO: 921258 - protein, 910 aa, Homo sapiens
CEKDMIMGGAEGKLSTSGGTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPELQLEESCAEAQDGELDGLWTTITIFITLFLLSVCYSATITFFKVGRTLSPAVLDIVPHAVTHCPHAVPTMSLTLSPMLSPPVPDTLLRTVSTCAQHCPPRYPPIPNNVPHTVSSCPLSPTLSSTLSPPLPVTVAHAAPTCPNTFLQAVLTCPQHSPPHSLHLSLTLSPMLSPPVPDAVLHTVPTFSLSLSPCCPLSLTLSSMLSSPVPNTLPHCLHLSLTLSPTLSPPVPDAVVCAVHILLVTWLCSPSSSLRAGSGEAVAPGWPEGWGGPWGQGCGLAHPCAVPCLQVKWIFSSVVDLKQTIVPDYRNMIRQGARATLCGVSRAAQTPTQEPWAMLSHHPGHTCPRPHRPQPHGSLASQSPSDPDTPPFQTLCIAGLPQTSAAWCMQGAGGQDTLLQPRGEVRETAPGVQGGQLLHHRLYPKPKDGVPEMQESFVQRRCQPSGTLLERSPPSALQGALRASRCSGGVGSSPLSEDGRPGQDKERKPRTVPGSGSFRALSRLSWEEADASCSCCPLQGLAPGPGSPGEIGPLPEPPGAHLPLSTWDRASSRGSALLREHHAQPQDPPSTLQQGCPCTPPSSPCCDVT

SEQ ID NO: 921259 - protein, 794 aa, Homo sapiens
MFLWLFLILSALISSTNADSDISVEICNVCSCVSVENVLYVNFSLHLGNNKLQNIEGGAFLGLSALKQLHLNNNELKILRADTFLGIENLEYLQADYNLIKYIERGAFNKLHKLKVLILNDNLISFLPDNIFRFASLTHLDIRGNRIQKLPYIGVLEHIGRVVELQLEDNPWNCSCDLLPLKAWLENMPYNIYIGEAICETPSDLYGRLLKETNKQELCPMGTGSDFDVRILPPSQLENGYTTPNGHTTQTSLHRLVTKPPKTTNPSKISGIVAGKALSNRNLSQIVSYQTRVPPLTPCPAPCFCKTHPSDLGLSVNCQEKNIQSMSELIPKPLNAKKLHVNGNSIKDVDVSDFTDFEGLDLLHLGSNQITVIKGDVFHNLTNLRRLYLNGNQIERLYPEIFSGLHNLQYLYLEYNLIKEISAGTFDSMPNLQLLYLNNNLLKSLPVYIFSGAPLARLNLRNNKFMYLPVSGVLDQLQSLTQIDLEGNPWDCTCDLVALKLWVEKLSDGIVVKELKCETPVQFANIELKSLKNEILCPKLLNKPSAPFTSPAPAITFTTPLGPIRSPPGGPVPLSILILSILVVLILTVFVAFCLLVFVLRRNKKPTVKHEGLGNPDCGSMQLQLRKHDHKTNKKDGLSTEAFIPQTIEQMSKSHTCGLKESETGFMFSDPPGQKVVMRNVADKEKDLLHVDTRKRLSTIDELDELFPSRDSNVFIQNFLESKKEYNSIGVSGFEIRYPEKQPDKKSKKSLIGGNHSKIVVEQRKSEYFELKAKLQSSPDYLQVLEEQTALNKI

SEQ ID NO: 921260 - protein, 146 aa, Homo sapiens
MPRPPLASAPVAVATYRSLYFSQLAPTSTTLHPSQALEGALRRTGQGWPRTSGAMGTLRLSGFPPYPWHLAHCLALYVPTISKSCLLHLQNASRVCPPLPAMVGESKSPSSLSGPLSLLVYLLPVMPLPIHGSWRAGMPLHQCIGV

SEQ ID NO: 921261 - protein, 241 aa, Homo sapiens
MSADEASVSRRKGAAEAAQRTQPCQGEFLGRDLEFSGPHLPTSPPRMSSYPPLSPPPPSPPPALGSRCLVPLGAASSAAAAAAAAAAATRFILLHQMANRVIRLYTVSHYRTPWVFLLLVLMAFPSCVPCRCALSGMDRHRTPLYDLPIEQKMYGESKIEHSMTYIGLILLKPWRTIRMSLPPFLYWLELSEEPETEYEQDTEATVFCNLTMKVTSHHFCHGSFVTSKSLGPTQEEGFTRG

SEQ ID NO: 921262 - protein, 248 aa, Homo sapiens
MAAAPTQIEAELYYLIARFLQSGPCNKSAQVLVQELEEHQLIPRRLDWEGKEHRRSFEDLVAANAHIPPDYLLKICERIGPLLDKEIPQSVPGVQTLLGVGRQSLLRDAKDCKSTLWNGSAFAALHRGRPPELPVNYVKPPNVGAVSQGFRWLGKGNPLTPCTSGVRQCPTLLPLALRGLHPLSNQCQRNEPATSVGNAEITHLLHRSRWELQTGAVPIWPSWNRIHMFCVLRVAVAFDVPTSHALVI

SEQ ID NO: 921263 - protein, 178 aa, Homo sapiens
MLITKTMGKMSPGHVRQLCGSPFHHRPRDLGGKNDFLSQVPGPLAVCSLGTWCPVSQLLQPWLTGPKVQLRLWLQRMQAPILGSFHVVLSLRVHKSQEPRFGNHCLYFRGCMETPERPRRSLLEEQGPHGEPLLGQLRKAAPSVAMEIAADGRILGRLAGSGCPGDAGVAVGGCGNTK

SEQ ID NO: 921264 - protein, 124 aa, Homo sapiens
MLCNKLYIRKNSRFQGSEDRMINSIRGGGCNGIPYSGWLINNRNVLLTVLEAGKSKIKAAVDSVSSEGPFLAPPPNTITLRIWFQHELGEDTNIQTLESLTQHLKIELDPLGNRKEHDEIKTLE

SEQ ID NO: 921265 - protein, 152 aa, Homo sapiens
SWHKAEQEQASHRMRRSHRCREHGLWSQPGCLKLGKSPCLSGPQCPDLQNGQNNGTYILRLLCRGNTLIHMESAQNSAWHIEWNWWLYKKRKRDLSEHAQPPRHVMSFATSVLCRIPAGKKSLTRCSPSTLDVSASTTVLLSSPNQAEWVHL

SEQ ID NO: 921266 - protein, 154 aa, Homo sapiens
MGGVSTCREEALSAATACGACRAAQVNAHPCWSALLHYRPFKEVASRNHPPNRRQQESEKDKVRSLLQIERGWQMTDVGPLLYLHLHKVVLGHVGVSESLVLVQVQCGEPVECRPLTDQPVGAAGWSSGRPGCSEQRLPFPAALLPASLRRGTS

SEQ ID NO: 921267 - protein, 164 aa, Homo sapiens
LILTRKVLLGQISLRSRFNKMKECDLTNYLQVHSFDYVYELQMESAVDTKALFLAMGQGGYLQGLSQPFCRQEVSILQTKKESARKPDCLGKPPLPVSGGVEKNNSTMLPLLATSVPCNNSMAPATAQEMEEMARQVITGIWRLVVEQDRGIHSRSHWYLETCG

SEQ ID NO: 921268 - protein, 252 aa, Homo sapiens
MSSSRLVWDASSGDAETTTAFGFLYTPVIRPPQAQGVGGPELWDILLASFNIAVEVCSLQEPTIDILQPSRIMEQPTSSTNGEKRKSPCESNNKKNDEMQEAPNRVLAPKQSLQKTKTIEYLTIIVYYYRKHTKINSNQLEKDQSRENSINPVQEEEDEGLDSAEGSSQEDEDLDSSEGSSQEDEDLDSSEGSSQEDEDLDSSEGSSQEDEDLDSSEGSSQEDEDLDPPEGSSQEDEDLDSSEGSSQEGGED

SEQ ID NO: 921269 - protein, 1255 aa, Homo sapiens
MQEGLDHKRWREQNLTKTAFNEEMGQDMLAELIQVIILAADLLCKDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYNGNKDLKL

SEQ ID NO: 921270 - protein, 179 aa, Homo sapiens
MEMVLPSASEKLGWTNPHPFTLSFTQKMPVGTTASKQMNPALVEMVDYWRTQAENWKLQRGETGFVGLDVVLGVGLWGDAEKVKDNSRASGLDKWWREMLSLRHRKKKKVVGLIQKKVCGLMGRPCKLHREVAYLGLEQKSANSENGQGEDVFCLAGCTILATTTHLHCCSWKAVTDDV

SEQ ID NO: 921271 - protein, 378 aa, Homo sapiens
MTQPALGLSFPKISQPNPRRSCLALRRQDNSLVLALSQCPNRSKEWDKVKGPGSSSAPRLWSQRKTQAEKASLDVFVLPWPAGVGNKGEELRGCTKVAAPSLPGAVRGADRGPFLSPNIRSSAADFSAYLVTKGTCNGLKCGPRGLTRKGWVGDPPGETGQEPMQLATFGQALQPGSLSRREQLDPLRYSRTTLQGNSMFPSWEQDASAVHREVSGVNNARAPSAASKRQDTTRLLPRSLILDCHASTEQGSVGMGPTELCVGYNLLVCHLLRPLKKHSIWVAVTQFSQYSLSRLPLSRKGKSPDPCASWMRRCPNMLWLALHGLHPLSDQSQLEEPGTSIGNAEITCLRHRSRWELQTGAVPIWPPWNGPHNFHTDC

SEQ ID NO: 921272 - protein, 159 aa, Homo sapiens
MMGNISFSKKKKNIFFLSLVVLNVRYFFPWGQKSKVEELKKKEHMHEIFNEILRRINRTKPTGHESRNGVNRTAAVRNVCWAEIVVVPRAVEDFNFPFLFYTHFSNSFPLLSMPTGTPSLEQALLARNFLHVLTSKSGLSGKTEFREMTNDLVTAMKEV

SEQ ID NO: 921273 - protein, 198 aa, Homo sapiens
MPNSSGLMNRRDAIAKTDATVVALLKGAGAIPLGITNCSELCMWYESSNKIYGRSNNPYDLQHIVGGSSGGEGCTLAAACSVIGVGSDIGGSIRMPAFFNGIFGHKPSPDFSCESIWSMSFVHWCSRLQTFPALTIEGHKCKPTGPALPLPQRMHGSGSCRLHNPIHHLRHLSTLPRELRFGLNTLQLPRQLASTWKC

SEQ ID NO: 921274 - protein, 160 aa, Homo sapiens
MAPASLLKHNKSHLCSSSQQVPYLHLRPPQPGLYCQYRYQTFSQSHSVSLWEVPKFTTFSYLLLSLPNYSNLCLLPSSKVATTFLGIFSAIPHSWYQVTVLVRFHAADKDIPETGKKKRFNEPTVPCDWGHLTIMVEGERHVLHVGRQEKRACSRKLPLI

SEQ ID NO: 921275 - protein, 714 aa, Homo sapiens
GDSPFVFAKMCPELVPSGGFLVSLTSRMKPRAFMLGKGPAGQAVGVRIKTAGPQDQTHQDPHDSGSETSSNSKRKKAFSLEVQILSLDEKIKLDSTETKILNKSQIEAIAASLGLQSEDSAPPTEETAYGRSLKVALGILNERTNLSQASTSDEEEITMLSQNVPQKQSDSPPHKKYRKDEGDLPGCLEERENSACLLASSESDDSLYDDKSQAPTMVDTIPSEVETKSLQNSSWCETFPSLSEDNDEKENKNKIDISAVMSVHSAVKEESACVKDEKFAPPLSPLSSDMLIMPKALKEESEDTCLETLAVPSECSAFSENIEDPGEGPSNPCLDTSQNQPSMESEMGAAACPGSCSRECEVSFSASNPVWDYSHLMSSERNFQRLDFEELEEEGQASDKSLLPSRINLSLLDDDEEDEELPRFILHYETHPFETGMIVWFKYQKYPFWPAVIKSIRRKERKASVLFVEANMNSEKKGIRVNFRRLKKFDCKEKQMLVDKAREDYSESIDWCISLICDYRVRIGCGSFTGSLLEYYAADISYPVRKETKQDTFRNKFPKLHNEDAREPMAVTSQTKKMSFQKILPDRMKAARDRANKNLVDFIVNAKGTENHLLAIVNGTKGSRWLKSFLNANRFTPCIETYFEDEDQLDEVVKYLQEVCNQIDQIMPTWIKDDKIKFILEVLLPEAIICSISAVDGLDYEAAEAKYLKGPCLT

SEQ ID NO: 921276 - protein, 144 aa, Homo sapiens
RSMGNGRFLPKDVRVCVAANVGINIEVPDKCPRSPYFIWKKYPDYDSKAKDRRQMIKVVKAPTVPSYTLPTSVVPWVIDQTDFGMLGSHLKQLDPNGFLMPKPHITQMHSRSRRLLLLYLVSAIFYHAAKFYYEELPEMQTNTW

SEQ ID NO: 921277 - protein, 624 aa, Homo sapiens
MSERTQEQDFVIITVDDSDDNNDCSIEMVEVSETADNSTNDIADDSTYVTADNPTDDTATQPNFPGGNDGHHRPLQMSYGSGSVTQAGVQWHDHSSLQPQPLGLKQFFHLSLPSSWDDRRTPPCPVAHGDQIVSQINHPVHLRRYSYNSEEVDFPKRGRFYTPEVQSSISPPAERQETHAWASPAVTSLESAACHELQEADLSESLSYPRIVSSSSLQQYVAQGGSFPCFGMPWNFISGGAESTNAVISFANATTAVPMAVLSRRESSLANNPGVVNYSALPENENVGPGRALSSFCFHPNLAPEAGKFKSKVPAGLCGEGCILCKRGALCPHMAEALLPLNILVKVDTNTENSVNTMNRSTLLDSDSGQDSSSSSVCIPPKYGYLGDPKRNVRVLKIHLLAVQNMAKPKQAACYLVRILFSKEILISSSVDIHLKDSQSLDPNKMAALRDRATKSSKEQQVMTACGRSHPFPSFQIKTVRKNKKRTNRVASASADRNDQRGRDGGEGCSWMFQPMNNSKMREKRNLQPNSNAIPEGMREPSTDNPEEPGEAWKFLQENYPICDLSENGRDWKSCVTSINSGIRSLRHDVRRAEARSQSLPAVTPPELEQESKPGDPDATDPST

SEQ ID NO: 921278 - protein, 179 aa, Homo sapiens
NVPAPRPGCMHGGNSGLQRNRALRAGAQGASRPGLFVCADVKGGAQIKCGNRDDLEGGGAGSPRRTKLLAVGLQRVAEVTATGSCTGGSGGGRGTPGLKRLVGLENSERAPGGGGKKTQPVAKCLAFGYFLRKRISGRSGRGGWGHHRASEMGSEFPSAFWEKPCLPSFPSPHPAEGLR

SEQ ID NO: 921279 - protein, 511 aa, Homo sapiens
MGPRGSGPRCAMKQVNELKEKGNKALGVENIDNALQCYSEAIKLDPHNHVLYSNCSATYAKKGDYQKAYKDGCKTVDLKERCLQEERLTALKHYDKAKELDPSNMTYITNQAAVYFEKGDYNKCWELCEKSIEVGRENREDYLQIAKVCARIGNSYFKEEKYKDAIHFYNKCAQEMPAGRENPEGARTAGLHKPRPGFRREEQRQRVFSERGLSPRHEALYGSHQKEPERCQIIQQSSCLLHQTPGFQLALKDCEECIQLEPTFIKGYTRKAVALEAMKDYTKVMDVYRKALDPDSSCKEAADGYQRCMMAQYNRHHSPEDVKRRAMADPEVQQIMSDIAMHLILEQMQKDPPGTQRTLKESCNRKEDPEADGCGSDCNSTMTCPSPLPFALMRKEERGPRQAARSGRESRGREGLTSLYLYVSPGKTRRFVPALFVLPLPLGPLSTYMVSSQLPLSSVSPFPAPSGCLSCSPIVGYFLFGAVGMYREGRGFFPASGPSCLTLFIPRPLLQ

SEQ ID NO: 921280 - protein, 313 aa, Homo sapiens
ELLLTFLRIPSFIFTVMALFYALIASTLCILPSWYMVQWPGGRILHRHELDTFLAQAVSTQLYEPDRLQELKIEKLDARGIQLAALFMSGVDTALFANDACGQPVPWEHCCPWIYFDGKLFQSKLIKAGRERVSLVELCDGQKKFADLCTRGIRISNLGYGGEGLHPIPPQGGKLEIAGMVVGQWAGSRSSRGRGSFGMQVVSVGGPGKGHGKEQTGRGSKGHKKGNKQGSSDGVSKSLELHQGRSRSQVNGNSGALIKEEKSDHRLPAPSQCALSRDSNECNNGNRYLPMNNREKNHLQEQKLETVAQRKED

SEQ ID NO: 921281 - protein, 142 aa, Homo sapiens
MATRVTSGRPHCSSQLGLACCQSSKVRSKTKISLTSGMSNPDHAVTSSSKTPESGHSSPWSLDKASETFLSQCSRRPLKVKTGGVNSGGNSRSYSCHGSGCSPKKEGVLHMGPALGPRWTFTYLSIPKAHPSAIYTNSYSLT

SEQ ID NO: 921282 - protein, 297 aa, Homo sapiens
MKTPFGKAAAGQRSRTGAGHGSVSVTMIKRKAAHKKHRSRPTSQPRGNIVGCRIQHGWKDGDEPLTQWKGTVLDQVPVNPSLYLIKYDGFDCVYGLELHRDERVSSLEVLPNRVASSRISDTHLAEIMVGKAVEHIFETEEGSKNEWRGMVLAQAPVMNTWFYITYEKDPVLYMYQLLDDYKDGDLRILQDSNDSPLAEREPGEVIDSLVGKQVEYAKDDGSKRTGMVIHQVEAKPSVYFIKFDDDFHIYEQLFFMGDCCETNRMASFLFNPKSGHKVTAPLKAVLNEQNIGLCEQI

SEQ ID NO: 921283 - protein, 78 aa, Homo sapiens
ETAAQQRLVGVRCGRGAAATATAAATRKAEDAGAKSKGRRHGHLRLPRRPLRDTHCLWIILSQLLQAPGCSPADFPPP

SEQ ID NO: 921284 - protein, 78 aa, Homo sapiens; identical to SEQ ID NO: 921283

SEQ ID NO: 921285 - protein, 1433 aa, Homo sapiens
MLYVERFCQDSHLSVSSGENQFSQLLCVQSLAQGTLLSLRSTRGGIALKKCKNDEEEDLRTELNLLRKYSFHKNIVSFYGAFFKLSPPGQRHQLWMVMELCAAGSVTDVVRMTSNQSLKEDWIAYICREILQGLAHLHAHRVIHRDIKGQNVLLTHNAEVKLVDFGVSAQVSRTNGRRNSFIGTPYWMAPEVIDCDEDPRRSYDYRSDVWSVGITAIEMAEGAPPLCNLQPLEALFVILRESAPTVKSSGWSRKFHNFMEKCTIKNFLFRPTSANMLQHPFVRDIKNERHVVESLTRHLTGIIKKRQKKGPSCTHELLRLPTSSRCRPLRVLHGEPSQPRWLPDREEPQVQALQQLQGAARVFMPLQALDSAPKPLKGQAQAPQRLQGAARVFMPLQAQVKAKASKPLQMQIKAPPRLRRAARVLMPLQAQVRAPRLLQVQSQVSKKQQAQTQTSEPQDLDQVPEEFQGQDQVPEQQRQGQAPEQQQRHNQVPEQELEQNQAPEQPEVQEQAAEPAQAETEAEEPESLRVNAQVFLPLLSQDHHVLLPLHLDTQVLIPVEGQTEGSPQAQAWTLEPPQAIGSVQALIEGLSRDLLRAPNSNNSKPLGPLQTLMENLSSNRFYSQPEQAREKKSKVSTLRQALAKRLSPKRFRAKSSWRPEKLELSDLEARRQRRQRRWEDIFNQHEEELRQVDKDKEDESSDNDEVFHSIQAEVQIEPLKPYISNPKKIEVQERSPSVPNNQDHAHHVKFSSSVPQRSLLEQAQKPIDIRQRSSQNRQNWLAASGDSKHKILAGKTQSYCLTIYISEVKKEEFQEGMNQKCQGAQVGLGPEGHCIWQLGESSSEEESPVTGRRSQSSPPYSTIDQKLLVDIHVPDGFKVGKISPPVYLTNEWVGYNALSEIFRNDWLTPAPVIQPPEEDGDYVELYDASADTDGDDDDESNDTFEDTYDHANGNDDLDNQVDQANDVCKDHDDDNNKFVDDVNNNYYEAPRQAMAEMEAASKMVMMEVVEKRKPTEAMEAIQPIEAMEEVQPVRDNAAIGDQEEHAANIGSERRGSEGDGGKGVVRTSEESGALGLNGEENCSETDGPGLKRPASQDFEYLQEEPGGGNEASNAIDSGAAPSAPDHESDNKDISESSTQSDFSANHSSPSKGSGMSADANFASAICHKNRLRVYHLTWLRNKILNNDPESKRRQEEMLKTEEACKAIDKLTGCEHFSVLQHEETTYIAIALKSSIHLYAWAPKSFDESTAIKVFPTLDHKPVTVDLAIGSEKRLKIFFSSADGYHLIDAESEVMSDVTLPKNPLEIIIPQNIIILPDCLGIGMMLTFNAEALSVEANEQLFKKILEMWKDIPSSIAFECTQRTTGWGQKAIEVRSLQSRVLESELKRRSIKKLRFLCTRGDKLFFTSTLRNHHSRVYFMTLGKLEELQSNYDV

SEQ ID NO: 921286 - protein, 138 aa, Homo sapiens
MKVLSAFPYKNSSHESDLILTIPLESCVSADLSAGLQGWACVPGHRWTCGFQGWDPGPQAELCSTREETECAGRGEGFSVAQPNTTFSQGPCPHPRSGCFPPVVSERQRHGSGTEPCGDDCNGSMPVSNKRAVAGRSP

SEQ ID NO: 921287 - protein, 138 aa, Homo sapiens; identical to SEQ ID NO: 921286

SEQ ID NO: 921288 - protein, 138 aa, Homo sapiens; identical to SEQ ID NO: 921286

SEQ ID NO: 921289 - protein, 118 aa, Homo sapiens
MVLTLQFLSHDQGQITKELQQFVVSGSPMRAPEEVTGAQAGVQWRDLGSLQPPPPSSLPWPSKVLRLQPLPGRHPVWEVRSVSAWPPIVWDVRSPSAQQPPRLRSEEPLSPAATPSEK

SEQ ID NO: 921290 - protein, 138 aa, Homo sapiens; identical to SEQ ID NO: 921286

SEQ ID NO: 921291 - protein, 214 aa, Homo sapiens
MESENMDSENMKTENMESQNVDFESVSSVTALEALSKLLNPEEEDDSDYGQTNGLSTIGAMGPGNIGPPQIEELKVIPETSEENNEDIWNSEEIPEGAEYDDMWDVREIPEYEIIFRQQVGTEDIFLGLSKKDSSTGCCSELVAKIKLPNTNPSDIQIDIQETILDLRTPQKKLLITLPELVECTSAKAFYIPETETLEITMTMKRELDIANFF

SEQ ID NO: 921292 - protein, 214 aa, Homo sapiens; identical to SEQ ID NO: 921291

SEQ ID NO: 921293 - protein, 137 aa, Homo sapiens [sequence omitted]

SEQ ID NO: 921294 - protein, 167 aa, Homo sapiens
GPRLLINLGTARARVPPHHCPACGGAQTARALPGCRSRAFPARLPAPPRGAAPGGGVRKAGSRRQRGGRLESRARVLPDLPTPPHGLRGTGLPDLTGFKLKPYVSYLAPESEETPLTAAQLFSEAVAPAIEKDFKDGTFDPDNLEKYGFEPTQEGKLFQLYPRNFLR

SEQ ID NO: 921295 - protein, 137 aa, Homo sapiens [sequence omitted]

SEQ ID NO: 921296 - protein, 137 aa, Homo sapiens [sequence omitted]

SEQ ID NO: 921297 - protein, 137 aa, Homo sapiens [sequence omitted]

SEQ ID NO: 921298 - protein, 137 aa, Homo sapiens [sequence omitted]

SEQ ID NO: 921299 - protein, 137 aa, Homo sapiens [sequence omitted]

SEQ ID NO: 921300 - protein, 137 aa, Homo sapiens [sequence omitted]

SEQ ID NO: 921301 - protein, 137 aa, Homo sapiens [sequence omitted]

SEQ ID NO: 921302 - protein, 173 aa, Homo sapiens
SASTRPASEAEQGRGRVGAGAGAAWSSCGVSGPGRGMGVLAAAARCLVRGADRMSKWTSKRGPRSFRGRKGRGAKGIGFLTSGWRFVQIKEMVPEFVVPDLTGFKLKPYVSYLAPESEETPLTAAQLFSEAVAPAIEKDFKDGTFDPDNLEKYGFEPTQEGKLFQLYPRNFLR

SEQ ID NO: 921303 - protein, 137 aa, Homo sapiens [sequence omitted]

SEQ ID NO: 921304 - protein, 137 aa, Homo sapiens [sequence omitted]

SEQ ID NO: 921305 - protein, 137 aa, Homo sapiens [sequence omitted]

SEQ ID NO: 921306 - protein, 137 aa, Homo sapiens [sequence omitted]

SEQ ID NO: 921307 - protein, 119 aa, Homo sapiens
MGVLAAAARCLVRGADRMSKWTSKRGPRSFRGRKGRGAKGIGFLTSGWRFVQIKEMVPEFVVPDLTGFKLKPYVSYLAPESEETPLTAAQLFSEAVAPAIEKDFKDGTFDPDNLGNFLR

SEQ ID NO: 921308 - protein, 178 aa, Homo sapiens
MPVLLLMTLEDRGSQEGAALHEEEQRRGSKRPTSPDCQLWVDRGGRCPQISDLAKNMADSRAQYDKLARKNREELDKYWSQQIEESTRVVTTQSAKVGAAEMTLTELRHRVQSLEIDLDSTRNLKASLENSLREVEARYALQMEPSLLFSKIIFGRVWEISYLHVFEGKQVVVCWFAY

SEQ ID NO: 921309 - protein, 238 aa, Homo sapiens
MPVLLLMTLEDRGSQEGAALHEEEQRRGSKRPTSPDCQLWVDRGGRCPQISDLAKNMADSRAQYDKLARKNREELDKYWSQQIEESTRVVTTQSAKVGAAEMTLTELRHRVQSLEIDLDSTRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 921310 - protein, 1146 aa, Homo sapiens
TSVVPIIMETQKDEAAQAKGAAASGSTREQTAEKGAKNKAAEATEGPTSEPSSSGPGRLKKTAMKLFGGKKGICTLPSFFGGGRSKGSGKGSSKKGLSKSKTHDGLSEAAHGPEDVVSEGTGFSLPLPELPCQFPSSQSAHGALETGSRCKTSVAGATEKAVAEKFPSMPKPKKGLKGFFSSIRRHRKSKVTGAEQSEPGAKGPERVRARPHEHVSSAPQVPCFEETFQAPRKENANPQDAPGPKVSPTPEPSPPATEKMACKDPEKPMEACASAHVQPKPAPEASSLEEPHSPETGEKVVAGEVNPPNGPVGDPLSLLFGDVTSLKSFDSLTGCGDIIAEQDMDSMTDSMASGGQRANRDGTKRSSCLVTYQGGGEEMALPDDDDEEEEEEEEVELEEEEEEVKEEEEDDDLEYLWETAQMYPRPNMNLGYHPTTSPGHHGYMLLDPVRSYPGLAPGELLTPQSDQQESAPNSDEGYYDSTTPGFEDDSGEALGLVRRDCLPRDSYSGDALYEFYEPDDSLENSPPGDDCLYDLHGRSSEMFDPFLNFEPFLSSRPPGAMETEEERLVTIQKQLLYWELRREQLEAQEARAREAHAREAHAREAYTREAYGREAYAREAHTWEAHGREARTREAQAREVRCRETQVRETQARQEKPVLEYQMRPLGPSVMGLAAGVSGTSQISHRGITSAFPTTASSEPDWRDFRPLEKRYEGTCSKKDQSTCLMQLFQSDAMFEPDMQEANFGGSPRRAYPTYSPPEDPEEEEVEKEGNATVSFSQALVEFTSNGNLFSSMSCSSDSDSSFTQNLPELPPMVTFDIADVERDGEGKCEENPEFHNDEDLAASLEAFELGYYHKHAFNNYHSRFYQGLPWGVSSLPRYLGLPGLHPRPPPAAMALNRRSRSLDTAETLEMELSNSHLVQGYLESDELQAQQEDSDEEDEEEEEGEWSRDSPLSLYTEPPGAYDWPAWAPCPLPVGPGPAWISPNQLDRPSSQSPYRQATCCIPPMTMSISLSVPESRAPGESGPQLARPSHLHLPMGPCYNLQPQASQSMRARPRDVLLPVDEPSCSSSSGGFSPSPLPQAKPVGITHGIPQLPRVRPEHPQPQPTHYGPSSLDLSKERAEQGASLATSYSSTAMNGNLANVGER

SEQ ID NO: 921311 - protein, 667 aa, Homo sapiens
MTRGVRTAVVTMKKAAVWTDSRYWTQAERQMDCNWELHKEVGTTPIVTWLLTEIPAGGRVGFDPFLLSIDTWESYDLALQGSNRQLVSITTNLVDLVWGSERPPVPNQPIYALQEAFTGSTWQEKVSGVRSQMQKHQKVPTAVLLSALEETAWLFNLRASDIPYNPFFYSYTLLTDSSIRLFANKSRFSSETLSYLNSSCTGPMCVQIEDYSQVRDSIQAYSLGDVRIWIGTSYTMYGIYEMIPKEKLVTDTYSPVMMTKAVKNSKEQALLKASHVRDAVAVIRYLVWLEKNVPKGTVDEFSGAEIVDKFRGEEQFSSGPSFETISASGLNAALAHYSPTKELNRKLSSDEMYLLDSGGQYWDGTTDITRTVHWGTPSAFQKCSLLLPRGYFRPLTRPQPKLSLILFWKHRGLASWGRGEGIVSVHQRALGVEQRAAVMLHAAGRLWGRHCAGNTERGTKCCPGLQELTEAYTRVLIGNIDLSRLIFPAATSGRMVEAFARRALWDAGLNYGHGTGHGIGNFLCVHEWPVGFQSNNIAMAKGMFTSIEPGYYKDGEFGIRLEDVALVVEAKTKYPGSYLTFEVVSFVPYDRNLIDVSLLSPEHLQYLNRYYQTIREKVGPELQRRQLLEEFEWLQQHTEPLAARAPDTASWASVLVVSTLAILGWSV

SEQ ID NO: 921312 - protein, 143 aa, Homo sapiens
MFRLLSSCCSCLRTTEETRRNVTIPIIGLNNSGKTVLVEAFQKLLPSKTDHCMKSELTTLLLDEYELSIYDLNGDLKGREAWPNYYAQAHGLVFVLDSSDIRRMQEVKIILTHLLSDKRVAGKPILMSHVQPSETLKEETISP

SEQ ID NO: 921313 - protein, 396 aa, Homo sapiens
IFWADRQAVMHGDLACNTPRDLAVVPLDTGHLTAASNAEVRASPEVPDGSGATGSKGGTWATATPQLLSEEDLPWHCDLYQDTCRGDFWQSEPGKCEGGPWGRSSWIPQAEAGNECEAHEEFEEKGRAEGLGVDINPPDPALTTLVLKKEKQQTQKRKHTGKWKHPEHVKDPASPRQCLGPGCVYPTWPGSKYCSDDCGMRLAGAHINNILPQHIQQWQRSPCIANEHGKKMLEHIHHKQQNTYTCLKDMEHHFHELEAIILHGKQQASNKGEKGSKDLQIFCASCRRPISKRVTFHHMEHCFAKYECQLPVGSLYPTCIERATWLFCDVYNLKSKRYCKRLQVLCPEHSWDPKSLNGLDDACPHWSTYRKRGIVPQKLYVMDDTQEPHLHLDLIW

SEQ ID NO: 921314 - protein, 263 aa, Homo sapiens
MPPQRLLPPLFAAVAILKGKQAVPKKELGTGARRASSNLVLCKALRKRQSKLEAKGTGLWQSLNTITKQREMIKSVTRVSANLFKNVVVGDGYTEKVTFQMDFERCVGIPCREKVQTPGQTIFLGFLQFHSRALAPRNLPCWTVHLEQEGCGSSWGGTKGFDSPTGNTNVAPCGCTDERLSTAQPTVLLVVEKRVKGWGWYCTDPNKPLDEYRWQTCGGFPETISVQHSKDTDAGPLTGAQRTNEVTLLGMRVERELGEVVVV

SEQ ID NO: 921315 - protein, 420 aa, Homo sapiens
MLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGEDDVVGRASREKPQQASGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNASYTNLKFMATQIASGMKYLSSLNFVHRDLATRNCLVGKNYTIKIADFGMSRNLYRGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 921316 - protein, 182 aa, Homo sapiens
MQSDVELDCDIEPCGHTKFPPTLPLSTTVIVCSCHPVATASTMAEAFSKTTSEEDQSIQEPKEANSMTAQKQKKRHANSGGDIFGDSFAAYFPRVLKQVHQALSLSQEAVSVMDSMVRDILDRIATEAGHLAHYSKCVTITSRDIRMAVCLLLPGKMGKLAESQGTNATLSFLNGRFYQLSF

SEQ ID NO: 921317 - protein, 104 aa, Homo sapiens
RRLSTAGLWAGRLTWCGASLGLSPAYGLSRVFKPSGFLLVKMSDKPDLSEVEKFDRSKLKKTNTEEKNTLPSKEKLHYVRYGKRESEYADIRSKKPSFLPDVCQ

SEQ ID NO: 921318 - protein, 104 aa, Homo sapiens; identical to SEQ ID NO: 921317

SEQ ID NO: 921319 - protein, 104 aa, Homo sapiens; identical to SEQ ID NO: 921317

SEQ ID NO: 921320 - protein, 182 aa, Homo sapiens; identical to SEQ ID NO: 921316

SEQ ID NO: 921321 - protein, 181 aa, Homo sapiens
MNRSGMSPVGGDSTVSFYILLFIPPLEHRAKVGRADTPLSRGSEALESAGTSVGAGSPVPPVRRRTAALPRPLPAPGQGNGARGLAKARGGRCTAPLRAGDALLRGPSAFTSWARLALPCAAARQSRYPARKCLLPGKTAAVCGSGWQSLKPSRTSPGRQKALCLSWGLFRQNEQLKKCRL

SEQ ID NO: 921322 - protein, 326 aa, Homo sapiens
IWHFLVLIMRIVLQLAKMNLMDITKIFSLLQPDKEEEDTDTEEKQALNQAVYDNDSYTLDQLLRQERYKRFINSRSGWGVPGTPLRLAASYGHLSCLQVLLAHGADVDSLDVKAQTPLFTAVSHGHLDCVRVLLEAGASPGGSIYNNCSPVLTAARDGAVAILQELLDHGAEANVKAKLPVWASNIASCSGPLYLAAVYGHLDCFRLLLLHGADPDYNCTDQGLLARVPRPRTLLEICLHHNCEPEYIQLLIDFGANIYLPSLSLDLTSQDDKGIALLLQARATPRSLLSQVRLVVRRALCQAGQPQAINQLDIPPMLISYLKHQL

SEQ ID NO: 921323 - protein, 684 aa, Homo sapiens
CTHVRTYVCAASFDLQKPAATHSVRCLSGWGSGPGKTRAVWMLRGGEQQTSFKMSHQEGSTDGLPDLGTESLFSSPEEQSGAVAATEASSDIDIATSELSVTVTGDGSDSRDGGFPNDASTENRSSDQESASEDIELESLEDFEHFLMSGESLFHYPLVGEEETEREEEDEEIQEEGGEEEEEEEEEEEEEEEEEEEEEEQPRAGPQGSGGNHEQYSLEEDQALEEWVSSETSALPRPRWQVVTALHQRQLGSRPRFVYEACGARAFVQRFRLQYRLADHVGCVNTVHFNQRGTRLASSGDDLKVIVWDWVRQRPVLNFESGHTNNVFQAKFLPNCGDSTLAMCARDGQVRVAELINASYFNNTKCVAQHRGPAHKLALEPDSPYKFLTSGEDAVVFTIDLRQDRPASKVVVTRENDKKVGLYTITVNPANTYQFAVGGQDQFVRIYDQRKIDKKENNGVLKKFTPHHLVNCDFPTNITCVVYSHDGTELLASYNDDDIYLFNSSHSDGAQYSKRFKGHRNNTTVKGVNFYGPRSEFVVSGSDCGHIFFWEKSSCQIIQFLKGSREGTINCLEPHPYLPVLACSGLDHDVKIWTPTAKAATELTGLKKVIKKNKWERDEDSLHHGSLFDQYMLWFLLRHVTQRGRHQDWRSGEAEFPDEESDESSSTSETSEEEVQDRVQCMPS

SEQ ID NO: 921324 - protein, 148 aa, Homo sapiens
MAEASSETTSEEGQSIQEPKEANSTKAQKQKRRGCRGSRRRHANRRGDSFGDSFTPYFPRVLKQVHQGLSLSQEAVSVMDSMIHDILDRIATEAGQLAHYTKRVTITSRDIQMAVRLLLPGKMGKLAEAQGTNAALRTSLCAIWQQRK

SEQ ID NO: 921325 - protein, 216 aa, Homo sapiens
RRAPSPPLPVSAPAAAAAAQRAAQMQAIKGVVVGDGAVGKTCLLISYTTNAFPGEDIPTAFDNYSANVMVDGKLVNLGLWNTAGQEDYDRLRPLSYPQADVFLICFSLVSPASFENVLAKWYPEVQHHCPNTPIILVGTKLDLRDDKDRIQKLKEKKLTPITYPQGLAMAKEMGAVKYLECLALTRRGLKTVFDEAIRAVLCPPPVKKRKRKCLQL

SEQ ID NO: 921326 - protein, 216 aa, Homo sapiens; identical to SEQ ID NO: 921325

SEQ ID NO: 921327 - protein, 159 aa, Homo sapiens
HLGVYVQVTGDAMAWLGLRGLTISICGVTQFPLHDVAPGRHQSAYWLYGLASSEKFLWIGQGTKGRCPSIECRQGTDKCDKHSKEPFAMSGDILSYYHWRVDVASIWWVEPRNAARHPMSAEDGHTTENPPASSVNSTHIENLELKNTKIPHMRSCKSY

SEQ ID NO: 921328 - protein, 351 aa, Homo sapiens
MSDKNQIAARASLIEQLMSKRNFEDLGNHLTELETIYVTKEHLQETDVVRAVYRVLKNCPSVALKKKAKCLLSKWKAVYKQTHSKARNSPKLFPVRGNKEENSGPSHDPSQNETLGICSSNSLSSQDVAKLSEMIVPENRAIQLKPKEEHFGDGDPESTGKRSSELLDPTTPMRTKCIELLYAALTSSSTDQPKADLWQNFAREIEEHVFTLYSKNIKKYKTCIRSKVANLKNPRNSHLQQNLLSGTTSPREFAEMTVMEMANKELKQLRASYTESCIQEHYLPQVIDGTQTNKIKCRRCEKYNCKVTVIDRGTLFLPSWVRNSNPDEQMMTYVICNECGEQWYHSKWVCW

SEQ ID NO: 921329 - protein, 351 aa, Homo sapiens; identical to SEQ ID NO: 921328

SEQ ID NO: 921330 - protein, 138 aa, Homo sapiens
MKIVEEKCSLHKETKKNPPRNQPQLNRSGRCRQVTLHVRSNTLKTKDAWQNPVPFQRQSCVPCLKHRISLSDLFLIMLIVFALKRQSFCQMGHTNKFLKLSLHVYWEIHSFHHNIPKDLTPSNVNSLISHLIIYIWNG

SEQ ID NO: 921331 - protein, 297 aa, Homo sapiens
MPRGQKSKPRAREKRRQAREEPKDVEGAQVTVAEEGESLTSSPHFKDSPERSSAVETPSNEQEPGIALAITTAAAVSCTASNEGIDSQVEERSNASQAQATTGQRASDHLELVFGLDVREVDPNKSIYVLVNKLELGHDTRVNPNRSLPKNGLLMTILSAIFSQGNCAPEEEVWKVLNMMGVYEGQEHVIYGEPRNLLTKDLVQEQYLEYWEVPNSSPPSYEFLWRPRAYAETSKMKVLEFLAKIHGTVPSAFPSHYEEALKDVEERSQARIAARARTATMASARSKATSSSLACSK

SEQ ID NO: 921332 - protein, 161 aa, Homo sapiens
ASFPASMMLEGSWCMCEERCERSTMDPPKTEVKRTMRSVPCGFQHDTSNHTMVWLGPNLIAEMKEPTLPDPQPWTMQLPRTTQAPDVTWGMPKRTTQEAEQILLQTQTPFTPGCKARIRAMTTTPDKPAAAYICALQSIRPDAENRKGEELGIQSGWWEIL

SEQ ID NO: 921333 - protein, 166 aa, Homo sapiens
MAAKDQLEVQVMAAQEMELAGKDPVSHEHEERKPVTETKEGDVTDEHGERGSFAETDEHTGVDTKELEDIAADIKEHLAAKRKRIEKIAKACSEIKNRIKNVLRTTQLKRQKRDYRISLKLPNVLEEFITDEQKDEEGDGEKEEQIKIFQEQQKRWQQDGKGTERD

SEQ ID NO: 921334 - protein, 136 aa, Homo sapiens
MLKPAHIFEKLNIIRTINSSHHRQKRATSLSSEDAAGCRMERRGQEGAKPTGAEANNSQPPTLHGHTTEETEFRIQSYVWINLTIILSEKTSSTELCTKEKPNCAKQYLGIYIDSKVIQTRAAAHSSGTLSTFRLD

SEQ ID NO: 921335 - protein, 376 aa, Homo sapiens
QQNALELMMDHLQKQPNTLRHVVIPDLQSSEAVPKKQQKQHAGQVKRPLPHPKDVKCFCGLSLSNSLKNTGELQEPCVAFNQQQLVQQEQHLKEQQRQLREQLQQLREQRKVQKQKKMQEKKKLQEQKMQEKKKLQEQRRQKKKKLQERKKWQGQMLQKEPEEEQQKQQLQEQPLKHNVIVGNERVQICLQNPRDVSVPLCNHPVRFLQAQPIVPVQRAAEQQPSGFYQDENCGQQEDESQSFYPEAYQGPPVNQLPLIDTSNSEAISSSSIPQFPITSDSTISTLETPQDYIRLWQELSDSLGPVVQVNTWSCDEQGTLHGQPTYHQVQVSEVGVEGPPDPQAFQGPAAYQPDQMRSAEQTRLMPAEQRDSNKPC

SEQ ID NO: 921336 - protein, 237 aa, Homo sapiens
MFGPDLHCTPGVLTPAQIKSICQAILDSGKQYAIKKRKPFPLMYSYYGTEYLAHGLSSILQMLLSYHEHLKPSDRELVWQSVDFLMEQEQNCNWPPELGETIERENELVHWCHGAPGIAYLFAKAYLVSKKPQYLDTCIRCGELTWQKGLLKKGPGICHGVAGSAYVFLLLYRLTGNSKYIYRAQRFAQFLFTEEFKAGSRVLESIYSLYEGFSGTVCFLIDLLQPNQAEFPLFSSL

SEQ ID NO: 921337 - protein, 321 aa, Homo sapiens
TLASFFHLHPVVFSMGEQNHSPGKELQHRTRAEAPGKKSWHSQAYALGAVSNFMSTFLTFPIYKVVFRQQIHAMAVSEAVRQLWHEGPQYFYRGIYPPLLSKTLQGTLLFGTYDSLLCFLSPVGPHTLGHRWAAGLMSGVVEAVALSPFERVQNVLQDGRKQARFPSTFSILKEFNSYGLWGRLSLGYYRGFWPVLARNSLGSALYFSFKDPIQDGLAEQGLPHWVPALVSGSVNGTITCLVLYPLIVLVANMQSHIGWQNMPSLWASAQDVWNTRGRKLLLIYRGGSLVILRSSVTWGLTTAIHDFLQRKSHSRKELKTD

SEQ ID NO: 921338 - protein, 156 aa, Homo sapiens
MLWHLEIFSTSTRNYLSQFPTSSSSSSGTTLAWTSLSISLSAFWSKPFNKSLGSSYPSHIFLSSEPFNFLESSKLSHIFLSSSGPSKLFQPLPVTQFQICFYIFRYPYSSTPLSVVPIYCNVNTVLKWKEINCMENHLGIVIVQVRSSEGLDYIFL

SEQ ID NO: 921339 - protein, 171 aa, Homo sapiens
MESLRGYTHSDIGYRSLAVGEDIEEVNDEKLTVTSLMARGGEDEENTRSKPEYGTEAENNVGTEGSVPSDDQDREGGGGHEPEQQQEEPPLTKPEQQQEEPPLLELKQEQEEPPQTTVEGPQPAEGPQTAEGPQPPERKRRRRTAFTQFQLQELENFFDESQYPDVVARQL

SEQ ID NO: 921340 - protein, 157 aa, Homo sapiens
GCQGFLSGTTFSLHFPGNMTYMTLVISLLLPMYIKRPLCGHNVTGHYTLVVEKNLEVCAEENETLVFEVGLVLNSISGTQGASWGQKRRVRAPPAGHQRQCEILSAHCVADHRDRYKNHCNGVLQSGREIGLNSKYSMGQWDFTAKDQDGGQRMENC

SEQ ID NO: 921341 - protein, 490 aa, Homo sapiens
ATERAAMNTQKGSLTINVHRGSLAMSIQRGSLVPRDMDSSGRDMQLRVIPAEVKFLDTMAGRVYRLPITVHNICRWNQKIRFKEPVKPQFKLMLTSLDKELASGLQMTAMVEYHPDKDEDTFDRLLISIENKTTEIPLIGLIPSCQLEIESVVNFGTLVANSKVYSKEITITNHGKAPGIFKAEYHGQLPILIFPTSGIVDAKSSMVIKVDFCADQPRIVDEEAIVILQGQPEMLLSIKAHVVEQIIELLSMSSDRRLECIHFGPVFFGSSKIKHARVYNNSPEPINWVAIIQDDAVGEELKVELALTGTGLPVLLQFDPGPVLNFKPCFMGERSEIQCIIKNQCELLPVTYHFKKTANFEIDPEKGKITGGGMVDVMCSFVPHQLGVFKVKQMIEIIGLVAEEDLQSLSVKSFHHVYLAFNSICKASTKKVVMKFDPGLFSGPSRLGTSVLEGLKCSWSAGHNIPIGGAVKSTSSGPGWWDALVLAVVV

SEQ ID NO: 921342 - protein, 252 aa, Homo sapiens
TARYEAGCCQDDSWRMESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAGKPGVLGLRWVNNHCYWG

SEQ ID NO: 921343 - protein, 398 aa, Homo sapiens
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAWKPLLLIVPLRLGINQINPVYVDAFKECFKMPQSLGALGGKPNNAYYFIGFLGDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 921344 - protein, 321 aa, Homo sapiens
MLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAWKPLLLIVPLRLGINQINPVYVDAFKECFKMPQSLGALGGKPNNAYYFIGFLGDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 921345 - protein, 321 aa, Homo sapiens; identical to SEQ ID NO: 921344

SEQ ID NO: 921346 - protein, 149 aa, Homo sapiens [sequence omitted]

SEQ ID NO: 921347 - protein, 156 aa, Homo sapiens
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLK

SEQ ID NO: 921348 - protein, 337 aa, Homo sapiens
TARYEAGCCQDDSWRMESVLSKYEDQITIFTDYLEEYPDTDELVWILGKQHLLKTGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAWKPLLLIVPLRLGINQINPVYVDAFKECFKMPQSLGALGGKPNNAYYFIGFLGDELIFLDPHTTQTFVDTEENGTVNDQTFHCLQSPQRMNILNLDPSVALGFFCKEEKDFDNWCSLVQKVKLYVFL

SEQ ID NO: 921349 - protein, 348 aa, Homo sapiens
SFQFLATMTSAAKKIILSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 921350 - protein, 398 aa, Homo sapiens; identical to SEQ ID NO: 921343

SEQ ID NO: 921351 - protein, 351 aa, Homo sapiens
TARYEAGCCQDDSWRMESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 921352 - protein, 321 aa, Homo sapiens; identical to SEQ ID NO: 921344

SEQ ID NO: 921353 - protein, 214 aa, Homo sapiens [sequence omitted]

SEQ ID NO: 921354 - protein, 134 aa, Homo sapiens
MLEVGPGGRCLGHGGGSFMASCCPCYKPRHILFLLRVLVAEGWKLSPFQEFALGKQELAKVTLTRSRTVKFKVWSMGVGYESLAPRLNLGCYIRITPHNGKILKIPWNVNPLEVGMTASNGMADSQIMVTNWLR

SEQ ID NO: 921355 - protein, 104 aa, Homo sapiens
MAQVRETSLPSGSGVRWISGGGGGASPEEAVEKAGKMEEAAAGATKASSRREAEEMKLEPLQEREPAPEENLTWSSSGGDEKVLPSIPLRCHSSSSPVCPRRKP

SEQ ID NO: 921356 - protein, 470 aa, Homo sapiens
MAQVRETSLPSGSGVRWISGGGGGASPEEAVEKAGKMEEAAAGATKASSRREAEEMKLEPLQEREPAPEENLTWSSSGGDEKFMTSGFEDKQSTCETKEQEPKLVKPKKKRRKKSVYTVGLRGLINLGNTCFMNCIVQALTHIPLLKDFFLSDKHKCIMTSPSLCLVCEMSSLFHAMYSGSRTPHIPYKLLHLIWIHAEHLAGYRQQDAHEFLIAILDVLHRHSKDDSGGQEANNPNCCNCIIDQIFTGGLQSDVTCQACHSVSTTIDPCWDISLDLPGSCATFDSQNPERADSTVSRDDHIPGIPSLTDCLQWFTRPEHLGSSAKIKCNSCQSYQESTKQLTMKKLPIVACFHLKRFEHVGKQRRKINTFISFPLELDMTPFLASTKESRMKEGQPPTDCVPNENKYSLFAVINHHGTLESGHYTSFIRQQKDQWFSCDDAIITKATIEDLLYSEGYLLFYHKQGLEKD

SEQ ID NO: 921357 - protein, 537 aa, Homo sapiens
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQVDMHDMLLEELAPVGTAHIPPTMHLESPALQVMGPAQEAPVAEAWIPQAGPPELNYGATGECQNFLDPGYPLPKLDMNFSLENREEPWVKELQDSKEMKQLLDSKIGFEIGIENEEDTSKQKKMETMYPFIVTLEGNALQGPILQKDYVQLENQWETPPEDLQTDLAKLVDQQNPTLGETPENSNLEEPLNPKPHKKKSPGEKPHRCPQCGKCFARKSQLTGHQRIHSGEEPHKCPECGKRFLRSSDLYRHQRLHTGERPYECTVCKKRFTRRSHLIGHQRTHSEEETYKCLECGKSFCHGSSLKRHLKTHTGEKPHRCHNCGKSFSRLTALTLHQRTHTEERPFKCNYCGKSFRQRPSLVIHLRIHTGEKPYKCVPCGKKGDSEFCQTIKMCQEHKDEGDVICLKWILQLQQLQPRNI

SEQ ID NO: 921358 - protein, 164 aa, Homo sapiens
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQVRKECGIFVIGPKEVAEAAGTRPHICLYVIPQPQDFSRVLFLFLFC

SEQ ID NO: 921359 - protein, 733 aa, Homo sapiens
PDNCVSKETRLQRRMMRCSSLKKHISFHLYQYDTDMIGNAGLVIQQPSILQSEDKSYNGGGIGSSNRIMDFLEEPIPGVGTYDDFNTIDWVREKSRDRDRHREITNKSKESTWALIHSGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 921360 - protein, 720 aa, Homo sapiens
PDNCVSKETRLQRRMMRCSSLKKHISFHLYQYDTDMIGNAGLVIQQPSILQSEDKSYNGGGIGSSNRIMDFLEEPIPGVGTYDDFNTIDWVREKSRDRDRHREITNKSKESTWALIHSGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITSCLSQGSSD

SEQ ID NO: 921361 - protein, 733 aa, Homo sapiens; identical to SEQ ID NO: 921359

SEQ ID NO: 921362 - protein, 106 aa, Homo sapiens
YDAHIRLNGYPFLEAKEEFAHKTLAMDVMKPRRNDPLLTVLTQDSMTVEDVETIISETTYSGFPVVVSRESQRLVGFVLRRDLIISIGKDFRKGIVESTVELNKYA

SEQ ID NO: 921363 - protein, 200 aa, Homo sapiens
MLPSSNQILTVFGDVAASPTVVADVSEKDTVLSITTGLTTAVTGVSVMSYKVCTRPHSRVTDIPDALPARLSSYSRSQKHNNLLTERRGVRGPRGLQTGRESEELKGRPLTIAEEIKVDAAHALEAHCGDSGEVVLFWHQRCGSRQSWSCACCPLPLRPAAAIQACLSLSLSFMPLSPPHLGTASSKNSCYDTEFNQESA

SEQ ID NO: 921364 - protein, 214 aa, Homo sapiens
MLPSSNQILTVFGDVAASPTVVADVSEKDTVLSITTGLTTAVTGVSVMSYKVCTRPHSRVTDIPDALPARLSSYSRSQKHNNLLTERRGVRGPRGLQTGRESEELKGRPLTIAEEIKVDAAHALEAHCGDSGEVVLFWHQRCGSRQSWSCACCPLPLRPAAAIQACLSLSLSFMPLSPPHLGTASSKNSCYDTEFNQEVMPHSIRNYATAEEVY

SEQ ID NO: 921365 - protein, 200 aa, Homo sapiens; identical to SEQ ID NO: 921363

SEQ ID NO: 921366 - protein, 214 aa, Homo sapiens; identical to SEQ ID NO: 921364

SEQ ID NO: 921367 - protein, 188 aa, Homo sapiens
QQRLPLKMVCLLHFNAGKDPVRDECEERNPFTETREEDVTDEHGEREPFAEKDEHTGQKRDYRHTRKLLNVLKEYIAEKQKDDEAEEAEAAAAAAEAAAAAEAAAAAAEVIVVEDEEEEEKEEEEEKEEEEEEGEEEGGGEEGEEGGGGGEGEETEEEEEEEEEEEEEEQIVESISRKTEEVATTYRC

SEQ ID NO: 921368 - protein, 226 aa, Homo sapiens
IQWVQKAGLLLHRVWKHGMPLSRCQYYALGLPSFQKFDGAVRRGQLSSIPYNGIFTDCLHTAPGKATDTQHHNMKAARRKAVPCKVIGVELPKTMGTHLLQQCDLDMRPGVKRDHFGALKFDWQCKGKMWGCSFHTRSPLGPSGAERRGPLPSRPQNSRSTDSLHCVPGKATDTQYQPQKRPGQKVIFCKATGAGLSKAIVAHLLHQCSVDDTSSATEKWGTDRIH

SEQ ID NO: 921369 - protein, 890 aa, Homo sapiens
MAMNFGDHASGFRHDDVIRFINNEVLRNGGSPAFYTAFRSRPWNEVEDRLRAIVADPRVPRAIKRACTWSALALSVQVAARQQEELLYQVWWLQGHVEECQATSWALTSQLQQLRLEHEEVATQLHLTQAALQQVLNERDGLCGRLLEVERSMQVYPMPQDFVPGPEAGQYGPVAGTLNAEQSEAVATEAQGMPHSEAQVAAPTAVYYMPEPQSGRVQGMQPLLLMQAPHPVPFHMPSPMGLPYSTPLPPPVVMESAAAIAPQMPPAGIYPPGLWATVGSQEETAPPWDQKCHGQDGYPENFQGVYHPGDNRSCNQKEGSECPQGMTSQGDSSSHSLKKDPVMQEGTAPPEFSRSHSLEKKPVMPKEMVPLGDSNSHSLKKDPVVPKEIVPIGDSNSHSLTKNPVVHKEMVSLGDSNSHSMKKDPVMPQKMVPLGDSNSHSLKKDPMMCQEMVPLGDSNSHSLKKDPVVAQGTAPLMYSRRHSQKKVPMMPKEMVPLGESHSHSLKKDLVVPKELVPLGDSKSHRMKKDPVMPQKMVPLGDSRSHSLKKDPVMPQNMIPLEDSNSHSLKKDPVMPQNMIPLEDSNSHSLKKDPMMHQEMVPLGDSNSHSLKKDPVVPQGTAPLMFSRRHSLKKVPVMPKEMVPLGDSHSLKKDPVMPQNMVPLEDSNSHSLKKDPVVPQGTAPLTFSRRHSLKKVPVVPQGTASLGFGRIHSLKKELVMPEEMVPLGDSNSHSMKKDLVMPKEMVPLGDSNSHSLKKDPVVHQEVVSLGDSNSHSLKKHPVIPQGTASLRFSKSHSQKEDQERPQATPLEDSKSHGVKNSPWKHQPQGQKVKEQKRKKASESQQQKPASCSSPVNWACPWCNAMNFPRNKVCSKCKRVRMPVENGSVDPA

SEQ ID NO: 921370 - protein, 145 aa, Homo sapiens
MFLSEKMDMSASFFRLSAPSDFSSCIFDTFVILERLLYSTTMNTWFSSAGLVLQLPAPLNTHLCPVENANGSAHSEWQLHSTVHTRNLAASVDEMISPPFSRGAMKLSNKQCILKSESSGYKKRKTLGNSHYSKTHQYSWQGKFK

SEQ ID NO: 921371 - protein, 137 aa, Homo sapiens
MAQTLPIPELDEILNITLMLECVKTFPAARRRPRHTRRIPSDNEGRDWGYAIASQGIPKIAGKPPETTKRQRRTPLQVSEKKQGSAHSCLRHLASKTVRQYISVVLSYPVCGTLSWQPWALPPLQAAFICGSPPYPS

SEQ ID NO: 921372 - protein, 2083 aa, Homo sapiens
PSADVEGRRWRRRRRKRQRQQRRRRRQRRLLRRRPRRRRRWRRRRRRMPASQARGRQARVSAHPARGRAPGCVTWSRCSRDARGAGPSTPLRVCVTCAITDNFAEGDFTMADYALLEDCPYVDDCVFAAEFMTDDYVRVTQLYCDGVGKQYKDYVQSERNLEFDICSIWCSKPISVLQDYCDAIKINIFWPLLFQHQNSSVISRLHPCVDANNSRASEINLKRLQHLELMEDIVDLAKKAANDSLLIGGLLRIGYKIENKILAMEEALNWIKYAGDVTILTKLGSIDNCWPMLSIFFTEYKYHITKIVMEDCNLLEELKTQSCMDCIEQGELMKMKGNEEFSKERFDIAIIYYTRAIEYRPENHLLYGNRALCFLRTGQFRNALGDGKRATILKNTWPKGHYRYCDALSMLGEYNWALQANITAQKLCKNDPEGIKDLIQQHVKLQKQIEDLQGRTANKNPIKAFYENRAYTPRSLSAPVFSTSLNFVEKERDFRKINHEMANGGNQNLKVMDEALMVDDCDCHPEFSPPSSQPPKHKGKQKSRNNESEKFSSSSQLTLPADLKNILEKQFSKSSRGAHQDFANIMTMLRSLIQDGYTALLEQRCRSAAHAFTELLNGLDPQKIKQLNLAMINYVLVVYGLAISLLGIGQPEELSEAENQFKRIIEHYHNEGLDCLAYCGIGKVYLKKNRFLEALNHFEKARTLIYRLPGVLTWPTSNVIIEESQPEKIKMLLEKFVEECKFPPVPDAICCYQKCCGYSKIQIYITDPDFKGFIRISCCQYCKIEFHMNCWKKLKTTTFNDKIDKDFLQGICLTPDCEGVISKIIIFSSGGQVKCEFEHKVIKEKVPPRPILKQKCSSLEKLRLKEDKKLKRKIQKKEAKKLAQERMEEDLRESNPPKNEEQKETVDNVQHCQFLDDRILQCIKQYADKIKSGIWNTATLLKELLSWKVLSTEDYTTCFSSRNFLNEAVDYVIRHLIQEKNRVKTRIFLHVLSELKEVEPKLAAWIRKLNSFGLDATGPFFSRYEASLKQLDFSIMTFLWNEKYGHKLDSIEGKQLDYFFEPTSSKEARCLIWLLEEHRDKFPALHSALDEFFDIMDSRCTVLRKQDSGEAPFSSTKVKNKGKKKKPKDSKPMLVGSGTTSVTPNNEIITSSEDHSNQNSDTAGPFAVPDHLRQDVEEFEALYDQHSNEYVVRNKKLWDMNPKQKCSTLYDYFSQLLEEHGPLDMSHKMFSEEYEFFPEETRPILEKAGGLKSFLLGCPRFVVIDNCIALKKVASRLKKKRKKKNIKTKVEDISKAGEYLQVKLPLNSAAREFKPDVKSKPVSGSSSAPASEDVKPKPLSANSPKPACEDVKAKPVSDNSSRQVSEDGKPKGFSSNSPKPGSEDANYKRVSSNSPKPVLEDVKPTYWAQSHLVTGYCTYLPFQRFDNTRTSPAYINVLPGLPQYTSIYTPLVSLSPEYQLPRSVPVVPSFVANDRADKNATAYFEGHHLNAENAAGHQIASETQILEDSSLISVKSQCSTGDAHTVLSESNRKDGHCGNSNNKCEVIPESTSAVTNIPQVQMVAIQVSWNITHQEVNTEPYNPFEKQQGEISRIEKEYQVLQDQLKEAYENYEQIKLKGLEETRDLEEKLKRHLEENKISKTELDWLLQDLEREIKKWQEEKKEIQKTLKSLKKKIKKVSNANEMYTQKNDGNDKEHELHLDQSLEISNTLTNEKMKIEECIKKGKKDYEESHQRAVAAEVSVLENWKESEVYKLQIMQSQAEAYLKKLELISHDPAAYPDMESDICSWELFLSNVTKETEKAKYQFEEQIKAIKNGSRLSELSKVQISELSFPACNTVHPELLPESSGHDDQGFMTSASDVTGNQAALHRDPSVFSAGDSPGEAPSALLPGPPPSQPEATQLPGPKGAGQAALSEQSPAADQKQPVPPGCAACSSQSPKKPFNSIIEHLSVVFPCYNSTELAGFIKKVRSKNKNSLSGLSIDEIVQRVTEHILDEQKKKKPNPGKDKRTYEPSSAAHVTRSSQGPPLAVVAPSPKTKGQKAEDVPVRVALGASSCEICHEVFKSKNVLCSSKYKRRIGISVE

SEQ ID NO: 921373 - protein, 140 aa, Homo sapiens
MAPIQKALSPRNVLSKSDTHSKKPEMGIIWAIEVARYRGLLGALLRGTLPGHSCVGDYLPAVQHRTVAVRWRKGGEWRLRKQQVGQEGAKPTGAEANNSQPPTLHGHTTEETEFRIQSYMQINLTIILSEKTSSTELCTK

SEQ ID NO: 921374 - protein, 143 aa, Homo sapiens
MLIYHSKNPGAFKNYAKSTLPVLYKWKDRTWMTAHLFTVWFTDYFKPTVETFCSETREIPFKILLLINNASSHPRALMEMYKDINVVFMPVNTSILLPMNQGKLPQPLQPSASTTLISQQPSTWRQDPTPAKKLPLDEASDDH

SEQ ID NO: 921375 - protein, 120 aa, Homo sapiens
SAAAEPSSAAERLCRHGYTMERPDKAALNALQPPEFRNESSLASTLKTLLFFTALMITVPIGLYFTTKSYIFEGALGMSNRDSYFYAAIVAVVAVHVVLALFVYVAWNEGSRQWREGKQD

SEQ ID NO: 921376 - protein, 143 aa, Homo sapiens; identical to SEQ ID NO: 921374

SEQ ID NO: 921377 - protein, 120 aa, Homo sapiens; identical to SEQ ID NO: 921375

SEQ ID NO: 921378 - protein, 129 aa, Homo sapiens
DVQLFPSLMRGLLPSWSPDPALPLSVPTTRDPGSKTPLIPQPPEFRNESSLASTLKTLLFFTALMITVPIGLYFTTKSYIFEGALGMSNRDSYFYAAIVAVVAVHVVLALFVYVAWNEGSRQWREGKQD

SEQ ID NO: 921379 - protein, 129 aa, Homo sapiens; identical to SEQ ID NO: 921378

SEQ ID NO: 921380 - protein, 120 aa, Homo sapiens; identical to SEQ ID NO: 921375

SEQ ID NO: 921381 - protein, 150 aa, Homo sapiens
MFICGNCLLFVELLTSPLTLKDSHIVFSGILGAVSRPLGQFSMAKVTSEPQKPNEDVDEQTPSTSSTKGRKKGKTPRQRRSRSGVKGLKTTRKAKRPLRGSSSQKAGETNTPAGKPKKARGPILRGRYHRLKEKMKKEEADKEQSETSVL

SEQ ID NO: 921382 - protein, 145 aa, Homo sapiens
GPDAAAPPLSGRGSMLPCARAKRPDLSLSPLSISLCLSSFPDAKAVGTLVTEAGGDEEKKIRSKPEQGAGAEEESHFCAGAADPTIKDNQKRGGGDQEPSQQQPEASSPGLLRGGATTPILAASLQPQCVQQVAPEGARQHFPTL

SEQ ID NO: 921383 - protein, 273 aa, Homo sapiens
SVWHMEILSKLRSTHASNDYVERPPAPCKQALSSPSLIVQTHKSDWSLATMPTSLPRSLSQCHQLQPLPQHLSQSSIASSMSHSTTASDQRLLASITPSPSGQSIIRTQPGAGVHPKADGALKGEAEQSAGHPSEHLFICEECGRCKCVPCTAARPLPSCWLCNQRCLCSAESLLDYGTCLCCVKGLFYHCSTDDEDNCADEPCSCGPSSCFVRWAAMSLISLFLPCLCCYLPTRGCLHLCQQGYDSLRRPGCRCKRHTNTVCRKISSGRTLS

SEQ ID NO: 921384 - protein, 210 aa, Homo sapiens [sequence omitted]

SEQ ID NO: 921385 - protein, 168 aa, Homo sapiens
MLKNFKKGFKGDYDVTMTPGKFRTLCEIDWPALEVGWPSEGRLDRSLVSKVWHKVTHKPGYPDQFPYIDTWLQLVLEPPHTQWLREQQHQRLAEAKKDQQRDRERKETERKGGKDREEKTERKRQRDKEGVKKRERERQRERKRQRQKESQRETESQREKEREKYTSS

SEQ ID NO: 921386 - protein, 145 aa, Homo sapiens
MWAVGASRWGRLPPARGAAAPNHKISNAGQRGLGHHTLQASCRPSRVVERPALIVAPGPVPRTGRQGLRTMALKLIHKEFLELARDPQPHCSAGPVWDDMLHWQATITRPNDSSYLGGVFFLKFPSDYLFKPPKIKFTNGIYHQR

SEQ ID NO: 921387 - protein, 151 aa, Homo sapiens
KIFHFLKDTMGTAAQTLLLDSWLSIQISQAVGRAIELPRDYDLGLCLPGCVEKDHPVGAGIGMAELSLSLGVACCDCCGGWGCGVWSNGVIFPGGLWLLLLNHTVCQQVGESQRSWASPCSHAACSPKGWCHSHCALQQHRVYFRATSDQG

SEQ ID NO: 921388 - protein, 138 aa, Homo sapiens
MTEGVAAFGNVQIRGAQVSALVHRGGRVYEEQQDGHLPPHSCLRSPLSRPSCPHCRVRPPEPSTLAEPGSKEQEEEGETGRDGTDGTAPGLLFLQPHLLSLQGNLKVIRPRSLERSPQTERRLCSLTTSVCSPTIGTM

SEQ ID NO: 921389 - protein, 137 aa, Homo sapiens
QVTWDGKCCQERAGASRRSLQPAAVAAAARSWASAQGAGCGRAGGVWWGAGGVGVCRPGSWEGFCLFGSPCGCCGAAGLRGCGAAGLRGCGAAGLRGCGAAGLRAVGDDGGGSRSGSRGGSGSGSGSAQSLGSPGYL

SEQ ID NO: 921390 - protein, 137 aa, Homo sapiens; identical to SEQ ID NO: 921389

SEQ ID NO: 921391 - protein, 180 aa, Homo sapiens
AAGSVTRTHNYNIKMPKTEETVLQNDPSVAENGAPEPKTPGQSQKSKSFCLDDQSPDLIETVNEVSKLSISHEIVVNQDFYVEETILPPNRLNIPNRKSTMLQNPKHFERQHDAQRKCSLRYTSMLQIFQNPRNPVEGRFAEAMYNAFWNHLKEQLLSTPPDFTCALELLKDVKENPGDE

SEQ ID NO: 921392 - protein, 135 aa, Homo sapiens
MEPCCRSTCKHSSPPYFSGGLQRFPYSGWEDLLQSPREFALAPRWAGTAGGPSAPSTAAGPGAKPLTARGWQRQPAAQTVGPPSPRPPRAHAGLQVLHAALVPARVSPSTPPRKLREPASASASPERGSHSAAVG

SEQ ID NO: 921393 - protein, 243 aa, Homo sapiens
EATSFYRMYKYNPGILVKHTQRLPTFRVLVGIPVQMAMRELNADSCSSPQMGAMWETSGSVKENSSQSKKYSTKIENLGPESACRHFWSFRYHEATGPLETISQLQKLCHQWLRPEIHSKEQILEMLVLEQFLSILPKETQNWVQKHHPQNVKQALVLVEFLQREPDGTKNEVTAHELGKEAVLLGGTAVAPGFKWKPAEPQPMGVFQKEYWNTYRVLQEQLGWNTHKETQPVYEREISLGCL

SEQ ID NO: 921394 - protein, 290 aa, Homo sapiens
EATSFYRMYKYNPGILVKHTQRLPTFRVLVGIPVQMAMRELNADSCSSPQMGAMWETSGSVKENSSQSKKYSTKIENLGPESACRHFWSFRYHEATGPLETISQLQKLCHQWLRPEIHSKEQILEMLVLEQFLSILPKETQNWVQKHHPQNVKQALVLVEFLQREPDGTKNEVTAHELGKEAVLLGGTAVAPGFKWKPAEPQPMGVFQKEYWNTYRVLQEQLGWNTHKETQPVYERAVHDQQMLALSEQKRIKHWKMASKLILPESLVSCYFWLFSGDLTVALPLLVPIA

SEQ ID NO: 921395 - protein, 243 aa, Homo sapiens; identical to SEQ ID NO: 921393

SEQ ID NO: 921396 - protein, 303 aa, Homo sapiens
MLALSEQKRIKHWKMASKLILPESLSLLTFEDVAVYFSEEEWQLLNPLEKTLYNDVMQDIYETVISLGLKLKNDTGNDHPISVSTSEIQTSGCEVSKKTRMKIAQKTMGRENPGDTHSVQKWHRAFPRKKRKKPATCKQELPKLMDLHGKGPTGEKPFKCQECGKSFRVSSDLIKHHRIHTGEKPYKCQQCDRRFRWSSDLNKHFMTHQGIKPYRCSWCGKSFSHNTNLHTHQRIHTGEKPFKCDECGKRFIQNSHLIKHQRTHTGEQPYTCSLCKRNFSRRSSLLRHQKLHRRREACLVSPN

SEQ ID NO: 921397 - protein, 243 aa, Homo sapiens; identical to SEQ ID NO: 921393

SEQ ID NO: 921398 - protein, 131 aa, Homo sapiens
IEFLEFTMIKKEEKGSGEKPIVPSGYDHYPILSVSLITNPVPRMVPGTELLQECTIMAGFSFSLCNSSCIFEGQLSSGDPWHFPPWWDVMPDSSEFIELNKRRQQMAEILIRCGWLMHDLKTPALVILGQI

SEQ ID NO: 921399 - protein, 131 aa, Homo sapiens; identical to SEQ ID NO: 921398

SEQ ID NO: 921400 - protein, 407 aa, Homo sapiens
MGCGQSMVSFPQLAARTLPEIATTLALSQVLILAPAMALALALATGTCIGAGADACFSHGIGPGTGTGTNTGTCHVTNGSCHLGHGVSPPLLSMPHLLPRKGTGGFLGSTKELSEAPEQGLHASEEVLPGLRGALGVPAAGAPVGVSWARRRGAGHRASETRRPWVSPLPRTFSPAALAGPGSRNSGKRCASTGIRRPERCVPGREDSDVAAAAAAAAKKTRSPRVLSRRPPPSDREEEEKEEEEEEEEEEEEQEEEEEEEEEEEEEEEEEEEEEEEAGGEGAKPPPPGSSRSCGNGRAPPRSASSGRKQYRRLQPEGCGGAAPRGGAAHVRLERDHKPKSQAQCKRLITVTCCCDESDHSGLSSYPSFSPVEKAPKSVGISVQRLPLQLPLQIIYLKLLCSVPGLE

SEQ ID NO: 921401 - protein, 138 aa, Homo sapiens
MVLAASDQGLEPAPDHKPPHYKCKQTHSFSASKGACSHDPVSLKVCGFSQLSWYVPAAVLGEKIHSVILHTLLCPSKWELQASPAASYLSKEARRERVYENLDWKATRRMQPYLTLHNLVKGHSLSAVNNRQRKSRRI

SEQ ID NO: 921402 - protein, 435 aa, Homo sapiens
ILRYPSGFLAFLSSMIAPSPKSSEEEGQKDEEVLQGEQGDFNDNDTEPENLGHRPLLMDSEDEEEEEKRSSDSDYEQAKAKYSDMSPVYRDKSGSGPTQDINTILLTSAQLSSDVGVETPKQEFDIFGAVPFFAVCAQQPQQEKNEKSLPQHRFPATGLQQEEFDVFTKAPFSKKVNVQECHAVGPETHPKSIDIFDFTPFQPFLTSTSKSESNEDLFGLVPFEEIMGSQQQKVKQRSLQKLSSRQRRTKQDMSKSNGKRHHGTPTSKKKTLKPTYRTPERARRHKKVGRRVSQTSNEFVTISDSKENIGAAVTDGNDRGNVLQLEESLLDPFGAKPFHPPDLSWHPLHQGLNDIRADHNTVLPKQPRQNSLHGSFHSADVLTMDDFGAMPFTELVVQSITLQQSQQSQPVELDPFESWSKCRSLHTADAQVIAL

SEQ ID NO: 921403 - protein, 258 aa, Homo sapiens
MACSLPSGAGNNSEPPSPTMVLYQGYLNLLLWDLENVEFPETLLMDRIRLQELAFQLHQLTVLASVLLVARSFSGEVLFRSPEFVDRLKCTTKALTEEFISRPEETMLSVSEQVSQEVHQGLKDMGLTTLSSENTASLLGQLQNITKKENCIRSIVGKNLHGRRAEKWQECGAWVGRPYPEYQWIRFFLKCCLLHGMQESLLHFPGGLILIEKELAELGWKFLNLMHHNQQVFGPYYAEILKHIIHPAQAQETDVEPN

SEQ ID NO: 921404 - protein, 137 aa, Homo sapiens [sequence omitted]

SEQ ID NO: 921405 - protein, 111 aa, Homo sapiens
MIWRGRSTYRPRPRRSVPPPELIGPMLEPGDEEPQQEEPPTESRDPAPGQEREEDQGAAETQVPDLEADLQELSQSKTGGECGNGPDDQGKILPKSEQFKMPEGGDRQPQV

SEQ ID NO: 921406 - protein, 140 aa, Homo sapiens
GYSIMARMAVLWRKMRDNFQSKEFREYVSSTHFWGPAFSWGLPLAAFKDMKASPEIISGRMTTALILYSAIFMRFAYRVQPRNLLLMACHCTNVMAQSVQASRYLLYYYGGGGAEAKARDPPATAAAATSPGSQPPKQAS

SEQ ID NO: 921407 - protein, 592 aa, Homo sapiens
MGLVTFEDVAVDFTQEEWQYLNPPQRTLYRDVMLETYSNLVFVGQQVTKPNLILKLEVEECPAEGKIPFWNFPEVCQVDEQIERQHQDDQDKCLLMQVGFSDKKTIITKSARDCHEFGNILHLSTNLVASIQRPDKHESFGNNMVDNLDLFSRSSAENKYDNGCAKLFFHTEYEKTNPGMKPYGYKECGKGLRRKKGLSLHQRIKNGEKPFECTACRKTFSKKSHLIVHWRTHTGEKPFGCTECGKAFSQKSQLIIHLRTHTGERPFECPECGKAFREKSTVIIHYRTHTGEKPYECNECGKAFTQKSNLIVHQKTHTGEKTYECTKCGESFIQKLDLIIHHSTHTGKKPHECNECKKTFSDKSTLIIHQRTHTGEKPHKCTECGKSFNEKSTLIVHQRTHTGEKPYECDVCGKTFTQKSNLGVHQRTHSGEKPFECNECEKAFSQKSYLMLHQRGHTGEKPYECNECEKAFSQKSYLIIHQRTHTEEKPYKCNECGKAFREKERTRERNPMHALSVAKPSEKSQHSLYIKELILERNPINVQNVGKPLPKNQTLLYISEPMQERKPMEEATLGSQSSWHIRELISSIYYGH

SEQ ID NO: 921408 - protein, 161 aa, Homo sapiens
ALKMTKWETEAPVVAETPDIKFFGKWSTDDAQISDISLQDYIAVKEKYTKYLPHSIGLQEPSAGSGECQHQMWPWEDSTYIEQAETVRQQDVDMSPLYHVNQAIWLLYTGQALIHYDCCPYKRRKFEHRHTQRGDHEDTGRRQLSPSQGKRPQKKPILPTP

SEQ ID NO: 921409 - protein, 158 aa, Homo sapiens
MKFGCLSFRQPYAGFVLNGIKTVETRWRPLLSSQRNCTIAVHIAHRDWEGDACRELLVERLGMTPAQIQALLRKGEKFGRGVIAGLVDIGETLQCPEDLTPDEVVELENQAALTNLKQKYLTVISNPRWLLEPIPRKGGKDVFQVDIPEHLIPLGHEV

SEQ ID NO: 921410 - protein, 158 aa, Homo sapiens; identical to SEQ ID NO: 921409

SEQ ID NO: 921411 - protein, 158 aa, Homo sapiens; identical to SEQ ID NO: 921409

SEQ ID NO: 921412 - protein, 158 aa, Homo sapiens; identical to SEQ ID NO: 921409

SEQ ID NO: 921413 - protein, 158 aa, Homo sapiens; identical to SEQ ID NO: 921409

SEQ ID NO: 921414 - protein, 183 aa, Homo sapiens
MSLKGWRVMRFCASAGYGRPGALAKMKFGCLSFRQPYAGFVLNGIKTVETRWRPLLSSQRNCTIAVHIAHRDWEGDACRELLVERLGMTPAQIQALLRKGEKFGRGVIAGLVDIGETLQCPEDLTPDEVVELENQAALTNLKQKYLTVISNPRWLLEPIPRKGGKDVFQVDIPEHLIPLGHEV

SEQ ID NO: 921415 - protein, 158 aa, Homo sapiens; identical to SEQ ID NO: 921409

SEQ ID NO: 921416 - protein, 158 aa, Homo sapiens; identical to SEQ ID NO: 921409

SEQ ID NO: 921417 - protein, 106 aa, Homo sapiens
MITASPSSFQLTDLNVSSSTIVQSFLGKESLKRLWLSSTLTTRWFRSSGGELSWEPGSWLMAWSSCLSKTSLESGFGSGEEPDGPPLVGSPPTDGASLASYSCSVF

SEQ ID NO: 921418 - protein, 158 aa, Homo sapiens; identical to SEQ ID NO: 921409

SEQ ID NO: 921419 - protein, 158 aa, Homo sapiens; identical to SEQ ID NO: 921409

SEQ ID NO: 921420 - protein, 158 aa, Homo sapiens; identical to SEQ ID NO: 921409

SEQ ID NO: 921421 - protein, 146 aa, Homo sapiens
MKFGCLSFRQPYAGFVLNGIKTVETRWRPLLSSQRNCTIAVHIAHRDWEGDACRELLVERLGMTPAQIQALLRKGEKFGRGVIAGLVDIGETLQCPEDLTPDEVVELENQAALTNLKQKYLTVISNPRWLLEPIPRKGGKDVFQNP

SEQ ID NO: 921422 - protein, 158 aa, Homo sapiens; identical to SEQ ID NO: 921409

SEQ ID NO: 921423 - protein, 106 aa, Homo sapiens; identical to SEQ ID NO: 921417

SEQ ID NO: 921424 - protein, 159 aa, Homo sapiens
MKAWGTVVVTLATLMVVTVDAKIYERCELAARLERAGLNGYKGYGVGDWLCMAHYESGFDTAFVDHNPDGSSEYGIFQLNSAWWCDNGITPTKNLCHMDCHDLLNRHILDDIRCAKQIVSSQNGLSAWTSWRLHCSGHDLSEWLKGCDMHVKIDPKIHP

SEQ ID NO: 921425 - protein, 224 aa, Homo sapiens
MSENVSDGLFKESAKTHQNQNGNESDICQAPLLQVCCSFLEVRSRPYLPGYHQQRLQNSKDCCLLLPLEALSQRGSGLMPARALLDPLEEAVCPLAELERCTGKTFSGCTALFRASRQEHLSPLKLCPQPPLPPGALSQGDESFIYKTLTEAVDFLSQMPCPVRKNLERQSGHSCFAALCHVVNAPLSAHAAQICYCRFLLLRMSVTHAPCCLPSVHAELCEKR

SEQ ID NO: 921426 - protein, 169 aa, Homo sapiens
SLSLQPPSPDSHRAPTSPPSDLSPVLTPSLGFSSAMASAGISSAAVSQKRYQVRTKRAHKQHQELQKKEAAAMDQGRGCAHVVRSLPPPCVREHEPPEPPILRHTRHQQHPLEGCRSSAGPLAVPEKKWEVIGHRQCLVLGRRLSPGEGTIEAFNNLLFPLNRFVNVKQ

SEQ ID NO: 921427 - protein, 113 aa, Homo sapiens
GNMSEHVRTRSQSSERGNDQESSQPVGSVIVQEPTEEKRQEEEPPTDNQGIAPSGEIENEGAPAVQGPDMEAFQQELALLKIEDEPGDGPDVREGIMPTFDLTKVLEAGDAQP

SEQ ID NO: 921428 - protein, 113 aa, Homo sapiens; identical to SEQ ID NO: 921427

SEQ ID NO: 921429 - protein, 245 aa, Homo sapiens
MIDGLWIPGTVLRAVPASAQPWGQGVHFQIRPAPEALGKSLGAKKCPGGAPFASTTSVFYPLDASPKEEKCQDEAGPSKEVSVLVQGRGDSPSFYAFSLLAPIVARCLHSLVLPTRSMGPVLASHCSSRETVECCALALEYKALSHKATLMIPGQKGSSVFKPGGGIFPRGLPGFCSCVCWSPGSHGELGSRDRVSICRQAWSQTPRLKCSSDPPTSTSQSAGITGKIVIEHQTSPLLKKTFYKN

SEQ ID NO: 921430 - protein, 196 aa, Homo sapiens
MIDGLWIPGTVLRAVPASAQPWGQGVHFQIRPAPEALGKSLGAKKCPGGAPFASTTSVFYPLDASPKEEKCQDEAGPSKEVSVLVQGRGDSPSFYAFSLLAPIVARCLHSLVLPTRSMGPVLASHCSSRETVECCALALEYKALSHKATLMIPGQKGSSVFKPGGGIFPRGLPGFCSCVCWSPGSHGELGSRENSN

SEQ ID NO: 921431 - protein, 227 aa, Homo sapiens
QFLLYKFKMKQRILKEDMLKIVNPRYQNQFAEIHRRASEHIEVVFAVDLKEVNPTCHLYDLVSKLKLPNNGRIHVGKVLPKTGLLMTFLVVIFLKGNCANKEDTWKFLDMMQIYDGKKYYIYGEPRKLITQDFVRLTYLEYHQVPCSYPAHYQFLWGPRAYTETSKMKVLEYLAKVNDIAPGAFSSQYEEALQDEEESPSQRCSRNWHYCSGQDCLRAKFSSFSQPY

SEQ ID NO: 921432 - protein, 402 aa, Homo sapiens
MASIIARVGNSRRLNAPLPPWAHSMLRSLGRSLGPIMASMADRNMKLFSGRVVPAQGEETFENWLTQVNGVLPDWNMSEEEKLKRLMKTLRGPAREVMRVLQATNPNLSVADFLRAMKLVFGESESSVTAHGKFFNTLQAQGEKASLYVIRLEVQLQNAIQAGIIAEKDANRTRLQQLLLGGELSRDLRLRLKDFLRMYANEQERLPNFLELIRMVREEEDWDDAFIKRKRPKRSESMVERAVSPVAFQGSPPIVIGSADCNVIEIDDTLDDSDEDVILVESQDPPLPSWGAPPLRDRARPQDEVLVIDSPHNSRAQFPSTSGGSGYKNNGPGEMRRARKRKHTIRCSYCGEEGHSKETCDNESDKAQVFENLIITLQELTHTEMERSRVAPGEYNDFSEPL

SEQ ID NO: 921433 - protein, 402 aa, Homo sapiens; identical to SEQ ID NO: 921432

SEQ ID NO: 921434 - protein, 212 aa, Homo sapiens
LPHETLGTAQNSLPASPVFLTPKCRQSSCFWLARMAFRTLARILLVTPWPKPGTATVLWERRPGGQALNNWHEGVRPKEGPEPTQQARGRTAAFGSSPASTGIQVLALPVYQACGGQGNESLLPGRLATICFMDTKTEGNILFREEDSTSLSSAVVGPTSELIAARAVLHCPVSGPEEETDRETSLTWKVPGKGHIMEYHTAVKKNMATCNM

SEQ ID NO: 921435 - protein, 564 aa, Homo sapiens
PFDRRPETQGLLGGNPSFYRKSQTMPALRNRSGVMQARLQHLSSLESSFTLNHSSTTTEADIFHQALLEGNTATEVSLTVLDTISFFTQCFKTQLLNNDGHNPLMKKVFDIHLAFLKNGQSEVSLKHVFASLRAFISKFPSAFFKGRVNMCAAFCYEVLKCCTSKISSTRNEASALLYLLMRNNFEYTKRKTFLRTHLQEVLLELLEQCVDGLWKAERYEIISEISKLIVPIYEKRQRKIISVVFTKPSLQKAVKFPCYPGKRHRHDSILYNLAENLKVLANDSGVDVNEMKHDIKKYIVIEEQKTTYRVFSLKWELNNENPWTQRGEQLTQGLLWEEDGKEYIYKEPKLTGLSEISLRLVKLYGEKFGTENVKIIQDSDKVNAKELDPKYAHIQVTYVKPYFDDKELTERKTEFERNHNISRFVFEAPYTLSGKKQGCIEEQCKRRTILTTSNSFPYVKKRIPINCEQQINLKPIDVATDEIKDKTAELQKLCSSTDVDMIQLQLKLQGCVSVQVNAGPLAYARAFLNDSQASKYPPKKVSELKDMFRPYNYNVIATTTYEAV

SEQ ID NO: 921436 - protein, 147 aa, Homo sapiens
DEEMQKGFKTACDRLLPPLATSPNTRPRRPTTPPPTSIQANHKSYPVGSIQMSHNSFLSATRPWECSIPCLAVTDSPSRAPPSPGGASPTPLRAGKSRALSLPALHWWAAYAPASTALFRLPVPIALQGNRIAGASWAAKRPRGCPA

SEQ ID NO: 921437 - protein, 147 aa, Homo sapiens; identical to SEQ ID NO: 921436

SEQ ID NO: 921438 - protein, 161 aa, Homo sapiens
TCVGRVTTQMLTRTQRHVHQLPAHSCLACSEDHPCCSGRQGLLTNVRLSFLHLRAFHGSLLPTALNPKKSYSLDFEGSPPGAPPSPQSSSSFCLCSLLWPVAILNVTHTTLLPTLQLFTQLPSSSSQRQAPIPASFLYMGAGPTAPLSSHLETKTDAIVLP

SEQ ID NO: 921439 - protein, 194 aa, Homo sapiens
VGGPVLAMPLHIFFPEHMSLCLNFPFCRLGFGAILDLVKSTFRPFEDTSGILGCVIILVKLTGTIPLLYRKQNKQEKVKTQKYQLLVFCCCLWAIVASAAFRSFVLRPLSEVVSEEGLTISEATASGWRALHSTHSSTPVLRPLQFQKSSVVLRILSKSYSSSVYSLFLPPGAHFLLRKLQILVQHGAPGFPKT

SEQ ID NO: 921440 - protein, 169 aa, Homo sapiens
MVRDCVYIASRRPNTPYFICSIQDFKLFTEAVREKDEQKEISFVSLTVPEVSGVWWKGILAPAESMLGCCKEQELAINSEFGCWQLKWGEKGMSHLADHCLRRLTVAVCSVEGGKMVKAPSRRLGLPFVGMFVEDMSQKETTRFTSIQDEAHVQCSSLISQAHPLFQSK

SEQ ID NO: 921441 - protein, 206 aa, Homo sapiens
MEKLYKENEGKPENERNLESEGKPEDEGSTEDEGKSDEEEKPDMEGKTECEGKREDEGEPGDEGQLEDEGNQEKQGKSEGEDKPQSEGKPASQAKPESQPRAAEKRPAEDYVPRKAKRKTDRGTDDSPKDSQEDLQERHLSSEEMMRECGDVSRAQEELRKKQKMGGFHWMQRDVQDPFAPRGQRGVRGVRGGGRGQKDLEDVPYV

SEQ ID NO: 921442 - protein, 528 aa, Homo sapiens
MTSKQAMSSNEQERLLCYNGEVLVFQLSKGNFADKEPTKTPILHVRRMVFDRGTKVFVQKSTGFFTIKEENSHLKIMCCNCVSDFRTGINLPYIVIEKNKKNNVFEYFLLILHSTNKFEMRLSFKLGYEMKDGLRVLNGPLILWRHVKAFFFISSQTGKVVSVSGNFSSIQWAGEIENLGMVLLGLKECCLSEEECTQEPSKSDYAIWNTKFCVYSLESQEVLSDIYIIPPAYSSVVTYVHICATEIIKNQLRISLIALTRKNQLISFQNGTPKNVCQLPFGDPCAVQLMDSGGGNLFFVVSFISNNACAVWKESFQKECLVPLCGEEENSVHILDEKLSDNFQDSEQLVEKIWYRVIDDSLVVGVKTTSSLKLSLNDVTLSLLMDQAHDSRFRLLKCQNRVIKLSTNPFPAPYLMPCEIGLEAKRVTLTPDSKKEESFVCEHPSKKECVQIITAVTSLSPLLTFSKFCCTVLLQIMERESGNCPKDRYVVCGRVFLSLEDLSTGKYLLTFPKKKPIGNFVGTFRLYI

SEQ ID NO: 921443 - protein, 221 aa, Homo sapiens
KDDNTSSAEEKECLVPLCGEEENSVHILDEKLSDNFQDSEQLVEKIWYRVIDDSLVVGVKTTSSLKLSLNDVTLSLLMDQAHDSRFRLLKCQNRVIKLSTNPFPAPYLMPCEIGLEAKRVTLTPDSKKEESFVCEHPSKKECVQIITAVTSLSPLLTFSKFCCTVLLQIMERESGNCPKDRYVVCGRVFLSLEDLSTGKYLLTFPKKKPIGNFVGTFRLYI

SEQ ID NO: 921444 - protein, 248 aa, Homo sapiens
MRMAALVAGTGVSVRAGRDRDPRAGASQPPPREVSPALSPVPGAPAPVAPGAQPQMSSHNSRLAADSYKNCRQSRTARSCASDHLAGAQQRLPIRRTRILTLCGDPHRPWRGSFDRGPESAEWPALGLSAAPGRGGISSVWPGEPRLPSPCPQPGISGNPEGRSPRPGRVSEPGVRAAGFVGPPPPPSPAHAPARALSAFLWLSRGRGACGGGGGGGPGGGECWNAPPGHLQRPWSRTGSRRAAEAQG

SEQ ID NO: 921445 - protein, 163 aa, Homo sapiens
MSEPCGLLCWLTPKRELAECRYSLPGSSTLVLKNRSGFVRMALQHGVPLIPAYAFGETDLYDQHIFTPGGFVNRFQKWFQSMVHIYPCAFYGRGFTKNSWGLLPYSRPVTTIVGEPLPMPKIENPSQEIVAKYHTLYIDALRKLFDQHKTKFGISETQELEII

SEQ ID NO: 921446 - protein, 259 aa, Homo sapiens
SSSFSSPVPHPCLLWHLMPPNSESFLDPPVQIGSHLVGIPLAATTVIAVNLYLVVFTPYWPVTVLILTWLAFDWKTPQRGQETAGGESTLGQAHSGNGQSLAALPLFSGGRRFTCVRHWRLWKHYSDYFPLKLLKTHDICPSRNYILVCHPHGLFAHGWFGHFATEASGFSKIFPGITPYILTLGAFFWMPFLREYVMSTGACSVSRSSIDFLLTHKGTGNMVIVVIGGLAECRYSLPGSSTLVLKNRSGFVRMALQHG

SEQ ID NO: 921447 - protein, 433 aa, Homo sapiens
SSSFSSPVPHPCLLWHLMPPNSESFLDPPVQIGSHLVGIPLAATTVIAVNLYLVVFTPYWPVTVLILTWLAFDWKTPQRGQETAGGESTLGQAHSGNGQSLAALPLFSGGRRFTCVRHWRLWKHYSDYFPLKLLKTHDICPSRNYILVCHPHGLFAHGWFGHFATEASGFSKIFPGITPYILTLGAFFWMPFLREYVMSTGACSVSRSSIDFLLTHKGTGNMVIVVIGGLAECRYSLPGSSTLVLKNRSGFVRMALQHGQPGVGHGAPTLNLDLGTAGLGSEKPEADPGIMRRQRVWHSTRSLPFWASEDMLLLCRVPLIPAYAFGETDLYDQHIFTPGGFVNRFQKWFQSMVHIYPCAFYGRGFTKNSWGLLPYSRPVTTIVGEPLPMPKIENPSQEIVAKYHTLYIDALRKLFDQHKTKFGISETQELEII

SEQ ID NO: 921448 - protein, 376 aa, Homo sapiens
SSSFSSPVPHPCLLWHLMPPNSESFLDPPVQIGSHLVGIPLAATTVIAVNLYLVVFTPYWPVTVLILTWLAFDWKTPQRGQETAGGESTLGQAHSGNGQSLAALPLFSGGRRFTCVRHWRLWKHYSDYFPLKLLKTHDICPSRNYILVCHPHGLFAHGWFGHFATEASGFSKIFPGITPYILTLGAFFWMPFLREYVMSTGACSVSRSSIDFLLTHKGTGNMVIVVIGGLAECRYSLPGSSTLVLKNRSGFVRMALQHGVPLIPAYAFGETDLYDQHIFTPGGFVNRFQKWFQSMVHIYPCAFYGRGFTKNSWGLLPYSRPVTTIVGEPLPMPKIENPSQEIVAKYHTLYIDALRKLFDQHKTKFGISETQELEII

SEQ ID NO: 921449 - protein, 277 aa, Homo sapiens
MSAPGSPDQAYDFLLKFLLVGDRDVGKSEILESLQDGAAESPYSHLGGIDYKTTTILLDGQRVKLKLWDTSGQGRFCTIFRSYSRGAQGVILVYDIANRWSFEGMDRWIKKIEEHAPGVPKILVGNRLHLAFKRQVPREQAQAYAERLGVTFFEVSPLCNFNIIESFTELARIVLLRHRMNWLGRPSKVLSLQDLCCRTIVSCTPVHLVDKLPLPSTLRSHLKSFSMAKGLNARMMRGLSYSLTTSSTHKSSLCKVEIVCPPQSPPKNCTRNSCKIS

SEQ ID NO: 921450 - protein, 309 aa, Homo sapiens
MFYANFSRRTGPAPPLRTTPRAWLRRECGASTMSAPGSPDQAYDFLLKFLLVGDRDVGKSEILESLQDGAAESPYSHLGGIDYKTTTILLDGQRVKLKLWDTSGQGRFCTIFRSYSRGAQGVILVYDIANRWSFEGMDRWIKKIEEHAPGVPKILVGNRLHLAFKRQVPREQAQAYAERLGVTFFEVSPLCNFNIIESFTELARIVLLRHRMNWLGRPSKVLSLQDLCCRTIVSCTPVHLVDKLPLPSTLRSHLKSFSMAKGLNARMMRGLSYSLTTSSTHKSSLCKVEIVCPPQSPPKNCTRNSCKIS

SEQ ID NO: 921451 - protein, 136 aa, Homo sapiens
MFYANFSRRTGPAPPLRTTPRAWLRRECGASTMSAPGSPDQAYDFLLKFLLVGDRDVGKSEILESLQDGAAESPYSHLGGIDYKTTTILLDGQMMRGLSYSLTTSSTHKSSLCKVEIVCPPQSPPKNCTRNSCKIS

SEQ ID NO: 921452 - protein, 277 aa, Homo sapiens; identical to SEQ ID NO: 921449

SEQ ID NO: 921453 - protein, 579 aa, Homo sapiens
PSHQASPAMEEGKTGKCLSRAKTSPRAQLSCSKAGGVESCFLSCPAHTLFVPDSENSYVLSCGVPGPQGKALQKRNGTSSGLGPSCSGKTFLLSALLRVAWGAGDEPGPGPRSQQAAGRVLAQDAPTTPIKQKARFKIRDAKCHLRPHSQARAKETARQPLLDHCHVTFVTLKCDSSKKRRRGRKSPSKEVSHITAEFEIETKMEEASDTCEADCLRKRAEQSLQAAIKTLRKSIGRQQFYVQVSGTEYEVAQRPAKALEGQGACGAGQVLQDSKCGQCSPGFFSADGFKPCQACPVGTYQPEPGRTGCFPCGGGLLTKHEGTTSFQDCEAKDLEGMRGPGDSTPVLPFPCTPPHPPPALCPPAVHCSPGHHYNTTTHRCIRCPVGTYQPEFGQNHCITCPGNTSTDFDGSTNVTHCKNQHCGGELGDYTGYIESPNYPGDYPANAECVWHIAPPPKRRILIVVPEIFLPIEDECGDVLVMRKSASPTSITTYETCQTYERPIAFTSRSRKLWIQFKSNEGNSGKGFQVPYVTYDEDYQQLIEDIVRDGRLYASENHQEILKDKKLIKALFDVLAHPQN

SEQ ID NO: 921454 - protein, 153 aa, Homo sapiens
MSKDLKILCKDPALELSCYRDHQFSGRKFQQEKLLKESSTLNMGNLSFYTTEEKIHELFSRSDIRNIFMGLDKIKKTACGFCFVECHNRADAENAMRFLTGTCLDEWIICTDWDVGFREGQQYGRGKSGGQVRDEFREDFHSGRGGFGRQTQI

SEQ ID NO: 921455 - protein, 490 aa, Homo sapiens
MDPSLKMERICFIYSLYTYLKAILHGISIILCIKQSLCEVLMCRILHLWHHVNAQKALGFGAFQILDFRMRNAQPIPNPVPGPVLGTRDTEKNEAHVSPTGYPRGKDYYIPISQPRKQTSCAAGERRLCPHTQGLPVTAVEGQKRSQEGMNCMNKDHGCAHICRETPKGGVACDCRPGFDLAQNQKDCTLTCNYGNGGCQHSCEDTDTGPTCGCHQKYALHSDGRTCIEKDEAAIERSQFNATSVADVDKRVKRRLLMETCAVNNGGCDRTCKDTATGVRCSCPVGFTLQPDGKTCKDINECLVNNGGCDHFCRNTVGSFECGCRKGYKLLTDERTCQDIDECSFERTCDHICINSPGSFQCLCHRGYILYGTTHCGAASLPSALTPAVLPDVDECSMSNGSCDQGCVNTKGSYECVCPPGRRLHWNGKDCVGMLAALGAPRLSSGRAPAFPGSLYMGPCLGAGAVGLPSWNLHAGSLPRHTLTSPGQPK

SEQ ID NO: 921456 - protein, 144 aa, Homo sapiens
MRRDPGLLLLCHTDSSDLQVDMQHLGSSQVLIRDALGMSHLFLTDFVYDAVCGGQKSLSAILSCPDTFCKILVSISEFSSEGPLLFLINSASSKGRGGTIFGICLYKVMEITPSFDLSLQECRNVMAEKRDVNRLYDVGHRVPP

SEQ ID NO: 921457 - protein, 160 aa, Homo sapiens
SLSFLKSMPDEHLWQASGQCLHLQSQGAHYLLQQLLPCRPALLPLNVHWPHGFPSLGMLKTLQKSRHHQAGKFSLCLVPSQGRQRASFQKLYTGSVEAELDIDECENDYYNGGCVHECINIPGNYRCTCFDGFMLAHDGHNCLETGSCYIAQASGTPGLR

SEQ ID NO: 921458 - protein, 187 aa, Homo sapiens
SLSFLKSMPDEHLWQASGQCLHLQSQGAHYLLQQLLPCRPALLPLNVHWPHGFPSLGMLKTLQKSRHHQAGKFSLCLVPSQGRQRASFQKLYTGSVEAELDIDECENDYYNGGCVHECINIPGNYRCTCFDGFMLAHDGHNCLGMLHKSGTTGSNDHLVFYGFLKGLSKASVVPAGLWVCGRGYWVS

SEQ ID NO: 921459 - protein, 1099 aa, Homo sapiens
MDIDHNCIYLSGLGLFMLYFFYVVLMLCLSTLGKNNDIQKHQGRARRRKKGGTYKDRKSFQREAEEERKLLSILKSFGPPASCSPLGQHHDTTRFHRLLCPDPVCQVCNRATADIQRLLSWESLKDAVPFVSPLASSASATESSFTLASTPSATTPEDLILSPQPKPSLLPHLILSPDLITTLADLFSPSPLRDPLPPQPVSPLDSKFPIDHSLPQQLPSPLFPPHHIQRAEPSLQPEASLSLNTVFLFDSTLSQDMNPLSNISQAMNATDSCAWHHEPPNPSALPLEDCPVTQSKASPTVLKPFPEMLSLGTNAVLVRKSFKVHVPISIIPGDFPLSSEVRKKLEQHIRKRLIQRRWGLPRRIHESLSLLRPQSKISELSVSDSIHGPLNISLVEGQRCNVLKKSASSFPRSFHERSSNMLSMENVGNYQGYSQETAPKDHLLHDPETSSDEDLRSNSERDLETHMMHLSGNDSGVRLGQKQLENALTVRLSKKFEKINEGRMPGTVHSSWHSVKQTMSLPEKSQSQIKHQNLVALVSEDHCVDTSQEISFLSSNKQKMLEAHIKTFRMRMLWGLPCKVLESIEIFKSEEDISNSFSHFYLPSSASFISQGDSKDGVSKSCRRSTFQGEKLGTTSSVPVLNHPQPVSSPIGKEGQGTLRRQFSDIDHDLIETDAKDGASTPLRRGTTYFQGEKLETTSSFSILGHPHLVTSPVDQEKQGTLRREFADTDEDLTESVWTTEDGRQTFLPPTYSIIDEVSQKQTILASRCSAELPILQAGVGRDSRDKRESASNNVNRLQGSGKTFPVTNGSKEMFKEEEICTLQSQTRNNLTTSKSGSCLVTNVKRSTSHETEIFPPRISVPQTPKSSYLKNQMLSQLKLVQRKHSQPQSHFTGMSLALDNLSSKDLLTHAQGISNQDLGTSQVLHVHLEVRGIRVAQQQEHRVPTHVLQKCQVKNFSPAAKRVSPLRPNGGELGGGDAGLGTSQLTRKSLPVHNKASGEVPGSKSSPTLKTQPPSENLFRKWMQTLLQWFNKPSIMCEEQESSWEKGSSLSSSVQNRSRVTSRAAFTGATEAQKIRKDTGEFLEEKLGHSHGIDITCP

SEQ ID NO: 921460 - protein, 188 aa, Homo sapiens
MMKTFWNEIVVMLPLGGRAVYTKSHTAPACACGEVRERVCTHGGGSLDAESGELSSPPPPHPPAAGSPRQSPAKALQKVPSVEDWEADPAPVPPKAPALPWCGWRGPRTLHAVSPASKFTAKYTTSEELGSACCAAAICRDGMLLPLVCSRPPREEGDRLPWRPAHHGEKATDLKTPEGGYAGQMDKC

SEQ ID NO: 921461 - protein, 138 aa, Homo sapiens
MIISLTLRGWGDVLGRDRARGSSRLRGALHWWTGDLVETTPRAGQGDEPPPWPLRRPQQPLPQAEGLTLGSALTARAASATCCSAQSGVCSSPGLDMTVLMQTEACQSMDGCGVGWQAQSPGADEGASLSCTEQLLAP

SEQ ID NO: 921462 - protein, 292 aa, Homo sapiens
MAPKSKNFLNFIASFLQRFLGFACEAVSPRPRASERASQRGRQGGRKGWGGGETDRASDTRTATDSDRSGARDLGDGEVAGREVLGTELQGRRAESRGRSVEGALAAAEARRAAWRRRSGAERGASTERSLGGERRSRRRGSRSRPRKSRLGGRGHALWRSPPPGGPARLRGPGAEGGRGGEELRIARARGEKTEDGKRQSQGHEVAQRAPRGSWDGHHPTLTGPLAVSFELPGRRKVAERSFLLGAYREYLRWFGKGNRGSQTAWVQRSPHAFECRSVETPQPSPPHQALR

SEQ ID NO: 921463 - protein, 157 aa, Homo sapiens
MTSRLFHEMQLQPREPSDAAGRDAEPRAVLAPHVSDWRDEILKVLSLTGIFLTQDQGSTALIGGRVLWRLGSGQQPGYRDVLRPNRTPRAAPAPHRVEPARERPWSHLIPPAADSGELCLAQRCGHHIQAANTRGPPGPARVRSILAWPAWPLAVCM

SEQ ID NO: 921464 - protein, 157 aa, Homo sapiens; identical to SEQ ID NO: 921463

SEQ ID NO: 921465 - protein, 121 aa, Homo sapiens
MAYNGFHLPVLLWFPGGAFETGSASIFDGSSLAAYEDMLVVIVQYRLGIFGFFTTWDQHAPGNWAFKDQVAALSWVQKNIEFFGGDPSSVTIFDSVSHGRRLIPQSRHGEWGGHHPLPEGP

SEQ ID NO: 921466 - protein, 375 aa, Homo sapiens
MWGDPSLAWPGASHPLGHQAVPQPGPLSSPGEAWAPPRHTLGLCRRPCPHQPDHRTLHSSWVLGAAPPDFGAPQPPCPPQQPLMPLDFTWQPWSSLHSQVHVSARSAERMGQGRARGDSLGLRICAHELSDSDGSPHLSGLYPRLHKGDHSRTCLWGHREGGSAPEMIIACGPPHPLESLTPYLPHRLLRLDRLLPPGAPGPRALLCDAAVGRSRPWVTTARPSSSRGQRCLSVGSLESGALVPLAGSSCPIAPQSMWPHPHPLVPAPSQAPSRVHDQAGLEMLLALLTLQGWVELAGFTHGKPYQTKIRREREAFSIIQAEGPIPEDQDQGRGLTAFPGAQRREGVVKASGLGQAADHHPPLPTIQARDNLRTN

SEQ ID NO: 921467 - protein, 136 aa, Homo sapiens
MQVLPSRPLCLLPPGILPERILVLKGNSWGWKPELSGLGLCSAGALGKKDGDLSELQLLSKEDLVYWRSLVTANLMIYESERCHVIRMYSSKETGFTQSHRTSTVSCLHSPPAYLVSVPSSNRNSPHLIISSIGCG

SEQ ID NO: 921468 - protein, 272 aa, Homo sapiens
LLLLLLLLLLPLNNEKFNLMRFIEESYGYQERIWTYSGSRGQHSDGSILNPKLPLRRIVPGPISLALGPRCLDYGSHDEILEAVLRTLAFCLPNSPTVAEFLLASQFWDALLETFQIISYLELISSARQKNEPDAAEFSRDESCWGHRGDRVVVILFLVGFSNFRFQTLRGLFWALLPWLLHTFWAEDNQKASNLMGGTFIAQAESEMSFYISAFRDTWPCRHLEFGFLASRTGYKLEKGKMNHATGQVSITDSQRCPLCGRHFHVDSLQRS

SEQ ID NO: 921469 - protein, 439 aa, Homo sapiens
TPWVLTGSCRQGSRWAVVRMPSPYRFQAPIPLSWGTTASIAWTLPQAGRAGTTWPCSPCAPRVGLPCPTVASLPPHALPNHNRSLSYNNVLNPGSPGGHACLAHPAVGVAGYHSPYLHPGATGDPPWPLPHSFSPVLGPRPQEPSPVLYDILSRTIMASIQERKDREERECLLRSQADSLFGDSGVYDAPSSYSLQQASVLSEGFRGPTLCYSSTDDLVARPGFGGACNPVLQTSLSSLSSSVSRALRTSSSSLQADQNPFRDPAQLAQPLPLCYLRISSWMSSIWSSTPQMSFLRFWGPEEPFRVSRSLLLAGQKRSWQPRPPPWIPSPLPPAPGTGSRLFKLLLEVGCRPLPLVPTEEATLLPMGPVLGGRRALMGPDSRPGPVPSCSLVLLTPLAPLPLTARRRPSPRKPAGSPLIPAPLGGHTNCGCFLTTLGAW

SEQ ID NO: 921470 - protein, 109 aa, Homo sapiens
TTTTKFAAASTSTGGEAEAGSPLVTCRRPRCYPWDRFWAAEEHSWGRIHAPGPFPPALWCSSRHWPHCLSLPVSPCARVLLLEPLSPQLTLRKLARRSPCVVSGRQSLP

SEQ ID NO: 921471 - protein, 263 aa, Homo sapiens
TPWVLTGSCRQGSRWAVVRMPSPYRFQAPIPLSWGTTASIAWTLPQAGRAGTTWPCSPCAPRVGLPCPTVASLPPHALPNHNRSLSYNNVLNPGSPGGHACLAHPAVGVAGYHSPYLHPGATGDPPWPLPHSFSPVLGPRPQEPSPVLYDILSRTIMASIQERKDREERECLLRSQADSLFGDSGVYDAPSSYSLQQASVLSEGFRGPTLCYSSTDDLVARPGFGGACNPVLQTSLSSLSSSVSRALRTSSSSLQADQYRWGS

SEQ ID NO: 921472 - protein, 281 aa, Homo sapiens
MLFPNKAFYFLFVVLLHEEQLLLEGLDLCLQLQPSDIGVINDLAKPMDVVLHRLAHGQLCLILDSKVISSKTGTVDLQNGAGIVHSICRDLSPQVLDGLEVMAPVSDLGSLLLQMLPDFALQLLVLSLQAPHSAQEEMRPLDVAELSEPEEVEVLELEGGFEQFLLPVIHEMPEDIASLTSTGGRTCGSGARCGRWTICSSRSKPRWRLRRSILNRLHNPGDAVEGRVTKRCQKAEEKAKEMVKMAEMLVELAQRIETNESRARSVVYSQWILKMTPYSNY

SEQ ID NO: 921473 - protein, 146 aa, Homo sapiens
KILMDFKWSCFFSWQKPSCLQVVTEDREEGLTVMDLLLTATYSIIPNLQMSKLKHRKFKSLSRRFGCHHLCNTLSLPLNCEFLEDREGTLYLFPISTSSGHRAWHNVEFLLTRTVHAAALHDGTSSLPLMPSANHPSAGTVTTSTA

SEQ ID NO: 921474 - protein, 205 aa, Homo sapiens
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFL

SEQ ID NO: 921475 - protein, 161 aa, Homo sapiens
MLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLKLLLDAPAEDPNYLPLPEEQPGPHLPPPQQ

SEQ ID NO: 921476 - protein, 165 aa, Homo sapiens
MLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLGLQSSKAPAGSSLTIWTQQSQGGPGTAGELAAPS

SEQ ID NO: 921477 - protein, 191 aa, Homo sapiens
MLFVFRYCRMLEEGSFRGRTADFVFMFLFGGVLMTVSFPQALEPRARAPRRPACVGPGANTAMPERDTVAVSSLVCVEGPLCAQLQGSGLDLQCCMQIQSHAQKSQAPFLPWALMGFSLLLGNSILVDLLGIAVGHIYYFLEDVFPNQPGGKRLLQTPGFLKLLLDAPAEDPNYLPLPEEQPGPHLPPPQQ

SEQ ID NO: 921478 - protein, 116 aa, Homo sapiens
MLFVFRYCRMLEEGSFRGRTADFVFMFLFGGVLMTVSFPQALEPRARAPRRPACVGPGANTAMPERDTVAVSSLVCVEGPLCAQLQGSGLDLQCCMQNTKPCTKEPGGLSGPLAEP

SEQ ID NO: 921479 - protein, 186 aa, Homo sapiens
RRRRFRYCRMLEEGSFRGRTADFVFMFLFGGVLMTVSFPQALEPRARAPRRPACVGPGANTAMPERDTVAVSSLLLGLLGSLFFLGQALMAMLVYVWSRRSPRVRVNFFGLLTFQAPFLPWALMGFSLLLGNSILVDLLGLWAVEGDPTVRGCLTGIAVGHIYYFLEDVFPNQPGGKRLLQTPGFL

SEQ ID NO: 921480 - protein, 127 aa, Homo sapiens
MSKSSWAGNLPLCSRPSSKAQLSPCCAWGSGEFHSLMEGRGPECKLPGKSPMLTCAQRSPPLTSQRPRTPIPNQSSASAPHGALPHFQGAQQPLTLALPWQHGTCQQLRVAAVCAGICARICAHSLQ

SEQ ID NO: 921481 - protein, 235 aa, Homo sapiens
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLKLLLDAPAEDPNYLPLPEEQPGPHLPPPQQ

SEQ ID NO: 921482 - protein, 109 aa, Homo sapiens
MLVYVWSRRSPRVRVNFFGLLTFQAPFLPWALMGFSLLLGNSILVDLLGIAVGHIYYFLEDVFPNQPGGKRLLQTPGFLKLLLDAPAEDPNYLPLPEEQPGPHLPPPQQ

SEQ ID NO: 921483 - protein, 117 aa, Homo sapiens
MLFVFRYCRMLEEGSFRGRTADFVFMFLFGGVLMTLLGLLGSLFFLGQALMAMLLLGIAVGHIYYFLEDVFPNQPGGKRLLQTPGFLKLLLDAPAEDPNYLPLPEEQPGPHLPPPQQ

SEQ ID NO: 921484 - protein, 115 aa, Homo sapiens
MVRPRSAELLSPCCAWGSGEFHSLMEGRGPECKLPGKSPMLTCAQRSPPLTSQRPRTPIPNQSSASAPHGALPHFQGAQQPLTLALPWQHGTCQQLRVAAVCAGICARICAHSLQ

SEQ ID NO: 921485 - protein, 148 aa, Homo sapiens
MGEKGSYLHRVMCLASNVKGKGGNPVTSESLLCQDVTSAYNLPATERKCVQNVFAFRLMQVSAFQEYSPKEAVGFKEGTKPSNSNLTHRMMLDQELSRASQFSWSGKWGTKKTACMGKELYSHPIIELLEVGAGSVAGKKGLILSECV

SEQ ID NO: 921486 - protein, 442 aa, Homo sapiens
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKEARPLLLLLLLLLLLLLSAAHLHGQGALACTGGEGEQQQRKLMWQGVQYTAQLWRDDGENNGNSYRKLSPQRPCEVAVVCITLYRRGNSLREARLQDWVTHTGSVDLASGMSTVPGGSRHSLGIQVRGGWGVTGGEEESLTVPVADTWQAGSFKVATQERNPQRAQMRLRRQKKGVVPFLGDFLTELQRLDSAIPDDLDGNTNKRSKVSSWGTHVG

SEQ ID NO: 921487 - protein, 274 aa, Homo sapiens
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKEARPLLLLLLLLLLLLLSAAHLHGQGALACTGGEGEQQQRKLMWQGVQ

SEQ ID NO: 921488 - protein, 559 aa, Homo sapiens
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKEARPLLLLLLLLLLLLLSAAHLHGQGALACTGGEGEQQQRKLMWQGVQYTAQLWRDDGENNGNSYRKLSPQRPCEVAVVCITLYRRGNSLREARLQDWVTHTGSVDLASGMSTVPGGSRHSLGIQVRGGWGVTGGEEESLTVPVADTWQAGSFKVATQERNPQRAQMRLRRQKKGVVPFLGDFLTELQRLDSAIPDDLDGNTNKRSKEVRVLQEMQLLQVAAMNYRLRPLEKFVTYFTRMEQLSDKERLHCSVTISVHCNVCLLGSSPSSASQAAGTTAVHHHVRLFCCCCSATSCPASWSPKTRRLATSCSGWEPTGMLARTPALHHPSPRP

SEQ ID NO: 921489 - protein, 486 aa, Homo sapiens
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKEARPLLLLLLLLLLLLLSAAHLHGQGALACTGGEGEQQQRKLMWQGVQYTAQLWRDDGENNGNSYRKLSPQRPCEVAVVCITLYRRGNSLREARLQDWVTHTGSVDLASGMSTVPGGSRHSLGIQVRGGWGVTGGEEESLTVPVADTWQAGSFKVATQERNPQRAQMRLRRQKKGVVPFLGDFLTELQRLDSAIPDDLDGNTNKRSKEVRVLQEMQLLQVAAMNYRLRPLEKFVTYFTRMEQLSDKESYKLSCQLEPENP

SEQ ID NO: 921490 - protein, 176 aa, Homo sapiens
MGSKLTCCLGPSGGLNCDCCRPDVGPCHECEIPETVAATAPASTTAKPAKLDLKAKKAQLMQYLSLPKTPKMLKMSKGLDARSKRWLKIIWRRHGIWPLENIGPTEDVQASAHGGVEENMTSDIEIPEAKHDHRPTEDVQVSAHGGVEENITSDIEISEAKHDHRTYFFLNSFIYV

SEQ ID NO: 921491 - protein, 450 aa, Homo sapiens
MRSHLTIDRLVPAPHEDTVHDITNEDATHDIANEDTVHDIANEAADKGIANEDAAHGIANEDAAHGIASEDAAHGIASEDAAHGIASEDAAQGIANEDAAQGIAKEDAVHGIANEDAAQGIANEDAAQGIAKEDAAQGIANEDAAQGIAKEDAAQGIAKEDAAQGIANEGAAQGIAKEDAAHGIANEDAAQGIANEDAAHGIASEDAAHGIASEDAVQGIAKEDAAQGIANEDAAQGIANEDAAQGIAKEDAAHGIANELYTTSLTRTPYKPHANEDAVHDITNEDSVQAITNEDTVYGIANEDTDAVDDIAYKDTVQDIANEDAVYDIANEDVVYDIANEDALQDIANEVAVYDIANEDIVYDIANEDALYDITNEDAVYNIANEDAVYGIANEDAVYEFANKDAVYDIANEDTVQDICKKEDAANEPLTLENDTYPEITHFLRKKRHL

SEQ ID NO: 921492 - protein, 450 aa, Homo sapiens; identical to SEQ ID NO: 921491

SEQ ID NO: 921493 - protein, 253 aa, Homo sapiens
MLSTDSKISQRELATDASKVAPRPGTVAHACNLSTLGGRGVGAGRREVEWAARRRKQAFRRLLIPRRSSLTPGDLNLKSEAPRVLSNPGVEVGWGIPALSDLGDQKDAHLGEWDLPFQSAHPRGPHLEGRTWRTAPPRRARLTPGAQAMWGVRAGRSVPAPHPASMRTTKPPGPGNRGGAGRGGAGKRRGAGPVTSRPRPRPAPSSRSAPQRSPHLQAQVCALRISKAGQQASENGKCWGEKDGDELLGKPPE

SEQ ID NO: 921494 - protein, 212 aa, Homo sapiens
LKWSEECVTHVRAPCMATWAIIANPGNGAVRASEVGGDITARCSHRRYSCPPPQQSLQYQEVGGFNHLTQKLVGTQGGGDVDLSENQLGVAGAQALCAALTVNQAMRKMQLSGNGLEEQAAQHLAELLLAHTDLKSLDLSYNQLNDQAEPLSGCGVRSMFLGPAAALHTPLPVSLRAIHVYTGPFLLCSGPLGSVDHHHPSCSHQGVCMALS

SEQ ID NO: 921495 - protein, 261 aa, Homo sapiens
MEAVPGISVPASDSHCRDLGVNNDHGGRARDVPASDSQCLDLEVNSKPADEGERVKEEVVISSAYLLEPPDFGGGFHWVSPAPGNRPSHSVDRVVRLRFVDASIFPYIELSEHRLWSQPDLEDFGYVSPTPVSLDFSGCPLGCAENKYADILPFCSLQERTTLPSAVLDLSSNAGLTYCRHLSTERTHLSSLVNYMIMSLDLPCDAGQELTAGIWEQYLQDSTARKLKACGRAYGTFLQMHLVIEAFTGKYLPWLVKSKND

SEQ ID NO: 921496 - protein, 135 aa, Homo sapiens
MTFPDPSPNPHPSCPTVHRDEAAHPGLCDSVHVITCDGTTALFPPCSWANSFSFCRKTTPSSMPWGHWGELSTNLSSAWTNQKKAGARKKLRHHLAYILILQLRKGRLSAAPGNKQLRRNGMFLTRSSRAVIAPL

SEQ ID NO: 921497 - protein, 180 aa, Homo sapiens
MTMFTESHFRILNLRTIINQAAGTPPPGSEALAVLRPAQNWSQGWTPPGGAPGALPTTCSKDTASWKRPWFPFGGELVQGTSRRRRGSRGPGLGGQPSLHHLLRVHRSQPWAFCPFHSKISGLTFISPFHPPQEVGTRLGVAFADPENEYCPAYTAQWPREADEDTEDLRAGKEGRGDIH

SEQ ID NO: 921498 - protein, 180 aa, Homo sapiens; identical to SEQ ID NO: 921497

SEQ ID NO: 921499 - protein, 207 aa, Homo sapiens
LRTEMFILLAALIENLLCARHCPSAKNSPANMTDTPAVISKLASAEGSWRVSNFLQDSIYSLAVIVLCAQRLVFLKHPLPALSTPLLALLPSYLWTDKEEKRGPCNAQWSQDASYVGDKDPPVQEAPGVPPSPGLQCQPLEGKHGCLLSAVEKTFWSRRSKAFWGLQPPRSPPQASPLAPGNEAILRSQAHSLFSLTGHKKLYVELF

SEQ ID NO: 921500 - protein, 174 aa, Homo sapiens
SSPLHLGRNKPTATRGRENAGRIREMGLGDMVEWPGREWLQGLSLGPAGLAGHPRGLLLAPEPVSVRAGWQGQREAEGPRARACGKRGRPLLGSSAAWTLTPCKVLVATACRAVPLAVGRGAGGHWEDLHPSEGKAWSRSSSIPFPPGLLLCAGSTWPCENRAAWWTGQHGTAS

SEQ ID NO: 921501 - protein, 174 aa, Homo sapiens; identical to SEQ ID NO: 921500

SEQ ID NO: 921502 - protein, 129 aa, Homo sapiens [sequence omitted]

SEQ ID NO: 921503 - protein, 443 aa, Homo sapiens
TLLSGTLHSAWRKRWFVLRRGRMSGNPDVLEYYRNKHSSKPIRVIDLSECAVWKHVGPSFVRKEFQNNFVFIVKTTSRTFYLVAKTEQEMQVWVHSISQVCNLGHLEDGADSMESLSYTPSSLQPSSASSLLTAHAASSSLPRDDPNTNAVATEETRSESELLFLPDYLVLSNCETGRLHHTSLPTRCDSWSNSDRSLEQASFDDVFVDCLQPLPSSHLVHPSCHGSGAQEVPSSRPQAALIWSREINGPPRDHLSSSPLLESSLSSTIQVDKNQGSLPCGAKELDIMSNTPPPRPPKPSHLSERRQEEWSTHSGSKKPECTLVPRRISLSGLDNMRTWKADVEGQSLRHRDKRLSLNLPCRFSPMYPTASASIEDSYVPMSPQAGASGLGPHCSPDDYIPMNSGSISSPLPELPANLEPPPVNRDLKPQRKCKHLTRPAVQG

SEQ ID NO: 921504 - protein, 413 aa, Homo sapiens
MSLWISGTYPSPQSYDSWDYSELDPERFRREELMLYRRRLTKGREFSLFAGKRAFSQKPAQSRKFYHPQHHPGKVFTEKSQAVSRKARAFPPPRQPAPLCTLAICHLCAYGEVLLPSQLPVLSVYSFPSPLPYCIYIFSLGGLIWSGSFKYRPYASDPPSPWPLPELVLVYPPAFSATPGGFEEPQSSYPGRVSVLASEAMLPRMMAKPYCLCQGVLLCASVTEDWMLKVLLYSLKNQLLLSTVSPKTGVRILPISSPLLISILKSQAGVVHLQSCAACKSPELTSNLFNIYGKSPLIVYFLQNYASLQQHGKNVLIFHSTGISLTAEATDCTPTYTDVISETLCSMKKRKDNLNQLYQHHWTEWNYFDKHLKELQDNFSRNHTFLFLDLLSVAASGPENAFSSLLFVNCQHH

SEQ ID NO: 921505 - protein, 161 aa, Homo sapiens
LVQGPQSMIQAINSEQTADWPHKARQQPTDRLPLSQGEVPILQGPAPSSGGSPGQRHRCAAGLQERSESYSPASSTELCSSCISVCQPDQQTLELRLKGRVLPSHELIHTGTCVRVWRAPVRWCAVLAAQVVKDGRAAEGAGQGHCPCLPECHYVNHPGIP

SEQ ID NO: 921506 - protein, 1707 aa, Homo sapiens
MATRVEVGSITPLTAVPGLGEMGKEETLTRTYFLQAGEASGAPPARILEAKSPLRSPARLLPLPRLAPKPFSKEQDVKSPVPSLRPSSTGPSPSGGLSEEPAAKDLDNRMPGLVGQEVGSGEGPRTSSPLFNKAVFLRPSSSTMILFETTKSGPALGKAVSEGAEEAKLGVSGSRPEVAAKPALPTQKPAGTLPRSAPLSQDTKPPVPQEEAGQDHPPSKASSVEDTARPLVEPRPRLKRRPVSAIFTESIQPQKPGPGAAATVGKVPPTPPEKTWVRKPRPLSMDLTARFENKEALLRKVADEGSGPTAGDMAGLERPRAASKLDRDCLVKAEAPLHDPDLDFLEVAKKIRERKEKMLSKPEMGSPRALVGGSSGVTPSNDQSPWEEKAKLDPEPEKAAESPSPRLGRGLELAEVKSRVADGEAAAGGEWASRRSVRKCISLFREDSTLALAVGSESPLATPASPSAAPEPEKGVVSVQERIRGWTAESSEAKPEVRRRTFQARPLSADLTKFFELNTCYIFSNEVKYEKSAELSGEFPKEPREKQKEGHSLDGACIPRSPWKPGTLRDKSRQTEQKVSSNQDPDSCRGGSSVEAPCPSDVTPEDDRSFQTVWATVFEHHVERHTVADQSGRCLSTTPPGDMAHARVSEPRPRPEMGSWLGRDPPDMTKLKKENSRGFDNPETEKLGPTTLLNGELRPYHTPLRDKYPLSENHNNNTFLKHLENPPTSQRIEPRYDIVHAVGERVHSEAISPAPEEKAVTLRSLRSWLSLKDRQLSQEVTPADLECGLEGQAGSVQRASLIWEARGMPEASGPKFGGNCPFPKWTGGAVVSSHKATVAVSEEHCAPGATSVRAIKAAIWESQHEGPEGARSKPGVGARGPPQGCPLDPLSRATNGPSDSQARTHPDAFAVQKGPFIVAAREGDPGPAQVPQPAVRMRKAGAMDQRMDRWRRRTLPPNVKFDTFSSLVPEDSPHVGHRRTDYVSPTASALRKPQLSHYRVETQEVNPGASRDQTSPAVKQGSPVEPKATFFAVTYQIPNTQKAKGVVLSGAESLLEHSRKITPPSSPHSLTSTLVSLGHEEALEMAGSKNWMKGREHENASILKTLKPTDRPSSLGAWSLDPFNGRIIDVDALWSHRGSEDGPRPQSNWKESANKMSPSGGAPQTTPTLRSRPKDLPVRRKTDVISDTFPGKIRDGYRSSVLDIDALMAEYQELSLKVPGEAQERRSPTVEPSKQLAETLETAMGTKSSPPFWALPPSAPSERYPGGSPIPADPRKKTGFAEDDRKAFASKHHVAKCQNYLAESKPSGREDPGSGVRVSPKSPPTDQKKGTPRKSTGRGEEDSVAQWGDHPRDCGRVPLDIKRAYSEKGPPANIREGLSIMHEARERRREQPKGRPSLTGENLEAKMGPCWWESGTGDSHKVLPRDLEKEDAPQEKERPLQQVSPVASVPWRSHSFCKDRRSGPFVPRGVRKALAGPCVYGNSHSVGQPRALHAPLLLIPQLAGPNPRLDTHQPVSQDTQRQGYSQAAGIIPPAVPPVQRNQPFCCTFVGQQDPVLWLCCQLGLSSDWYCQLLGSEGSTPGPAPLDEKPEMPRAGLIGPSGGFSVPQAAVAISGADWLVPWPGKLETVLCSPHNLWVLEMEYYYCPSLLKLLRYLWEELRLLNRNEDPGSDVGFPPVLKKTGRTRTTSTYRMPPVCQGQGAIAETKT

SEQ ID NO: 921507 - protein, 126 aa, Homo sapiens
MSHIQVTLILDFIIHFTTSILVKGIQQVARKLQTFSLFQPLPVTQFQSCFNIFGYLYSSTRLSVVLIYCISLFTYCYKELPKTRVNEVGSAFLMPSVSASKLLGNETIYHCEHVDGKRRFPMGLAK

SEQ ID NO: 921508 - protein, 126 aa, Homo sapiens; identical to SEQ ID NO: 921507

SEQ ID NO: 921509 - protein, 218 aa, Homo sapiens
NRSVYLTGRLLAYHRDEVLKMQSRRSSQESVPKATKTGGDSSAILIYLSCKYQTPDHWYPSDLQARARVHEYLGWHADCIRGTFGIPLWVQVLGPLIGVQVPEEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 921510 - protein, 260 aa, Homo sapiens
ALSAFTAIPAVLAAPAMGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQVLGPLIGVQVPEEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 921511 - protein, 2556 aa, Homo sapiens
MIVLYSCCKELIHSFLKDSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSSELRTFNSDLVTFFGDSSSTNLTFSFFFSTCNKYIFKRKKENGEKKRWVIDRLSEHIVASLITSVFSFGICIQKENISLLKYLNHERQPEKDNVKQVHIPFKFKHKKIKKIEFLVFHFFHVIWKLLLRNIYTEKKWLFNFVCTGCVSVLRSTMFGREGNSKELLGEGGGKTVTEPHFKNKNTKNLKKKKRKKFVIGLVDKYQCVLAHVTAQACSFWCVCARVFMCIRVHPSLSLCVCLCSSLLPCPTLTSQKAASLTVCRLAGRPICFLFYFFNYENTQARRATATKATPLGCIKMNRVLFNDESRELLSICNLAWMWGFSGCSFDLAVEWSTAKSKKLEQEDLLEQRCVYFCFFFFLSEWPPGTSEYLLSFMQAFSVSLKWERKITFDDAMSQKQRNFVPSFLMIRFEKFFKKLGEVELHISVGWFSFSFYENRKESSGEQPPESICSYSLCSFLAERYLCQAVARYSSQAITDRNVYLTNVLKPAVYFKRFLLFLCVVYFLCMWFCLGRYNLAKTFKYCTFFLIFDLFPPPCNFAFLISVFKYFFFFLSINVVVLWAEQGSTFNLQFITNMYVLMSESKCIKLLIVKRIIADLKGAKNQIGWGDGCRGRASTCVDIPVCIMLFNIKCRHFVPANTCPFQPLVGADLYCPLELAAIEDKGVFLSLASSVKDTIQQCLMYLTFYLCLCVGGWVGVYRKSQNKLFAFQWFCETKNGKFCSPSGFTLLIINLASKEIDRHDSSECSHIQACMSPLWVGGHTWHLQHGRGPAGCLEHALFLLCNLNHHRAPSTTVPHAKALLPAAPTDLLSVWSKVLSCGDHQVKSSLYSDIQRRLNLSVPGPGAYPKAPASQWRPCPLPLLVHCCVLPHPPLLLPVGSLTCTMGYLSSLRYYGESRVLEPLLFTRHNEGFEICKNKHEKLKCSSIISLKGKKLKTLKKKDQKVRIYIHINIYFEMKTELWEHLTVFFVSVFNICFPALKFASILRNSRVGSQFFEDGLFNHILSKRDGCFFPVNKLLQVPETSESLNNFYLKKCKKKSLQTLLSYWGSHILKHIEIFFKNYQFSSNRKIHYLKNMGEGLSFVRAQIMDSFEIVCSLMGECLVYIDENAITLFLSIETELKSPLVIFIFLKEPFSLSPQPQQQKKGRKEENNSLKKKVICKKYSWIAENLCKEFRKYRLIIFGTNFKYRHYYEENYLWTVLLMKNVCLTSVCLGGGENIEESNKEQVISTFLAPSYCCARFNCCFEDLLLNYPHPLAGDVECFLSVFGDVEFFCIPSWGQGSEFPSMTTASFKHSASQWEGNSSSTGKGSGWGCCLQFLYNRFSAFVHTPRHPEQGGRTCVCVWSSHSTDVRYSPIKEIGVVLDRPQRQWAEFKINKQTSSKLICLCLSNVECQVPSCVVCPPLLCIDSSRCVIVTTAVIWKVSLSWANRRGSCCSALVLRLLPFSPRPPPSFCQLAGSFALLVGSDLRTGYGEDVMEEKSSFRGISLARAMSTKRLGDFSILIKFSESAFFSSTTLWHRYRLAGHLSLHRFILKTFDYVNLSFPFFFFNYFLKHLITSGLEVCTSPEHHKLGFYLPHEYQKKRSTNRERGVSHQTEDLCCQLDPVSGPNFKCGKEFRSLRHCEEMDGSCNISDPSVPNPGRVSFTTFIGVNLAVLQLRFQTKLFNQCPPNKSLIHLLLVSFIYSNLISYEYGSCCKNFPTSSDMNEHKLAIGSSKLLWVEYGIEGMQEEKERKKIKLLPENLEAPLLTHISRRN

SEQ ID NO: 921512 - protein, 193 aa, Homo sapiens
MRLGPSSSANGAGEGDCMAGEGRRNLLLPVPMRALEQCFFAPQQQQFLPVDAPESILQFSQYLEVHLRCILRGVDTGPKLHGSLFPLFPQPWGSSHLYSSISVCPSLDAVASRALNLYCLLWAYGVCSRESLLKDPQTLDSHGQPTVVMEPEPECNSQCDQELEFKSRQQVLLIEGKFSEDAGSLQHSGELKQ

SEQ ID NO: 921513 - protein, 389 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQLFL

SEQ ID NO: 921514 - protein, 286 aa, Homo sapiens
MTGRNSLRDGWICNAMAGGVPGQPAGVGLALIATDSQETRPGRAGPGSGESLSASHLFISDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQLFL

SEQ ID NO: 921515 - protein, 107 aa, Homo sapiens
MRIPSRDSMTGRNSLRDGWICNAMAGGVPGQPAGVGLALIATDSQETRPGRAGPGSGESLSASHLFISDFAYCWENFVCNEGQPFMPWYKFDDNYASLHRTLKEILR

SEQ ID NO: 921516 - protein, 149 aa, Homo sapiens
MDDTPPWGARCAQGAALGTLERSLPESPPPAIRCPISETGTGRPAPHRQFRGVTRTQDSDDSMPDPPGRRRSLTAAWGRRRGDQRGPGQLVPGIGQDGPLAGAGGRSRLALLHGHQVMMKPLLWSKLPVNSAQRAGPPTSLLNVPASPP

SEQ ID NO: 921517 - protein, 542 aa, Homo sapiens
MGDIFLCKKVESPKKNLRESKQREEDDEDPDLIYVGVEHVHRDAEVLFVGMISNSKPVVSNILNRVTPGSKSRRKKGHFRQYPAHVSQPANHVTSMAKAIMPVSLSEGRSTDSPVTMKSSSEPGYKMSSPQVVSPNYSDSLPPGTQCLVGAMVSGGGRNESSPDSKRLSTSDINSRDSKRVKLRDGIPGVPSLAVVPSDMSSTISTNTPSQGICNSSNHVQNGVTFPWPDANGKAHFNLTDPERANESGLAMTDISSLASQNKTFDPKKENPIVLLSNFYYGQHKGDGQPEQKTHTTFKCLSCVKVLKNIKFMNHMKHHLEFEKQRNDSWEDHTTCQHCHRQFPTPFQLQCHIDSVHIAMGPSAVCKICELSFETDQVLLQHMKDHHKPGEMPYVCQVCHYRSSVFADVETHFRTCHENTKNLLCLFCLKLFKTAIPYMNHCWRHSRRRVLQCSKCRLQFLTLKEEIEHKTKDHQTFKKPEQLQGFPRETKVIIQTSVQPGSSGMASVIVSNTDPQSSPVKTKKKTAMNTRDSRLPCSKDSS

SEQ ID NO: 921518 - protein, 252 aa, Homo sapiens
MEGHVYWTDDEVWAIRRAYLDGSGAQTLINTKINDPDDIAVNWVARSLYWTHTGTEHIEVTCLNSTSHKILVSEDMDEPRAIALHPEMGLTYWIDWGENPEIKRANLDRQELRVLVNASLGWPNGLALDLQEGKLYWGDAKTDKIEAISVDETKRQTLLKDKLPHIFRFTLLGDFIYWTAWQHHSIKRVHKVKANRDVIIDQLPDLMGLKAVNVDKVVGTNPHADRNGGAATCASSRPTQPGLAAPSRAWNC

SEQ ID NO: 921519 - protein, 252 aa, Homo sapiens; identical to SEQ ID NO: 921518

SEQ ID NO: 921520 - protein, 224 aa, Homo sapiens
MEGHVYWTDDEVWAIRRAYLDGSGAQTLINTKINDPDDIAVNWVARSLYWTHTGTEHIEVTCLNSTSHKILVSEDMDEPRAIALHPEMGLTYWIDWGENPEIKRANLDRQELRVLVNASLGWPNGLALDLQEGKLYWGDAKTDKIEAISVDETKRQTLLKDKLPHIFRFTLLGDFIYWTAWQHHSIKRVHKVKANRDVIIDQLPDLMGLKAVNVDKVVGPGTAE

SEQ ID NO: 921521 - protein, 178 aa, Homo sapiens
MEGHVYWTDDEVWAIRRAYLDGSGAQTLINTKINDPDDIAVNWVARSLYWTHTGTEHIEVTCLNSTSHKILVSEDMDEPRAIALHPEMGLTYWIDWGENPEIKRANLDRQELRVLVNASLGWPNGLALDLQEGKLYWGDAKTDKIEVRLPWRYLILEAWPCPAVPGLLRGQARPPPAA

SEQ ID NO: 921522 - protein, 252 aa, Homo sapiens; identical to SEQ ID NO: 921518

SEQ ID NO: 921523 - protein, 224 aa, Homo sapiens; identical to SEQ ID NO: 921520

SEQ ID NO: 921524 - protein, 132 aa, Homo sapiens
MEGHVYWTDDEVWAIRRAYLDGSGAQTLINTKINDPDDIAVNWVARSLYWTHTGTEHIEVTCLNSTSHKILVSEDMDEPRAIALHPEMGLTYWIDWGENPEIKRAILLSASRRPRPWTLMCPATTSTGQTSA

SEQ ID NO: 921525 - protein, 293 aa, Homo sapiens
APESMWSVVPPAMQILPLIKGQPRGESCGLRQGPQHTSIRKLSLSWMGNHRAGFLLEFMVEREGAEREEFSRPRCSKPLAPVLGPGEPEEQETKDQPRGPQDPFPGGVTCVLSEESEEQQSPGHGGDVPRALPLVTPALALPQPCLIPFASEEGGASMKISILGSSPHPTLTICTIESLEHISHPRQCTHIHTGHMWEGPSGGTQSTDQGHSPEPKPAAPNPALPTHEQEIKSHDLAASPGESPERPGTMKVEEQPGKEKPLCLQDRGSQSKGEIKGTPVTSGRTLHMAGTPF

SEQ ID NO: 921526 - protein, 160 aa, Homo sapiens
ASGMMSEPSPTLLLPAQGSWAALRPPPSKIKIGLERQWDRAVGVPGGSGAGRTKSVPAEGCRYRVQGVAAAGPQLASLNPFLGTAVARPFPLVLFLLETPHSLLGGSRQRKRGCVCGCHYSADTLAPPQRVAGPGNLHLNRPWLSHFGNCPKHLSNMGQV

SEQ ID NO: 921527 - protein, 641 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAHGPKGGSGSGPTIEEVD

SEQ ID NO: 921528 - protein, 404 aa, Homo sapiens
MSTQFSHFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGMNAGMNPGMLAAGNGQGIMPNQVMNGSIGAGRGRQNMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQRK

SEQ ID NO: 921529 - protein, 172 aa, Homo sapiens
AAGSWLWVDVVGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQRK

SEQ ID NO: 921530 - protein, 140 aa, Homo sapiens
RQNMQYPNPGMGSAGNLLTEPLQQGSPQMGGQTGLRGPQPLKVSTVLVCVHNRHACEYCHDGWRVCLTLYSSFHYYTPGIYCAVISFKKCLYLSKTFILQLVFYNFILPNDCWLMLVLSGTSIGMFLSHFQVQFSLVASL

SEQ ID NO: 921531 - protein, 297 aa, Homo sapiens
MSTQFSHFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGMNAGMNPGMLAAGNGQGIMPNQVMNGSIGAGRGRQNMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMVSTNPLQTCFQTGILTKELC

SEQ ID NO: 921532 - protein, 197 aa, Homo sapiens
MRFERKLRPAVKSRTAQFGRYESCRSNSIRRKGDNAFPRGRAARRGANCLDAPPATVPQLASSAQRDSAPQGHREGPDPSAQWDGVAPRVRAELPIWAGPKGHVAGKAGARAASTNRRPPRAASPRLPRPTPGGRLRASYQCQDCQSGRSAARASRDCWTAGSRLEASERSVTAVEEGGAGRQRGTRASGPLSWGAG

SEQ ID NO: 921533 - protein, 197 aa, Homo sapiens; identical to SEQ ID NO: 921532

SEQ ID NO: 921534 - protein, 294 aa, Homo sapiens
AGGWKVVPVTGLAVGAAVAMLSVAARSGPFAPVLSATSRGVAGALRPLVQATVPATPEQPVLDLKRPFLSRESLSGQAVRRPLVASVGLNVPASVCYSHTDIKVPDFSEYRRLEVLDSTKSSRESTEARKGFSYLVTGVTTVGVAYAAKEMPSHQFVSSMSASADVLALAKIEIKLSDIPEGKNMAFKWRGKPLFVRHRTQKEIKQEAAVELSQLRDPQHDLDRVKKPEWVILIGVCTHLGCVPIANAGDFGGYYCPCHGSHYDASGRIRLGPATLNLEVPTYEFTSDDMVIVG

SEQ ID NO: 921535 - protein, 150 aa, Homo sapiens
MKTLIEHTTMHGYRCTAGTINAETHSIPLRTGSETVCIQGENLLGLYSVFGSDVHEGALSIGSFGAMNIAHCFGAQSREVLHQVQAGIQDSIGHSVTKQPELPDSPVVCSGRPQQRSLNGECRINCSSSVKNSSREMQLYPTCTPASHVY

SEQ ID NO: 921536 - protein, 680 aa, Homo sapiens
MHQQDQEVAWAPPITPIHANLEDRSRGCCFNATTRREAEGLCHARVLREGVTSTLAVLQADSSLGVSSTWRTAAGGAARAAAHGQSSPWATPATTPSPEEPKAGEAQHGMKQRSEGHKEPPRAAVHMGETSPTRPRPPVLTDALCEVGVELVSEKGLGQLTEVQLQHACDGVHVHLAHHHRHVLVIWKEHGNAAASLKILINEEKNREGCDMPGPWSTLRSHRGHHCPHLHPVLRRPTLTDVEACLQCLDVRGHPRHAVDAHLLHASALDLLHTLAHDVGHLGPLSPAGGGNVLSVLTALLGHNTGDLLPMCTPGGGVRTVTKVPRSGAAHRAFCMPVLPLQALSSWHVLSQEPFKRPEPLRITHDLCGKKQLKGQAPSVREPKPLPTHLVTTAILTPKTPVCFRDGILFKLNFLLLNLTESFTSIYSGEKGHSPLILLVLIAQGPKDPWDGRQESPTDTYPIHGDDGALPVSVLQGLWVQLKGRSHDWQRPWVKGELSSSNFSNNSWGPGIHSCCLGNSSTIQAASLQELVLNVTRTQSVLVCNTLTVMTKPHVPHPGTLCFPLYGEHKLYVSGSWVLLVNVSQGSELCSQSGTEKQRAAGRLPPGAMWPQALIPHLALKVVRGHTPGLRDPTLRSSICEQGANSHHWAPLPLKTQNWQKQLTSNPESSAPSPPAYPVP

SEQ ID NO: 921537 - protein, 465 aa, Homo sapiens
MGIKNPKANPTVTLFPPSSEELQANKATLVCLISDFYPGAVTVAWKADGSPVKAGVETTKPSKQSNNKYAASSYLSLTPEQWKSHRSYSCQMPPGPLAPASSFTAAVGAGAGASQGGFLYEPVSQCVVFGGGTKLTVLGGHQDSDPLPLIHPAGQPKAAPSVTLFPPSSEELQANKATLVCLISDFYPGAVTVAWKADSSPVKAGVETTTPSKQSNNKYAASSYLSLTPEQWKSHRSYSCQMPGPCHGIPDPMQQASDSVSSRSLDFQGSCCGSQDVTGPLSLWVKCGGHVDSLMSRCHQDHWPQLPPSQLQWGLGLGASQGGFLYEPVSQCWVFGGGTKLTVLGGHQDSDPLPLIHPAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 921538 - protein, 211 aa, Homo sapiens
MAAWGLDSLLEPETPTFPTPGPGSWDLQTVAVPGTFLPTTLIGCRHTPWVTALSPRPKGQPEPLSPEVPLSSGLLSTLAWGSPNSSSRVPEAQPPAPSLAETGPPRTCWLPGTPAGEREAGARQVMWAVGWAASLHGTLVTVSSSENEQSGTRALSVLFPLGRGFLGLGETDSCGRWRLHEEPCHTPTCTCTCTCQLIDRVRQESPKPFDL

SEQ ID NO: 921539 - protein, 1320 aa, Homo sapiens
MVVGSQGSLGAGQLWWRKSVYPGTGKRQGLHGLGWEAQGQHEGEGPQVWVSRGINELENGMRLGAVAHACNPSTLGGWGSWITGGQEFETSLANMVKPVSTKNTKISRAWWRVPVILATQETEAGELLEHGRWRLQGADVAPLHSSLGNRVRHWLKKKKKKCQAQWFTPVIPALREAEAGGIMRSRDKDHLGQHGETPSVLKIQKLAWRGGGRLYVPATRVAEAGELLRTQEAEVAVSRDSTTALQPGDRARLLSQKKKRGKEKIKESGVRGCTERRAWGEHTWSFSHSADFPVHFPPTGGEIRSAHDLNVAEAQPLGRRKKRKWGVCKQSSKEITAPFHWTGAAGSPPKQGHADLRASLFSGAPGLCCLSPIHTQSQSSGRWKRSHFNNYLSTWSLMASNSVIILCGGYTLFSTRSIAFQVDVSVYKWSGDSGSFGKLIADEGAVMCCSHCESCGSSALFPSFYLAVGCWHLSVLWDLMLLTLSEMPHEVTGGDPRLAHTPWTCPAMLDKLILGHSLPVLGKALPETLGGPLMCQALTLLIHSEGGGLFGYCRAPQTSWEPETGSCCHTSKALLSSSEEQCPESPLRILPAPLAASPFMCVLGGILGHLGGARRDCTTLPGFLDQGGDPLTLAFGNVFSSAHPHRPLRDAKKVSCGLFVGVDSKWGQIPPAELQRASLRRWASHGEQLVSPVLGGHRSAFCDTLLRGWPGLSHHLTAWSVVEGPEPRAACESSGAPALSSQYVLPRSGNVSLGLEPADPPFLAEPKQTHTQFQRGEGRPGAVGSVSWLWFGSGLRASCGRKESCGDNQGHLVMLGSRCWHSRMRGRPEKGPLRGHPRCSSQTQAAKASWAPLKARRSWSPGDLGVTSDFWEQKRFGERFISILRQTNLAMGFPGRTWETPGAGHQVCPSVHALLSPPSRVLPVVSKERRASSLVVLLHNSFHPIHEFSPPASGSCSRRTKESLCFRPRLLLPKSTVPAAPLPPPAYRGRELQKQSASSQILSIGPPVLSWSHMSTAPVSGHTLAMASPNPAGLGESPRAGVTMPPRTPLRTLHPETKGAPLLRPSLAWRCLSCHCACGCPLAPSSTWAANQCRSPVLLPVLFSGQGRECSSRDLRTSGMSMAGATENQSQLTQPSRRCLLQGVQRQLERQGPPAAGQGGRRGGSLEAANGQHQSQPARPPPARPPASSGCSQAFPSRCLAGRAWPCASCSTWSCRANPLTESPACYLTLEREVLPQAGSHNWGCQVRMVSSTPTASTHQHGGALEAQARSGNHPGLGPEAPREKEDDRQGQHLRQPSTRHPVLADAGMRSDIMPSPVRF

SEQ ID NO: 921540 - protein, 275 aa, Homo sapiens
LWSVQNSLGGSQTLCPCFSSRPTMLPVSLPQGHVTAAAPLDSHGACGPELIFLAGPSPGSSGGERQANEAKVMVQLASLGGTVAFQPDCSSLTSHCAQVEAGPRGEDNSKAGSCKSAFPQQHGMNTIDAHSNLNDSPENYANCEKAIRKSYTNVANSPSDYHHSAFENHCPEPEGWRISMAVGGREKPEGNEEEPGCLQRLRPPVLQGPGLRLRSADSTMRVPTAPPPGSAEAVGNTQGSQTVDICLPMQTSCSLEAGEGTLKKRSRHDSYPEGL

SEQ ID NO: 921541 - protein, 135 aa, Homo sapiens
MSKGCQIVTCACVKVHIPLLLRPWIEHVPTFSCDEMTGPSIENTTFPSAKGLFKFTEVVKCLLPSLHWFLGSSEPIFSKCPEPPVGLSCESPSWLPPIPLKCLNLLSGTSMAPLWNLMIDFDLPSPTDHPWITGH

SEQ ID NO: 921542 - protein, 120 aa, Homo sapiens
MPVLTQERVLSAQILVSADIAKSVSLLVTSSKPQTAVQKSHYTIWDKPNASIFKITMIQLKEDSGSYWCEIYNTSKNIITVLRDVSLVVFAGNQVPPSALAQLAPNSWSLCCVDSSWPRA

SEQ ID NO: 921543 - protein, 167 aa, Homo sapiens
MPVLTQERVLSAQILVSADIANSKPQTAVQKSHYTIWDKPNASIFKITMIQLKEDSGSYWCEIYNTSKNIITVLRDVSLVVFAAPTTSPTWTLTWLPTNTGHDSKFVREERGRGCRLLIVEEPWKRQFNMDFCNETKWNPENVETLDRVGVLKEDLASVLPHYQIHI

SEQ ID NO: 921544 - protein, 173 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQGKTLRLSNVY

SEQ ID NO: 921545 - protein, 389 aa, Homo sapiens
MYSISPANSEEGQELYVCTVKDDVNLDTVLLLPFLKEIAVSQLDQLSPEEQLLVKCAAIIGHSFHIDLLQHLLPGWDKNKLLQVLRALVDIHVLCWSDKSQELPAEPILMPSSIDIIDGTKEKKTKLDGGSASLLRLQEELSLPQTEVLEFGVPLLRAAAWELWPKEQQIALHLECACFLQVLACRCGSCHGGDFVPFHHFAVCSTKNSKGTSRFCTYRDTGSVLTQVITEKLQLAFSPRTEEEFLDQVKRKLAQTSPEKDLLTTKPCHCKDILKLVLLPLTQHCLVVGETTCAFYYLLEAAAACLDLSDNYMVCFNMGRITLAKKLARKALRLLKRNFPWTWFGVLFQTFLDKKNLAVLQQQVHCLSLLWQLYNLEATASSYRFACLA

SEQ ID NO: 921546 - protein, 137 aa, Homo sapiens
KKPNTKGYLLYDSVYMKCPERANALKQKANQRMKGGQNGEWLLNECKPGHGPPKFWKAPPPLAPTGSAHHQRLSSKPPPSAYCMDSRSPLPPLPPRKAGLGPIRGCGTFWKAQGFSLGGAGPLIGGGLPEGWGDGRG

SEQ ID NO: 921547 - protein, 137 aa, Homo sapiens; identical to SEQ ID NO: 921546

SEQ ID NO: 921548 - protein, 121 aa, Homo sapiens
MQVIFMCSDIVGTVTAQDQATMKRREAVCAHRHFLGTGKPPHPLGRSIPVEPCPGLPAFAEVDLLSLLVPIKISSTPPSGSRLDPQIASSAFPGLGSLGGQDSSGSLVQRASCELESPYEL

SEQ ID NO: 921549 - protein, 614 aa, Homo sapiens
VEIAVVMSGKGQERNCRGREAVRRLRRSPEQMGAGGGASGLDVLPLLAAPRCPRAALAGGSKGTSVGLDAQQLWPVSSTAVCEGNSTCSENEVCVRPGECRCRHGYFGANCDTSERGVGPVLVGGAESWRDGAGSKVGRGRIRLRGGSPEVAAGVRDAGRFRLAGGTYSSTGAFHPLRSSPAECPRQFWGPDCKELCSCHPHGQCEDVTGQCTCHARRWGARCEHACQCQHGTCHPRSGACRCEPGWWGAQCASACYCSATSRCDPQTGACLCHAGWWGRSCNNQCACNSSPCEQQSGRCQCRERTFGARCDRYCQCFRGRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRELSLGRKKAPHRLCGRFSRISMKLPRIPLRRQKLPKVVGKDDSAGYLGETPLDAGSCWEMGVRGSRSQ

SEQ ID NO: 921550 - protein, 166 aa, Homo sapiens
MRFPENALQMCLLFPELPAQLVSVVSLMLLLLQLSQCPFPTCHPRPVPQSNESSSGQTDKATQEEICKKIGSRNSVLTSPLSEIYKTVVSMFQLVGVQVSEEQLRDTGQFRICSPGHSCGFHETVNISGLPVTLSNILCKSISAITPSWNDKLLFLNSEQRLPTLQ

SEQ ID NO: 921551 - protein, 166 aa, Homo sapiens; identical to SEQ ID NO: 921550

SEQ ID NO: 921552 - protein, 186 aa, Homo sapiens
MRYVITCTVLTRSNNQQEKNWPSQQEKSVYLCRAADDGMSHLKHAQHSADKAPFTLSLPSEERSIRSPPASVQQAKQNATQGHPEKETKMSLLGIMSLHYQKEDPTYVISGPFNKYFLKEVFLSSSHLRITHLTQTEQRCHEHIKLAAPFASTWQMREKENLVWRPPSIKGKRVKSGRESSQVQQQ

SEQ ID NO: 921553 - protein, 170 aa, Homo sapiens
MNVRMFSLMVGIFSVLNTTQFFIFDLNQKTHICYEAKFSIYVDSKSELVTWTLFHRANISTGLSLTTIIIGCFLFYCIHKNIYMGLLIYAMWIITYELINFSIVLLLNGIIKDHFKTLSYLHWIFQISHMLLHFFCLPFIVKHAYNLYKESQTVGRKRRHRLCSTIAVNS

SEQ ID NO: 921554 - protein, 150 aa, Homo sapiens
MASMRARRSSSSFLLLMASRSCRASEKACKKVSKMPKNSSGCILLSCSPKCIKALANCQGTEQDWWRVPWSMLGSAPEVSWVLARAEPSARLGTVGTGGRAGRGEKTPPSSSGSETRLRRGSSEKLKLDTVMKSLMTGTNLSLGSRTWRL

SEQ ID NO: 921555 - protein, 150 aa, Homo sapiens; identical to SEQ ID NO: 921554

SEQ ID NO: 921556 - protein, 150 aa, Homo sapiens; identical to SEQ ID NO: 921554

SEQ ID NO: 921557 - protein, 150 aa, Homo sapiens; identical to SEQ ID NO: 921554

SEQ ID NO: 921558 - protein, 180 aa, Homo sapiens
MSKLRWLVAGSGVGWGCQLLTRQKERLVQRSCGSHRLGGFKEAQESQVAQESQVAGDPEGRQKEMRVIVPSSGLCSQLRKPQLCPTCSASEGRGSLEVGAQDPDSDISSATENSVTSGKSLLGSWAEDWNILWQAGGLSRDHQDPAHLVQTATASSFLQVTPTSHLTSQSLCFSPVKCVR

SEQ ID NO: 921559 - protein, 231 aa, Homo sapiens
MHTPACSVCALHMYQCACVCKSNCQCVMCMSVYVCVSAYVCKCVSVHVLHRKHDPVSAPGEASGSFYSWWKMKQEQIRKLRHRKVTQDYRGQHREQWNLHLTPGRRNLHDHTTPPQGTGRENNGSSRTKVTFPRVSCCLDLAAVSVLPRRGISMSSGQWQRGRGAPLQCAGWSTGSCQCEDLQQLVYPWSCHQLPEFGAAGATLVVLPCRGSSCLLVSESQLWGCNLKPKA

SEQ ID NO: 921560 - protein, 231 aa, Homo sapiens; identical to SEQ ID NO: 921559

SEQ ID NO: 921561 - protein, 429 aa, Homo sapiens
MGFLEEEGRWNLSFSGAGYLGAHHVGATECLRQRAPRLLQGARRIYGSSSGALNAVSIVCGKSVDFCCSHLLGMVGQLERLSLSILHPAYAPIEHVKQQLQDALPPDAHVLASQRLGISLTRWPDGRNFLVTDFATCDELIQALVCTLYFPFYCGLIPPEFRGERYIDGALSNNLPFADCPSTITVSPFHGTVDICPQSTSPNLHELNVFNFSFQISTENFFLGLICLIPPSLEVVADNCRQGYLDALRFLERRGLTKEPVLWTLVSKEPPAPADGNWDAGCDQRWKGGLSLNWKVPHVQVKDVPNFEQLSPELEAALKKACTRDPSRWARFWHSGPGQVLTYLLLPCTLPFEYIYFRSRRLVVWLPDVPADLWWMQGLLRNMALEVFSRTKAQLLGPISPPATRVLETSPLQPQIAPHREELGPTHQA

SEQ ID NO: 921562 - protein, 147 aa, Homo sapiens
MRLQGAIFVLLPHLGPILVWLFTRDHMSGWCEGPRMLSWCPFYKVLLLVQTAIYSVVGYASYLVWKDLGGGLGWPLALPLGLYAVQLTISWTVLVLFFTVHNPGLLTPGLYAQALLHLLLLYGLVNGNIERLDKYQKNPPSVHLHLL

SEQ ID NO: 921563 - protein, 354 aa, Homo sapiens
MELQKEISGPTSEKMFESFRGSSLRNEATPRYSQQEEARNERWQQSLSLERWPPCTSHPLGTPPLMPVTVASRSCVRAARALEGWGWGEFCRNLFAPPVGIRKRGLERPSGERAAQGHAGRTVLEITDRGTNSGETHPNQHHPGRPEAGFLCCFPRLRWAFLMVVGPLRLLASGDIPVDPVKLLGRSLRSPKPKHAREGSCFAKPRRLVSKTTVGTTVTGEAARASRMRIGCKFTDPSALCLPPPLKEQWPAPLLKALGIRKADRALQVNCKEEQRRILGGDHVTTRGTGLSHSKKSHEKTQASSLTWVRCSPVGQRAPVGALVLVCSGLRDSTLDENDPRMREQPRGTQADLS

SEQ ID NO: 921564 - protein, 518 aa, Homo sapiens
MCPQESSFQPSQFLLLVGVPVASVLLLAQCLRWHCPRRLLGACWTLNGQEEPVSQPTPQLENEVSRQHLPATLPEMVAFYQELHTPTQGQTMVRQLMHKLLVFSAREVDHRGGCLMLQDTGISLLIPPGAVAVGRQERVSLILVWDLSDAPSLSQAQGLVSPVVACGPHGASFLKPCTLTFKHCAEQPSHARTYSSNTTLLDAKVWRPLGRPGAHASRDECRIHLSHFSLYTCVLEAPVGREARKWLQLAVFCSPLVPGQSHLQLRIYFLNNTPCALQWALTNEQPHGGRLRGPCQLFDFNGARGDQCLKLTYISEGWENVDDSSCQLVPHLHIWHGKCPFRSFCFRRKAADENEDCSALTNEIIVTMHTFQDGLETKYMEILRFQASEEESWAAPPPVSQPPPCNRLPPELFEQLRMLLEPNSITGNDWRRLASHLGLCGMKIRFLSCQRSPAAAILELFEEQNGSLQELHYLMTVMERLDCASAIQNYLSGTHGGSPGPERGGARDNQGLELDEKL

SEQ ID NO: 921565 - protein, 518 aa, Homo sapiens; identical to SEQ ID NO: 921564

SEQ ID NO: 921566 - protein, 140 aa, Homo sapiens
MLRQGGALCGLNRGLQQTIAQRGLKPLMVPEKYNNNRNKHQTHKSSVQKAQSPRAPIVGALPSWTSTLIKNCLNPKGISLTAKLQALSLKLPLIGLRRHDLPGAHSFEIRGDPMTCSVCRSDESPPGRSIKDHSAYPFPL

SEQ ID NO: 921567 - protein, 185 aa, Homo sapiens
MEAAADGPAETQSPVEKDSPAKTQSPAQDTSIMSRNNADTGRVLALPEHKKKRKGNLPAESVKILRDWMYKHRFKAYPSEEEKQMLSEKTNLSLLRISNWFINARRRILPDMLQQRRNDPIIGHKTGKDAHATHLQSTEASVPAKSGPVVQTMYKACPCGPCQRARCQERSNQIRSRPLARSSPE

SEQ ID NO: 921568 - protein, 171 aa, Homo sapiens
PVVSQNRMHRTRGPDPEAVCPTEKHLHFLFLWTDKGYTGEEGGKVDTFGSGGWQQGPEGHVVGLGFQWEQCDRGRVGQRGCHRDRVGQQGNREDGFWIKLYYFRSSSSFTFSTDRGPIPIKRSPSSRNGGPPPTKSAPVTRSNSRMGGQDRRSDWIEADIPFHPVLLADSS

SEQ ID NO: 921569 - protein, 171 aa, Homo sapiens; identical to SEQ ID NO: 921568

SEQ ID NO: 921570 - protein, 167 aa, Homo sapiens
MSTCRFYEKRVSKMLKQKKHLKLWDECTHHKVVSQIASVEILCEGVSFSTISLKALKIFTCRFYKKRVSKLLSQRKVQLCRKALKMSTCRFYKKSVSKLHNHKKGSTLGDVCTHPDKFLRMFLSSSYIKAAERSKSQFADSTKKVFPNAQSKERFNYLRCTHTSQAL

SEQ ID NO: 921571 - protein, 167 aa, Homo sapiens; identical to SEQ ID NO: 921570

SEQ ID NO: 921572 - protein, 239 aa, Homo sapiens
MVQPQTSKAESPALAASPNAQMDDVIDTLTSLRLTNSALRREASTLRAEKANLTNMLESVMAELTLLRTRARIPGALQITPPISSITSNGTRPMTTPPTSLPEPFSGDPGRLAGFLMQMDRFMIFQASRFPGEAERVAFLVSRLTGEAEKWAIPHMQPDSPLRNNYQGFLAELRRTYKSPLRHARRAQIRKTSASNRAVRERQMLCRQLASAGTGPCPVHPASNGTSPAPALPARARNL

SEQ ID NO: 921573 - protein, 146 aa, Homo sapiens
VIICQSRKMMRLKPASLSEVPPEVVDVTANEIKDSDTPKGDLAHTLTRQSSTIGCLQAREEGSQQWLSTSLKSSKAGKLTVQPSVCGQRLESHWQTTVVSPRVQRPKISKTSDIEGQEEWKGYPAMEKESQEASLSHLPPALFLLP

SEQ ID NO: 921574 - protein, 139 aa, Homo sapiens
MGVWLCFFCVCVCVCLMKRSTPHQNKTKQKKKKRKKKTGICQCFIVLWPTKKETLSVLSSWPLEFTKNSVHCQAGSSGHETALLHRLGIYPGTYRMMLDVSWLSWGIHIATQPHYWIHFSGLPSPQMASETLFEPHLHL

SEQ ID NO: 921575 - protein, 275 aa, Homo sapiens
MVTFMLMQARVHNEAWCPEDSACTFQQPNERDPPQEECHADEMKQRLDYKEKDKHGCLLFILQELCSTSIEMGEQEFSYWWLKIFVVEVVEPDPEHRQEFNANAPPRKSPSLPSLRDFSVCNSHSHCDASKVSQSVLVPWAVTMTRQVQGGAVSSRIGLASNGCSYRAPTTFHQIVYSPVSDLIATHTLGPRIKSQHDGGVPPHYVKHLLGLEPNSVMKSQDDGGVNPDDRKYLLTYEQNLRNMDVSCGSLREDRQESTTKAPLWRSPSWPRSQD

SEQ ID NO: 921576 - protein, 275 aa, Homo sapiens; identical to SEQ ID NO: 921575

SEQ ID NO: 921577 - protein, 181 aa, Homo sapiens
SCPDSMPGVTGLPQAGAPDPQAKETANLSSSLLAGSPKCGWNQETGETNEGNRTIVFRWPPAQQINTQRLSNEQRKGLTFIHVTKGWEKQDLTKSLQTCRNSYKNSYTSRTKNDGMGREFQEDTDKNLFLLSLFLEPISSGPLPGLAGNVITAVAGLWSESAWSGKDLFFFLLVFLIFPAS

SEQ ID NO: 921578 - protein, 172 aa, Homo sapiens
SCPDSMPGVTGLPQAGAPDPQAKETANLSSSLLAGSPKCGWNQETGETNEGNRTIVFRWPPAQQINTQRLSNEQRKGLTFIHVTKGWEKQDLTKSLQTCRNSYKNSYTSRTKNDGMGREFQEDTDKNLFLLSLFLEPISSGPLPGLAEESSRTKLEAEGVNLNLWTDSSWKP

SEQ ID NO: 921579 - protein, 154 aa, Homo sapiens
VHVLFRDMNGAGNNYSQQANTGTEKQTLPILMHKWEWNNEDTMGPESMPKALGTLGPWKKGGSGVGGGGIWSHCPSGSHCCSPWMAWSLSLQQNQQAFRKQLPPEGARSLRTEHAEPANKLSEEQGVLTVPRIALPSPQDTPERGRGFRVPGDT

SEQ ID NO: 921580 - protein, 145 aa, Homo sapiens
CRSGYRTGQVMAQSQFPRGQGKVLSHDVPLWHPSQESCQNVGSHGQPTDRRSSGVSRIGGFLVSLTSRMKPRTLTWLRGLAGSGVKLQTFAVSVTAHKSKCGPKEFIAKNERTKLPQCGKGPEGVANAGSGSLLLFSYLTQPTSC

SEQ ID NO: 921581 - protein, 165 aa, Homo sapiens
MWCSWRSLPESGAFSSCGVCFPFKLQKSLKRPCVAAVAALRLVLPPLPSTALPASTHSCAPGKQPGASRGREPSQTGSAACRLDVLPPQHAMLARLEGGLQILGKSGPVIGKYMGTKPNPHSDPMGTAAGTRPLCNSGCTTSEGPSDPMCHWRYYMWAGSSGCFS

SEQ ID NO: 921582 - protein, 629 aa, Homo sapiens
MVFANRTLVVKSMTDKDAGDYLCVARNKVGDDCVVLKVDVMMKPAKIEHKEENDHKVFYRGDLKVDCVATGLPNPEISWSLLDGSLVNSFMQSDDSGGRTKHYVVFNNGTLYFSEVGMREEGDYTCFAENQVGKDEMRVRVKMVTPATIWNKTYLAVQVPYGDVVTVTCEAKGEPMPKVTWLSPANRVIPTSSEKYQIYQYGTLLIQKAQCSDSGNYTCLVRNSAGEDRKTVWIHVNLQPPKINGNPNPITTVWEIAAGGSRKLIDCKAEGIPTPRVLWAFPEGVVLPDPYYGNRITVHGNGSLDIRSLRKSDSVQLVCMARNEGGEARLIVQLTVLEPMEKPIFHDPISEKITAMAGHTISLNCSAAGTLTPSLVWVLPNGTDLQSGQQLQRFYHKADGMLHISGLSSVDAGAYRCVARNAAGHTERLVSLKVGLKPEANKQYHNLVSIINGETLKLPCTPPAAGQGHFSWTLPNGMHLEGPQTLGRVSLLDNGTLTVREASVFDRGTYVCRMETAYGPSVTSIPVIVIAYPPRITSEPTPVIYTRPGNTVKLNCMAMGIPKGDITWELPDKLHLKAGVQARLYGNRFLHPQGSLTIQQARRRDAGFYKCTAKNILSSDSKTTYIHVF

SEQ ID NO: 921583 - protein, 345 aa, Homo sapiens
MVFANRTLVVKSMTDKDAGDYLCVARNKVGDDCVVLKVDVMMKPAKIEHKEENDHKVFYRGDLKVDCVATGLPNPEISWSLLDGSLVNSFMQSDDSGGRTKHYVVFNNGTLYFSEVGMREEGDYTCFAENQVGKDEMRVRVKMVTPATIWNKTYLAVQVPYGDVVTVTCEAKGEPMPKVTWLSPANRVIPTSSEKYQIYQYGTLLIQKAQCSDSGNYTCLVRNSAGEDRKTVWIHVNLQPPKINGNPNPITTVWEIAAGGSRKLIDCKAEGIPTPRVLWAFPEGVVLPDPYYGNRITVHGNGSLDIRSLRKSDSVQLVCMARNEGGEARWADHEVRRSRPSWLTW

SEQ ID NO: 921584 - protein, 2702 aa, Homo sapiens
VLLTSKMKLQTLVMCPECLPSGRFMFLFTSLMKLQTLLVRGLAHFLNEAADLTDVSSVSSFWQVHGLAHFKNEAAGLTDVSRVSSFWEFRGLPHFKNEAADLTDMSSVSSFWQVHGLAHFKNEAADFYDVSRVSFFWQVHGVAHFKNEAADLTDVSRDSSFWQFPGLPHFKNEAADFTDVSRVSVFWQVHGLAQFKNEAADISDVSRVTSFWQVHGVAHFKNQAADLTDVSRVSSFWQVRGLAHFFNEAADLTDVSRVSSFWQVRGLAHFTNEAADLTDVSSVSSFWQVHGLPHFKNEAADLTGPEFVSSDVSRVSSFWQFRGLPHFKNEAADLTGECYSTLRCYVQSLFLQMCPECLPSGRFMVLLTSLMKLQTLLVHGLPHFKNEAADLSDVSSVSSFWQVHGLPHFKNEAADLTDVSRVSSFWQVRGVAHFFNEATDLTDVSRVSSFWQFRGLPHFKNEAADLTGECYSTLRCYVQSFFLQMCPECLPSGRFMVLLTSRMKLQTLLVMLQHLKMFPEFLPSGRFVVLLTSLMKLQTLLMCPEFLPSGSFVVFLTSRMKPQTLVLSVTAQCLPSGRFMVLLTSRMKLQTLLMCPEFLPSGSFVVFLTSRMKLQTLVLSVCPGFLSSGRFIVLLTSRMKLPTFVMCPEFLPSWRFVVLFTSLMKLQTLPMCPECLPSGSFMVLLTSLMKLQTLLMCPEVLPSGRFMVLLTSRMKLQTLVMIPEFLPSCRFVVLLTSLMKLQTLLMCPEFLLSGSFVVFLTSRMKLQTLLMCPGFLSSGRFMVLLTSRMNLPTFSDMSSVSSFWQVHGLAHFKNEAADFYDVSRVSFFWQVHGVAHFKNEAADLTDVSRDSSFWQFPGLPHFKNEAADLSDVSRVSSFWQVRGLAHIFNEAADLTDVSRVSSFLQFRGLPHFKNEAADLTGHGLASSKNEAADLTDVSRVSSFLQVRGLAHFLNEAADLTDVSRVFSFWQVRGLAHFLNEAADLTDVSRVSSFLQVRGLAHFLNEAADLNDVSRVSSFWHVHGVAHFKNEAADFSVECYSTYRCYVQCLFLQMCPEFLPSCRFVFLLTSLMKLQTLLVRVLAHFFNEAAELTDVSRVSSFWQFRGLPHFKNEAADLSDVSRVSSFWQVRGLAHFFNEAADLTDVSRVSVFWQVHGLPHFKNEAADLSDVSRVSSFWQVRGLAHIFNEAADLTDVSRVSSFWQFRGLPHFKNEAADLSVECYSTVSSFWQVHGLAHFKNEAADLTDVSRISSFRQFRGLPHFKNEAADLSVECVSRVSVFWQVHRLAHFKNEAADLCDVSRVSSFWQVPGLAHFFNEAADLTDVSRVSSFWQFRGLPHFKNEAADLSVECYSTRFMVFLTSRMKLQTLLVRGVAHFFNEAADLTDVSRVSSFWQFRGLPHFKNEAADLTDVSRVSVFWQVHGLAHFKNEAADFSDVSRVASFWQVRGLAHFLNEAADLTDVSSVSSFWQVHGVAHLKNEAADLPDVSRVSSFLQVRGLAHFLNEAADLNDVSSVSSFWQVHGLAHFKNEAADLTDVSRVSSFWQFRGLPHFKNEAADLSVECYSTVSFFWQVHGLAHFKNEAADLTDVSRVSVFWQVHGLAHFQNEAADFSDVSRVSSFWQVRGLAHFLNEAADLTDVSSVSSFWQVHGVAHFKNEAADLTDVSRVSSFLQVRGLAHFLNEAVDLNGECYSTSRCYVQSFFLQMCPECLPSGRFMVLLTSLTKLQTLLVRGLAHFLNEAADLNDVSRVSVFWQVHGLAHFKNEAAELSDVSRVSSFLQVRGLAHFLNEAADLTDVSSVSSFWQVHGLAHFKNEAAGLTDVSRVSSFWEFRGLPHFKNEAADLTDMSSVSSFWQVHGLAHFKNEAADFYDVSRDSSFWQFPGLPHFKNEAADFTDVSRVSSFWHVHGLAHFTNEAADLTDVSRVYSFLQVRGLAHFLNEAADLTDVSRVCVFWQVHGLAHFKNEAADLSEFVPSDVSRVSSFWQLHGLAHFTNEAADLTDVSRVYSFLQVLGLAHFLNEAADLTDVSRVSVFWQFHGLAHFKNEAADLSDVSRVSSFLQVRGLAHFLNEAADLTDVSSVSSFWQVDCLAHFKNEAADLTDVSRVSSFWQVRDLAHFFNEAADLTDVSRVSSFWQFLGLPHFKNEAADITEFVPSRVSRVSSFWQVRGLAHFFNEAADLTDVSRVSSFWQFRGLPHFKNEAADLTGECYSTYSCYVQSLFLRMCPECLPSGRFMVFLTSLMKLQTLLVRGLAHFLNEAADLTEFVPSDVSRVSSFWQVRGLAHFFNEAADLNDVSRVSSFWQFRGLPHFKNEAADITDVSRVSSFWQVHGVAHFKNEAADLTGISRVSSFWQVRGLPHFFNEAADLTDVSRVSSFWQFRGLPHFKNEAADLTDVSRVSVFWHVHGLAHFKNEAADLSDVSRVSSFLQVRGLAHFLNEAADLTDVSSLSSFWQVHGLAHFKNEAADLTDVSRVSSFWQVRGLAHFFNEAADLTDVSRVSSFWQFRGLPHFKNEAADITDASRVSSFWQVHGVAHFKNEAADLTGFSRVSSFWQVRGLAHFFNEAADLTDVSRVSSFWQFRGLPHFKNEAADLTDVSRVSSFWQVRGLAHFKNDAADLSGECFNTKRCYVQSLFLQKYPGFLPSGRFMVLLTLRMKLQTLLVHGLVHFKNEAADLSDVSRVSSFWQVHGLSHFKNEAADLTGLLILR

SEQ ID NO: 921585 - protein, 150 aa, Homo sapiens
MLLLVYKRAEYFREFSLILTHCLQEYTLVMATLENYLASFTKIIHMHTINPAISFLELSPAKMCTRVYQKICTKMFITALFIVVQLEVALIGKQLRSRQGKTEPSLTREAETVVAQLIEKVLEHGVNSTAWVARQLEEGSNWITGFVSGK

SEQ ID NO: 921586 - protein, 188 aa, Homo sapiens
MPKHEQNYSSHKPCGHLLWEISCAQCLSSSTPVLLAATLHLMGNTLELMGNEAHNNRKCCNIVCAAFSPLYIQHFESTQDQELSSFCLLGSTLDPIVFSTLLRGPHRVCLWQHPKAFTLAPVPAHLYAPSYILWHAADPTEWHSPLPVPVWPLQIQKPDLFLIPGSSYSFRLLAGNKALKLNLLLVPS

SEQ ID NO: 921587 - protein, 223 aa, Homo sapiens
VLTTRQLTQSVTQETASVIMRVPQVEETVKANAKQGRYSHSPAPASRECLVQMTTGIWQAETEFTESLDRAVSVFQADDEEDPSCSHRTGSGNVPALVTGWMEDRANVDVRLCIEIRSRIKVMERVHIRVIAKTLGGAAVHLQDSRYWVMVSMTDVASASRDHTGESNPGQRVTKVRVGECGTTLKDTWLLLRNPHGPALPGKKLKLLSSNTQLAFLIFYRKS

SEQ ID NO: 921588 - protein, 205 aa, Homo sapiens
MVPASASGELSKLSVVVEGKAGPDNSWQEREHKRGDELAAAVVGFTGIDCHLVGEESYIFADSISEMRHCPPSLSSALFCVLLCSWHQIHTLHHSENESPFQNPQGIPRSHSGHIDFSHTFMLASILVRAIERQYLLYPQSLHFQALPREGRCGMNARQISLEPAAKNECGMEKESTKGQCDNKKSNFILQLVQAIPKVDLRWYN

SEQ ID NO: 921589 - protein, 144 aa, Homo sapiens
HFAFPKTMKEKKNQRQKCGISNNELESMEAGEDGNIPGWEKFPERVSRKVWSGPVSGLETISEIHMASEAVVMGDVTPKRGQSHKEKDEKQTNRGGPSRAQTNASLSAFLNTVSYFSCSHFPHNFTGLRFLSPTRIYLDNSPIY

SEQ ID NO: 921590 - protein, 228 aa, Homo sapiens
AIVDSPFMVAKMCPELVPTSGLLVSLTSRMKLQTLTIPSFYGHALVLHHNCQKDWTDPPQMTELKGAKVLFVLQWIQTKALYPLYGLHSKDGLGIQMSFIDKEWISRVLSQQCWHRHYSGLRGSNNSESVTLLSLDALHLMPHDLRQIDVLADSLQIWKTADDWKFLQVKISQMNLQSKPAPPTQKDKRTDPLFSSRLSVYILQPPQRSEQIIILPLTKKNNAFLYIY

SEQ ID NO: 921591 - protein, 152 aa, Homo sapiens
MSPPIAEQIIRSLKLIMGLDGTTQATEPQPIHCSRSQKSELFRWLPIYPSHEVSSPCSLSPACPLPPCSMDPAPSKATPASFPITICPNPTLCSFYSSRCTSTLTCFLSKTACGPSTPRDFCMTCLLHSNKPQVLLLVQGPAFENHCCIMTL

SEQ ID NO: 921592 - protein, 140 aa, Homo sapiens
MRDCHIFLSICEEEQVIRDKNKQSNLKDQPSEYEGFTLFVIKIKPHTILDALFTYSSTLFATNRLSILCEASHFFPAGGNHFSEDAKQGQIPHSPRLLISGGLSSPGAGKQNHKPTVACWMFLNGFSIFKIQEEFHGHTF

SEQ ID NO: 921593 - protein, 159 aa, Homo sapiens
MPSSYPFVKGHDQVTPRFLEDDHLWLETHHPPLWEHQDQMPSKQAAATKGAVQQFLLPRQFGSAFHPIQPQFLLILSGFPMIPCDPENPCGKFPSGLRGKGGRVDWRDVMWEEPNPYCWFEDVGRGPEPRDAVVSRRWGWPSAYSQQANGDHSPTTTRN

SEQ ID NO: 921594 - protein, 164 aa, Homo sapiens
SSGDPVMGLSSRADICRKESEDLAMGPIPKTDAMLPARGLSSHKLSTAAAAEISSKDTEIMTKKQGTINIYQADLKNNHTDVLKVKNITAWVTEQDPISKKRGDERRGEERRGKERKREGRKEERKEKGRKGRKEKRKEKKILMDNLQQPPSPSAFACFTLHFY

SEQ ID NO: 921595 - protein, 681 aa, Homo sapiens
AGMGPKRRQLTFREKSRIIQEVEENPDLRKGEIARRFNIPPSTLSTILKNKRAILASERKYGVASTCRKTNKLSPYDKLEGLLIAWFQQIRAAGLPVKGIILKEKALRIAEELGMDDFTASNGWLDRFRRRHGVVSCSGVARARARNAAPRTPAAPASPAAVPSEGSGGSTTGWRAREEQPPSVAEGYASQDVFSATETSLWYDFLPDQAAGLCGGDGRPRQATQRLSVLLCANADGSEKLPPLVAGKSAKPRAGQAGLPCDYTANSKGGVTTQALAKYLKALDTRMAAESRRVLLLAGRLAAQSLDTSGLRHVQLAFFPPGTVHPLERGVVQQVKGHYRQAMLLKAMAALEGQDPSGLQLGLTEALHFVAAAWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQEPAPPSLPLLTEALRPQQFQPREGLGLSMAGSSGPQTGFPTSPEAGTSLLCFLPIPGPPLPPSFSSPTLGMLMGEYPVHLLSLACPGYGP

SEQ ID NO: 921596 - protein, 601 aa, Homo sapiens
AGMGPKRRQLTFREKSRIIQEVEENPDLRKGEIARRFNIPPSTLSTILKNKRAILASERKYGVASTCRKTNKLSPYDKLEGLLIAWFQQIRAAGLPVKGIILKEKALRIAEELGMDDFTASNGWLDRFRRRHGVVSCSGVARARARNAAPRTPAAPASPAAVPSEGSGGSTTGWRAREEQPPSVAEGYASQDVFSATETSLWYDFLPDQAAGLCGGDGRPRQATQRLSVLLCANADGSEKLPPLVAGKSAKPRAGQAGLPCDYTANSKGGVTTQALAKYLKALDTRMAAESRRVLLLAGRLAAQSLDTSGLRHVQLAFFPPGTVHPLERGVVQQVKGHYRQAMLLKAMAALEGQDPSGLQLGLTEALHFVAAAWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 921597 - protein, 601 aa, Homo sapiens; identical to SEQ ID NO: 921596

SEQ ID NO: 921598 - protein, 148 aa, Homo sapiens
RLGRRLGLNRPREESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 921599 - protein, 134 aa, Homo sapiens
RLGRRLGLNRPRRGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 921600 - protein, 601 aa, Homo sapiens; identical to SEQ ID NO: 921596

SEQ ID NO: 921601 - protein, 603 aa, Homo sapiens
AGMGPKRRQLTFREKSRIIQEVEENPDLRKGEIARRFNIPPSTLSTILKNKRAILASERKYGVASTCRKTNKLSPYDKLEGLLIAWFQQIRAAGLPVKGIILKEKALRIAEELGMDDFTASNGWLDRFRRRHGVVSCSGVARARARNAAPRTPAAPASPAAVPSEGSGGSTTGWRAREEQPPSVAEGYASQDVFSATETSLWYDFLPDQAAGLCGGDGRPRQATQRLSVLLCANADGSEKLPPLVAGKSAKPRAGQAGLPCDYTANSKGGVTTQALAKYLKALDTRMAAESRRVLLLAGRLAAQSLDTSGLRHVQLAFFPPGTVHPLERGVVQQVKGHYRQAMLLKAMAALEGQDPSGLQLGLTEALHFVAAAWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQDWRFPRGPPPWK

SEQ ID NO: 921602 - protein, 239 aa, Homo sapiens
MVEAGVYRRGRWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 921603 - protein, 601 aa, Homo sapiens; identical to SEQ ID NO: 921596

SEQ ID NO: 921604 - protein, 130 aa, Homo sapiens
MEIGRVFGKGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 921605 - protein, 601 aa, Homo sapiens; identical to SEQ ID NO: 921596

SEQ ID NO: 921606 - protein, 597 aa, Homo sapiens
AGMGPKRRQLTFREKSRIIQEVEENPDLRKGEIARRFNIPPSTLSTILKNKRAILASERKYGVASTCRKTNKLSPYDKLEGLLIAWFQQIRAAGLPVKGIILKEKALRIAEELGMDDFTASNGWLDRFRRRHGVVSCSGVARARARNAAPRTPAAPASPAAVPSEGSGGSTTGWRAREEQPPSVAEGYASQDVFSATETSLWYDFLPDQAAGLCGGDGRPRQATQRLSVLLCANADGSEKLPPLVAGKSAKPRAGQAGLPCDYTANSKGGVTTQALAKYLKALDTRMAAESRRVLLLAGRLAAQSLDTSGLRHVQLAFFPPGTVHPLERGVVQQVKGHYRQAMLLKAMAALEGQDPSGLQLGLTEALHFVAAAWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVIHGYVPASRHAGTV

SEQ ID NO: 921607 - protein, 178 aa, Homo sapiens
HFPCSSKRRWILSCGLCMVLNIIMAKPYEFNWQKEVPSFLQEGAVFDRYEESFFTFPDTFFLTVKHFLSLNLKKKTSKFKSLLILELFGSPFTSNSPTQTLLRSSLLHKPESQSMSLKHTKSKKSFILKKETAIIDKCSPTELSTMIEMVYICVAVMAATCGCSAFEMWLLGLRDLSF

SEQ ID NO: 921608 - protein, 363 aa, Homo sapiens
MLGCARRRKPWQRGGWKGEQRHCPRPHLLSCGKASKNMLQSSQLSPVTACFKEVTDEVSISTLPLASSNIQRRSLNHKHENAIPEGWSKSSNNLNVGSDTTSETSFSLSKEAPREHLDHQAAHQPFPRPRFRQETGHPSLQRDFPRSFLLDLPNFPDLSKADINGQNPNIQVTIEVVDGPDSEADKDQHPENKPSWSVPSPDWRAWWQRSLSLARANSGDQDYKYDSTSDDSNFLNPPRGWDHTAPGHRTFETKDQPEYDSTDGEGDWSLWSVCSVTCGNGNQKRTRSCGYACTATESRTCDRPNCPEKKKEKEEEEEKGKGMEEEKEEEEGEEEEEEEEAATKTICDPQNLKYVPSDPLKKA

SEQ ID NO: 921609 - protein, 179 aa, Homo sapiens
EDTAMPNWPRHQVWPCVSASKDPKPAWGCPIESVESPELLHRRPCPKAVAPSPLAALRPQPPPRAPASLWPLHSARGLCSNSHLHPHGGAAEETFLDQGQAQAQAQSCLSKRKGGATRWNGLAASVATPTWGPSPWSWRPRTASLGTLEGTPGTAWVGLSPARASVTLFPGQSRGSALN

SEQ ID NO: 921610 - protein, 179 aa, Homo sapiens; identical to SEQ ID NO: 921609

SEQ ID NO: 921611 - protein, 131 aa, Homo sapiens
CWEMVQNAFATLKILLRLILKQNAVVSATASGEGVLGHWNPPDLYRLQATDNFIRWADMNQGSGRDTLTLKDTTFPDAVFLVTKTVDFVLLILFFWLYSLTCSDKFCCHPESCTTERPTWQGTEGYLYCSL

SEQ ID NO: 921612 - protein, 220 aa, Homo sapiens
HLAIDWSGMINFILQRDNVDANDLKQFFETNYSQIYFIFYENFIALENSLKLKDMPKRSCTVLPLSEKIRCEGIRLFLLWLQALQTNCAEEQVLIFACLVPGFPAVMSSRGPCTLETLINPSPSVADVKIYPEEITPLLPAISGEKIAEDQTCFFLQILLKYMVIQAASLEWKNKENQDTGFKFLFTLFRKYYLPHLFPSFTKLTNIYKPVLGKYCWSRV

SEQ ID NO: 921613 - protein, 145 aa, Homo sapiens
MVSGHLGCALQQCDEGQLDADEPRPAFLTWLPGCCSQSSPSSQETWRVFSRESVQPKKKELKVLKSAVSQKHGPSGVSYSGAADAECGMRSSNTGGYRVAADSGKDLLHLAVQDVHCSTSDHAILFIFSVDDIEIERNQDNLEPL

SEQ ID NO: 921614 - protein, 144 aa, Homo sapiens
STIVEVGTRMKLEIIILSKLSQGQMRTGCPLLSLVFKIVLGIQARTIRQENDMKDIQIEKEEDTISNIKIRGFMYVNNELAKKEIKRVISFVIGKKYLGIYLTKEVKDLYKENCKAWVKEIEEDTYKWKGIPCTRIRRNLMLLK

SEQ ID NO: 921615 - protein, 164 aa, Homo sapiens
MAAATTEIELQVLQKENDYSRQKPADCKAKLQPFLNATIGNGGSVALGALRGAGDLTCEWFYPQSKGAGVFIHNFLPSLCFHKSDSALSLIDFAFQNEMTCLLSNIITDYDNNHSQQLVWSHNISPQMGFGGYVCDNENSNFPVQSKGSISLRNWSSLRAGTNG

SEQ ID NO: 921616 - protein, 164 aa, Homo sapiens; identical to SEQ ID NO: 921615

SEQ ID NO: 921617 - protein, 165 aa, Homo sapiens
MPTICWMLCGPWKTPAFNMVGVIPDTEITIKQQMAFVNIQLQCCKKEHERQDLETGLVWATWKAPGGSNIEQASHAGLACNYLQCGKKKNFHILTLKFSLRPVCQYINFNSDIGSTVSSSYVISGGLGGSACQGAGGFYCLPGGRDPPGLLKPQRQVFLEGENRT

SEQ ID NO: 921618 - protein, 225 aa, Homo sapiens [sequence omitted]

SEQ ID NO: 921619 - protein, 225 aa, Homo sapiens [sequence omitted]

SEQ ID NO: 921620 - protein, 166 aa, Homo sapiens
GGRREYDNMMPSFQIGSTEDTQTRIRFPGSRSQLSLPCSAPRAAGHLACQPKVLSWADFPLFTNRRRHSRMPCPVPDLGASPHPSLEKRAGARGGASPGGVAGWPARGAWRGGAARSRLTTCEPVRAPLGVCRPWGRSPSRRREHGRWEGALRPRPWEAGAGRCPD

SEQ ID NO: 921621 - protein, 178 aa, Homo sapiens
VVMSGVGHAGAQRAEPSSTAGTDTKPGPKEAWLPKWQATNHASPDPGWGSSVSEKNRKLGHTRFPPPGYLVSGNIYWTCWTHFLKNPLYPSGKPGKEQASNRYKSGGISQPLKLRFSAYPPLQLNHFEYSLMVQETVSLFPSLAFLCVRVPGVQWSLAGGNDSLDHGRPRSGQARKFL

SEQ ID NO: 921622 - protein, 95 aa, Homo sapiens
RHSNAKLGYPDPILYPGICRFMAKRPGPPGSREMESPACSGASLGEMTAWTMGARGLDKRGSFFKRITEELSDTTKTRPATSFEETTLLKSGYTE

SEQ ID NO: 921623 - protein, 139 aa, Homo sapiens
MDQRNEKLPTATLRAEIPSHIKLPDAKEHRSGAIASLELGRPPPPLGLLKQRAGRKVGEPEPREEQKARGGGGGTQEGGRGSGLVTAPPPRRLQSATAATEPRGASKASPGSRGLPWAFQTACAHFRGSPRGAVLWLHY

SEQ ID NO: 921624 - protein, 139 aa, Homo sapiens; identical to SEQ ID NO: 921623

SEQ ID NO: 921625 - protein, 138 aa, Homo sapiens
REDGKKEGSEEEKKQERKEEEKKRKREERKRKRATERERERKTDKGGRKGGTKRRRKERKKEPRKKGKKKGRKEKKEKRRKEGRKEARKKERKGGKERREGGREGRKEGSKEEGREGREEGGRTRHEQILLDLGQVGL

SEQ ID NO: 921626 - protein, 138 aa, Homo sapiens; identical to SEQ ID NO: 921625

SEQ ID NO: 921627 - protein, 138 aa, Homo sapiens
ALSQLWKLCCEWLRPEIHTKEQMLDLLLLELFLAILPEELLAWMHEYHPKNGEEAVVLLEVRKGPIHLGRTAWRGCPSWSFVGSLGIMYTVAPSDAQMSLLVLRFQPRPMCRKCFLFFLFFLFFFFLGGEKSFHLAPR

SEQ ID NO: 921628 - protein, 68 aa, Homo sapiens
ALSQLWKLCCEWLRPEIHTKEQMLDLLLLELFLAILPEELLAWMHEYHPKNGEEAVVLLEIMLSESIK

SEQ ID NO: 921629 - protein, 269 aa, Homo sapiens
MDPHQKVPSIYNGDTLQTPEYEKVSQYEDQLERHEGRHMEERRYKCNECGKKFAQSSGLVRHQRIHTGEKPYECDHYGKAFSVRSTLTVHERIHTGEKPYTCNECKKAFSVRAHLIIHQRIHNGEKPYECNECGKAFSVSSDLIKHQRIHTGEKPYECDECGKAFSVSSALIKHQRIHTGEKPYEYKECGKAFYVNSALINHQRIHSGEKPYECGECGKAFSQISTLIHHQRIHTGEKPYECEECGKAFHGSSNLTKHQKTHAKGKCHQ

SEQ ID NO: 921630 - protein, 269 aa, Homo sapiens; identical to SEQ ID NO: 921629

SEQ ID NO: 921631 - protein, 145 aa, Homo sapiens
RGRSTKVTASAAEETPALAMAEEKPKEGVKTENNDHINLKVAGQDGSVVQFKIKRHTPLSKLMKAYCERQGLSMRQIRFRFDGQPMKQTHLHSWKWRMKIQLMCSNSRREVSTEKGTCFFTPELCSLKTKITFSIRKLQFASTTS

SEQ ID NO: 921632 - protein, 402 aa, Homo sapiens
MYTSEEKCNQRTQKRKIYNVCPRKGKKIFIHMHEIIQIDGHIYQCLECKQNFCENLALIMCERTHTGEKPYKCDMCEKTFVQSSDLTSHQRIHNYEKPYKCSKCEKSFWHHLALSGHQRTHAGKKFYTCDICGKNFGQSSDLLVHQRSHTGEKPYLCSECDKCFSRSTNLIRHRRTHTGEKPFKCLECEKAFSGKSDLISHQRTHTGERPYKCNKCEKSYRHRSAFIVHKRVHTGEKPYKCGACEKCFGQKSDLIVHQRVHTGEKPYKCLECMRSFTRSANLIRHQATHTHTFKCLEYEKSFNCSSDLIVHQRIHMEEKPHQWSACESGFLLGMDFVAQQKMRTQTEELHYKYTVCDKSFHQSSALLQHQTVHIGEKPFVCNVSEKGLELSPPHASEASQMS

SEQ ID NO: 921633 - protein, 402 aa, Homo sapiens; identical to SEQ ID NO: 921632

SEQ ID NO: 921634 - protein, 174 aa, Homo sapiens
MADLVSIKLFLYCNVVVFLGAVDRKDSLGSYTPIPTMVGFFLLGKPPAVGNTALLFLSTQTKNGIGLSRSLSCWFCHWVKAKLELQHQSYAIKWSCWHLKYSNCGSFKKGQHLMGQVGLNKKMSGVGAATGKKKSECQPRRRLWGWSEQATHPVRVRRGCDTPHQIQTGPRPEL

SEQ ID NO: 921635 - protein, 1453 aa, Homo sapiens
KLGMEAVSRVFPALAGQAPEEQGEIIKVKVKEEDHTWDQESALRRNLSYTRELSRQRFRQFCYQETPGPREALSQLRELCRQWLNPEIHTKEQILELLVLEQFLTILPEELQSWVREHNPESGEEVVTLLEDLERELDEPRQQSLLEADALKGICGEFGCIDPEWKYSGLCAILGFTIHGHFPTRCSWKNTSLAMTNYNYLYCLPNAPTCPQVSQGTYGQEVSMEEMIPLDSAKESLGTQLQSMEDRMECESPEPHPLQDNDDLNLVVHYCYRTKRVHLPGTGKPNIHINRRKEGIYLQSVKQGELVPSKLRPSFPNGSFLWFSMMSQSMGGDNLSSLDTNEAEIEPENMREKFFRSLARLLENKSNNTKIFSKAKYCQLIKEVKEAKAKAKKESVDYRRLARFDVILVQGNEKLIEAVNGETDKIRYYLHSEDLFDILHNTHLSIGHGGRTRMEKELQAKYKNITKEVIMLYLTLCKPCQQKNSKLKKVLTSKSIKEVSSRCQVDLIDMQLNPDGEYRFILHYQDLCTKLTFLRSLKSKRPTEVAHALLDIFTIIGAPSVLQSDNGREFSSQVVSELSNIWPELKIVHGKSQTCQSQSSAEQTEDIRKRIFSWMQTNNSSHWTEFLWFIQMSQNQPYHRSMQQTPCESAFSSEAKLGLSHSQLTEELVASLHTENELDQADKELENTLRAQYEENIETGTDSSDIEENLSVTPKVAEKSPPESRLRFLSCVVCEKECTGVNSCISCDGNIHAICGVPSQHGTEGCGRQITCSLCYETSTMKRKHDEIQRSLPVKPSKMLKPSGTPFSPDKVGDWMAKQASLDFFVKKRHAFSEHSSSNKRNVNNRSYPEEGKTKRVHASFTRKYDPSYIEFGFVAVIDGEVLKPQCIICGDVLANEAMKPSKLKRHLYSKHKEISSQPKEFFERKSSELKSQPKQVFNVSHINISALRASYKVALPVAKSKTPYTIAETLVKDCIKEVCLEMLGESAAKKVAQVPLSNDTIARRIQELANDMEDQLIEQIKLAKYFSLQLDECRDIANMIILLVYVRFEHDDDIKEEFFFSASLPTNTTSSELYEAVKNYIVNKCGLEFKFCVGVCSDGAASMTGKHSEVVTQIKELAPECKTTHCFIHRESLAMKKISAELNSVLNDIVKIVNYIKSNSLNSRLFSLLCDNMEADHKQLLLHAEIRWLSRGKVLSRMFEIRNELLVFLQGKKPMWSQLFKDVNWTARLAYLSDIFSIFNDLNASMQGKNATYFSMADKVEGQKQKLEAWKNRISTDCYDMFHNLTTIINEVGNDLDIAHLRKVISEHLTNLLECFEFYFPSKEDPRIGNLWIQNPFLSSKDNLNLTVTLQDKLLKLATDEGLKISFENTASLPSFWIKAKNDYPELAEIALKLLLLFPSTYLCETGFSTLSVIKTKHRNSLNIHYPLRVALSSIQPRLDKLTSKKQAHLSH

SEQ ID NO: 921636 - protein, 1397 aa, Homo sapiens
KLGMEAVSRVFPALAGQAPEEQGEIIKVKVKEEDHTWDQESALRRNLSYTRELSRQRFRQFCYQETPGPREALSQLRELCRQWLNPEIHTKEQILELLVLEQFLTILPEELQSWVREHNPESGEEVVTLLEDLERELDEPRQQSLLEADALKGICGEFGCIDPEWKYSGLCAILGFTIHGHFPTRCSWKNTSLAMTNYNYLYCLPNAPTCPQVSQGTYGQEVSMEEMIPLDSAKESLGTQLQSMEDRMECESPEPHPLQDNGSFLWFSMMSQSMGGDNLSSLDTNEAEIEPENMREKFFRSLARLLENKSNNTKIFSKAKYCQLIKEVKEAKAKAKKESVDYRRLARFDVILVQGNEKLIEAVNGETDKIRYYLHSEDLFDILHNTHLSIGHGGRTRMEKELQAKYKNITKEVIMLYLTLCKPCQQKNSKLKKVLTSKSIKEVSSRCQVDLIDMQLNPDGEYRFILHYQDLCTKLTFLRSLKSKRPTEVAHALLDIFTIIGAPSVLQSDNGREFSSQVVSELSNIWPELKIVHGKSQTCQSQSSAEQTEDIRKRIFSWMQTNNSSHWTEFLWFIQMSQNQPYHRSMQQTPCESAFSSEAKLGLSHSQLTEELVASLHTENELDQADKELENTLRAQYEENIETGTDSSDIEENLSVTPKVAEKSPPESRLRFLSCVVCEKECTGVNSCISCDGNIHAICGVPSQHGTEGCGRQITCSLCYETSTMKRKHDEIQRSLPVKPSKMLKPSGTPFSPDKVGDWMAKQASLDFFVKKRHAFSEHSSSNKRNVNNRSYPEEGKTKRVHASFTRKYDPSYIEFGFVAVIDGEVLKPQCIICGDVLANEAMKPSKLKRHLYSKHKEISSQPKEFFERKSSELKSQPKQVFNVSHINISALRASYKVALPVAKSKTPYTIAETLVKDCIKEVCLEMLGESAAKKVAQVPLSNDTIARRIQELANDMEDQLIEQIKLAKYFSLQLDECRDIANMIILLVYVRFEHDDDIKEEFFFSASLPTNTTSSELYEAVKNYIVNKCGLEFKFCVGVCSDGAASMTGKHSEVVTQIKELAPECKTTHCFIHRESLAMKKISAELNSVLNDIVKIVNYIKSNSLNSRLFSLLCDNMEADHKQLLLHAEIRWLSRGKVLSRMFEIRNELLVFLQGKKPMWSQLFKDVNWTARLAYLSDIFSIFNDLNASMQGKNATYFSMADKVEGQKQKLEAWKNRISTDCYDMFHNLTTIINEVGNDLDIAHLRKVISEHLTNLLECFEFYFPSKEDPRIGNLWIQNPFLSSKDNLNLTVTLQDKLLKLATDEGLKISFENTASLPSFWIKAKNDYPELAEIALKLLLLFPSTYLCETGFSTLSVIKTKHRNSLNIHYPLRVALSSIQPRLDKLTSKKQAHLSH

SEQ ID NO: 921637 - protein, 208 aa, Homo sapiens
RLSQIPVSRMATCVLLECLMRDAKCLNFLTLPVRPLPQTHMIHHSVSDYKATLRCWALGFYPVEITLAWQQDGEDQTRDMELLETRPAGDGTFQKWAAVVVPSGEEQRYPCHVQHEGLPKPLTLRWEQSSQPTIPIVGIVAGLVLLGAVVTGAVVSAVMCRKKNSGSDHAQGSDVSLTACKVGAQATVRFMWSLLSWVIFAALLSLAV

SEQ ID NO: 921638 - protein, 160 aa, Homo sapiens
MEHVKQAEIDKHNCEFFASPPIRRPSGFHQLYLQFNPRLHTQFRGGKIAATFSVLDLQLQGTVSRMLRTECLVVSGEDSVREPPPFTLLPARRGPGPVLGEFFSPAGRLDAVDTRDPSPPGLLALEGFPDVAVGELGFHVAAGAFRKSIRAASFSLSPNP

SEQ ID NO: 921639 - protein, 423 aa, Homo sapiens
MAVMAPRTLLLLLSGALALTQTWAGPGEPRRDEGRAGLSHCSPPGSHSMRYFFTSVSRPGRGEPRFIAVGYVDDTQFVRFDSDAASQRMEPRAPWIEQEGPEYWDQETRNVKAQSQTDRVDLGTLRGYYNQSEAVSGSEIHPEAAGPRDPCPGRGPGAFTRFHFQFRPKIPPGWSGLGGARGTGLTAGSGPGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSGGEGVKGGV

SEQ ID NO: 921640 - protein, 141 aa, Homo sapiens
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHYKLNNGHLSLFLLLHPVLDPCLAFLCIF

SEQ ID NO: 921641 - protein, 153 aa, Homo sapiens
MVCVARAIACGEKGQAGFSRFHLFGQFLLRAGSRARGATAPKVHFIIQRTQMQGIWVAFSMSLRLAENLSKDLEQSLNSFRLGFNCAKRTNCAKAIKVCFALSGIHPQSWSLPGRARGYKAVQHVAELNTVGNCNTVVFVYPNIRKLLQGADP

SEQ ID NO: 921642 - protein, 153 aa, Homo sapiens; identical to SEQ ID NO: 921641

SEQ ID NO: 921643 - protein, 405 aa, Homo sapiens
MNLKPRHNLDTDDIYTLNVFQIGGFELNQSINTNQTVSEELEFSGSAMESLRGNTAQGPTNEEDYKNEGQLSRQTKCPAQKKSSFENTVVRKVSVTLKEIFTGEEGPESSEFSLSPNLDAQQKIPKGHGSPISRKNSKDNSDLIKHQRLFSQRKPCKCNECEKAFSYQSDLLVHSRIHGGEKPFECNKCGKSFSRSTHLIEHQRTHTGEKPYECNECGKAFSRSTHLSLHQRIHTGEKPYECSECGKAFSRSTNLSQHQRTHTQERPYKCNECGKAFGDRSTIIQHQRIHTGENPYECSKCGKAFSWISSLTEHQRTHTGENPYECSECGKVFSRSSSLTEHQRIHSGEKPHECRVCGKGFSRSSSLIIHQRTHTGEKPYKCNDCGKAFCQSSTLIRHQHLHTKE

SEQ ID NO: 921644 - protein, 125 aa, Homo sapiens
MISSSLSGRVPVILGNLMGVGAAVRRMGFSLILPTSPSPAHSGSAPSAGPARGVSGVLGRRRPVSEAYRAPGPRWVLLEVLEGGNTGSSRETGERVAGGLAAGRVRRHLHGWDAAWRGVMKPLSP

SEQ ID NO: 921645 - protein, 351 aa, Homo sapiens
KNHQVQKHQQPCHLQRGLLISNTDLTWEFLTNAEYLHPILHLQRSEDNIVRDAHSSLCQCFLRSLQLVLSGTSGNLERQPAGRRGNRCTDPASQHTQSAVAASKTAVPPNQAPDAVARACNPSSPGGWGRRIVGARGFGATALCGAGVRTGPGTNMVLPGEPGSTRLSKEGGTRPRPDTEQVKLPVLGDGGTAPASNACSSARDIRRDPGMMIHSVSGSRKKLSSLQDGAADIDKEAGNLHGGRLAAAPIEKVYLGETSLQFTGRASLYPFPRSRLCYDQGIVTPVTHTYTSRRSPGARKSGTTGKPQKKKNSSFTNFPNYSYGIATPSAVQILLVGAKQEVSEYESMTVH

SEQ ID NO: 921646 - protein, 170 aa, Homo sapiens
MQLRIRPRQEEGSPDWKRRGFDPRTGQVFSVAFITRMDSNPDIDLNVYLCVSPGLTLPRENGSVNLVRPRLLDSEGKVRRVKGTWSINSWNKRQRHGNLRGFQSGPGNDARGCKPFCPFLLPLKLTVSGRVFLEVGFRDRGDQRPELLCPKGIARFFDADRKGLAPEPTT

SEQ ID NO: 921647 - protein, 170 aa, Homo sapiens; identical to SEQ ID NO: 921646

SEQ ID NO: 921648 - protein, 170 aa, Homo sapiens; identical to SEQ ID NO: 921646

SEQ ID NO: 921649 - protein, 170 aa, Homo sapiens; identical to SEQ ID NO: 921646

SEQ ID NO: 921650 - protein, 276 aa, Homo sapiens
MPDPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKNQKLSLQLKMQSIWSNTSTSLELKSLKKEGRKNHHLPYCLLLLPQPRHYPGKDTKEETEDFPNSPPPINREEDKRYTTVMGPCLRQAALEGELLACPVMEDQQANWVHEPITFNTFKEIRKSIRENGPASPFTRGLIEVIADNYHIDSMGLVSAS

SEQ ID NO: 921651 - protein, 143 aa, Homo sapiens
MDGKDNLINKVKILNQPVRLVQFLEGQHQSSATKPRRSGKESVREPWGRVPGALGVAFGQAGQSDFEWGPAQIGHGLGGILGCGHSLAQWPDFRHLKQDPGGGGPGGMPGHCGLGGGKASKGCCQTSHGLGWVFIFDEKEPKR

SEQ ID NO: 921652 - protein, 162 aa, Homo sapiens
IPSESSDGLEFCPMKINKDSVAYTASLLFAQVVFPLWVVSPHLPSFSKCSPSGTRTNSHPIIQAITDNSKEASQKIKSRTTISSINLTNGYISKGNEIVQNINIWGKLYITQCSFHIMLTPFLYLSIYFKRHLLMQRRLNSEGSHSESCPQSVQFTPYPKER

SEQ ID NO: 921653 - protein, 744 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVSNKNEVVVTDFHNHSEKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 921654 - protein, 744 aa, Homo sapiens; identical to SEQ ID NO: 921653

SEQ ID NO: 921655 - protein, 665 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVSNKNEVVVTDFHNHSEKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 921656 - protein, 733 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVSNKNEVVVTDFHNHSEKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 921657 - protein, 658 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGSRGREKGEFTNLQGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVSNKNEVVVTDFHNHSEKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 921658 - protein, 740 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVSNKNEVVVTDFHNHSEKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 921659 - protein, 250 aa, Homo sapiens
MDASSVTFSTRRNAFLVSSVVRPYQVPVMGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVSNKNEVVVTDFHNHSEKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 921660 - protein, 181 aa, Homo sapiens
AHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGRESQMGQAQVVGGEGREVQDDL

SEQ ID NO: 921661 - protein, 202 aa, Homo sapiens
LPEVAIGSKAVVASISHHHTAIRGQCQALRNIQWHREMGSKKDRKEPELSNYQDAACRPSQPNGKLVGRFGGRGATDRHFAGPHFVAVSNKNEVVVTDFHNHSEKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 921662 - protein, 505 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVVPAASSGRKFISF

SEQ ID NO: 921663 - protein, 633 aa, Homo sapiens
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGIGGQLQDLC

SEQ ID NO: 921664 - protein, 772 aa, Homo sapiens
MSVRAAGGFFGLWLLTGWCEWREPSVGAMAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVSNKNEVVVTDFHNHSEKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 921665 - protein, 744 aa, Homo sapiens; identical to SEQ ID NO: 921653

SEQ ID NO: 921666 - protein, 858 aa, Homo sapiens
ALSSQSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 921667 - protein, 883 aa, Homo sapiens
ALSSQSSTQEIGEELINGVIYSISLRKVQLHHGGNKGQRWLGSSTQEIGEELINGVIYSISPRKLQLHHGGNKGQRWLGYENESALNLYETCKVRTVKAGTLEKLVEHLVPAFQGSDLSYVTIFLCTYRAFTTTQQVLDLLFKRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 921668 - protein, 810 aa, Homo sapiens
MPGRRTDPSWSLHSSEEGVLGDMQSCGRGFLGGGERCSPLTRGLLGSFSWTAKGAWAGAGGLQMDRGRLRSPAWLRGAQASDSAATHLSPGAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 921669 - protein, 786 aa, Homo sapiens
ALSSQSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 921670 - protein, 848 aa, Homo sapiens
ALSSQSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGEELQPLIMAVFFLVLRVLLADLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 921671 - protein, 203 aa, Homo sapiens
RRFPIWQLAWGAPTGQWDLLIFRLPQFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 921672 - protein, 858 aa, Homo sapiens; identical to SEQ ID NO: 921666

SEQ ID NO: 921673 - protein, 858 aa, Homo sapiens; identical to SEQ ID NO: 921666

SEQ ID NO: 921674 - protein, 582 aa, Homo sapiens
ALSSQSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETER

SEQ ID NO: 921675 - protein, 547 aa, Homo sapiens
ALSSQSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYVSVPGGAGVGPGRRDLP

SEQ ID NO: 921676 - protein, 123 aa, Homo sapiens
AGTTGRRVAWYTFCGFGERGFSGSRGCSVSLERHRKGWHVVELFSSCSSVTSASSKTNSRARASSNTSSSTQPSAGSSPGARASSNTSSRFRARSSSSTSSGAPAGSRASCGTRIGSSASSGT

SEQ ID NO: 921677 - protein, 582 aa, Homo sapiens
ALSSQSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKAVSHRTMQQAEFSSALSRGGGRLRKARPPAQDPTLEGTSKFATLEMNPKRAQKRPKETGIIQGTVPYLGTFLTDLVMLDTAMKDYLYVSVPGGAGVGPGRRDLP

SEQ ID NO: 921678 - protein, 836 aa, Homo sapiens
ALSSQSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRSKSEDQRAMAEGAGPHHSPAPGWKPLAPENSPAECG

SEQ ID NO: 921679 - protein, 115 aa, Homo sapiens
MAWCPACPRAPPLYTSLTPSQVWVTATCAHGHPRAPTVTTAVLSCPQALACDLRRGPGPSHHSSLSQAAPKIPSSGPTESEGVSPTAYPSPPLGAERETLFMDQTLHPVSEDSPS

SEQ ID NO: 921680 - protein, 858 aa, Homo sapiens; identical to SEQ ID NO: 921666

SEQ ID NO: 921681 - protein, 336 aa, Homo sapiens
GHWVSTFQGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 921682 - protein, 858 aa, Homo sapiens; identical to SEQ ID NO: 921666

SEQ ID NO: 921683 - protein, 895 aa, Homo sapiens
ALSSQSSTQEIGEELINGVIYSISLRKVQLHHGGNKGQRWLGSSTQEIGEELINGVIYSISPRKLQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 921684 - protein, 189 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 921685 - protein, 85 aa, Homo sapiens
ELGTPHAEGPYDVVVLPGGNLGAQNLSESAAVKEILKEQENRKGLIAAICAGPTALLAHEIGFGSKVTTHPLAKDKMMNGALLLL

SEQ ID NO: 921686 - protein, 189 aa, Homo sapiens; identical to SEQ ID NO: 921684

SEQ ID NO: 921687 - protein, 189 aa, Homo sapiens; identical to SEQ ID NO: 921684

SEQ ID NO: 921688 - protein, 189 aa, Homo sapiens; identical to SEQ ID NO: 921684

SEQ ID NO: 921689 - protein, 189 aa, Homo sapiens; identical to SEQ ID NO: 921684

SEQ ID NO: 921690 - protein, 189 aa, Homo sapiens; identical to SEQ ID NO: 921684

SEQ ID NO: 921691 - protein, 179 aa, Homo sapiens
EDPRYILPTGIPVDVMMRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 921692 - protein, 189 aa, Homo sapiens; identical to SEQ ID NO: 921684

SEQ ID NO: 921693 - protein, 220 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGDSGSHYVAQAVLKLLGSNDPPTLVSQSAGITGHYTYSENRVEKDGLILTSRGPGTSFEFALAIVEALNGKEVAAQVKAPLVLKD

SEQ ID NO: 921694 - protein, 100 aa, Homo sapiens
LIRLRQEGPEGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 921695 - protein, 171 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVELAIVEALNGKEVAAQVKAPLVLKD

SEQ ID NO: 921696 - protein, 171 aa, Homo sapiens; identical to SEQ ID NO: 921695

SEQ ID NO: 921697 - protein, 169 aa, Homo sapiens
MASKRALVILAKGAEEMETVIPVDVMRRAGIKVTVAGLAGKDPVQCSRDVVICPDASLEDAKKESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 921698 - protein, 168 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLFFIFKAGIRTNDHITATLYWVFSSQACNGDLNPSSPHDGQ

SEQ ID NO: 921699 - protein, 118 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAAYCSVAHRNRF

SEQ ID NO: 921700 - protein, 110 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGLH

SEQ ID NO: 921701 - protein, 158 aa, Homo sapiens
MASKRALVILAKGAEEMETVIPVDVMRRAGIKVTVAGLAGKDPVQCSRDVVICPDASLEDAKKERKEIILPLLLCSVDILACHYIQGPYDVVVLPGGNLGAQNLSESAAVKEILKEQENRKGLIAAICAEVTCRGSLCCSVIGGWGSLSFDGLIPNSS

SEQ ID NO: 921702 - protein, 100 aa, Homo sapiens
MASKRALVILAKGAEEMETVIPVDVMRRAGIKVTVAGLAGKDPVQCSRDVVICPDASLEDAKKEDQLIPLLMKKLLTTHPSIIYDNMSPYPLQFPAFPLK

SEQ ID NO: 921703 - protein, 72 aa, Homo sapiens
RPPTTTKFAAASTDKMMNGGHYTYSENRVEKDGLILTSRGPGTSFEFALAIVEALNGKEVAAQVKAPLVLKD

SEQ ID NO: 921704 - protein, 109 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGK

SEQ ID NO: 921705 - protein, 169 aa, Homo sapiens; identical to SEQ ID NO: 921697

SEQ ID NO: 921706 - protein, 103 aa, Homo sapiens
ILELDARKTPEALTRPATLVHGPTALLAHEIGFGSKVTTHPLAKDKMMNGGHYTYSENRVEKDGLILTSRGPGTSFEFALAIVEALNGKEVAAQVKAPLVLKD

SEQ ID NO: 921707 - protein, 171 aa, Homo sapiens; identical to SEQ ID NO: 921695

SEQ ID NO: 921708 - protein, 155 aa, Homo sapiens
MASKRALVILAKGAEEMETVIPVDVMRRAGGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 921709 - protein, 189 aa, Homo sapiens
GRLLLLNSRPRRQTKEKETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 921710 - protein, 189 aa, Homo sapiens; identical to SEQ ID NO: 921684

SEQ ID NO: 921711 - protein, 189 aa, Homo sapiens; identical to SEQ ID NO: 921684

SEQ ID NO: 921712 - protein, 189 aa, Homo sapiens; identical to SEQ ID NO: 921684

SEQ ID NO: 921713 - protein, 189 aa, Homo sapiens; identical to SEQ ID NO: 921684

SEQ ID NO: 921714 - protein, 189 aa, Homo sapiens; identical to SEQ ID NO: 921684

SEQ ID NO: 921715 - protein, 3719 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921716 - protein, 3471 aa, Homo sapiens
MMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921717 - protein, 2015 aa, Homo sapiens
RGHGVCTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921718 - protein, 3719 aa, Homo sapiens; identical to SEQ ID NO: 921715

SEQ ID NO: 921719 - protein, 3719 aa, Homo sapiens; identical to SEQ ID NO: 921715

SEQ ID NO: 921720 - protein, 3719 aa, Homo sapiens; identical to SEQ ID NO: 921715

SEQ ID NO: 921721 - protein, 3704 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921722 - protein, 3391 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRL

SEQ ID NO: 921723 - protein, 3810 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLPHLFLCIPFLLVFSGISVNLDYFEDISSVSGAFVCSQISTPFLGCPGTLCLPLHLTLHSPDTASQSLTHTNDWMYPGFSAQLFSASAFLCRYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921724 - protein, 3759 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTWASVTGARRSCREQKSKELSRGPITSDSENHLQVCTLAYGRVRPGCLRRSDRVRFLVLVPDGQFGSQIKGDILG

SEQ ID NO: 921725 - protein, 597 aa, Homo sapiens
MVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921726 - protein, 582 aa, Homo sapiens
MSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921727 - protein, 565 aa, Homo sapiens
MDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921728 - protein, 565 aa, Homo sapiens; identical to SEQ ID NO: 921727

SEQ ID NO: 921729 - protein, 3544 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVGQEILITAHPSQSGRSIPGSP

SEQ ID NO: 921730 - protein, 390 aa, Homo sapiens
RIPTTLGLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921731 - protein, 398 aa, Homo sapiens
RRIHPNIRLGTRPGVTRLCCQRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921732 - protein, 3220 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEVCSMPGC

SEQ ID NO: 921733 - protein, 3222 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMSESSQSEASVRREESPMDVDQPSPSAQDTQSIASDGTPQGEKEKEEREEDLAAVEGSLEPPLWEGISSGSARASALVAEPQGCPSPQTPPSKADPLSSL

SEQ ID NO: 921734 - protein, 2853 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAARPHAPDPVEY

SEQ ID NO: 921735 - protein, 2906 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAACDSEPRHNSGTGASSITTATSTTSTTTTTAASTTPTPPTDPQPVHTLNCDACCPRPLQCLLSQ

SEQ ID NO: 921736 - protein, 2815 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPFPCRP

SEQ ID NO: 921737 - protein, 1774 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSRREEEAG

SEQ ID NO: 921738 - protein, 1860 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDNPPTHRVCPSCPIFPSAYLFLFSFSPRRLFPHLLSPFHAVHDPHPMCFKKAVAFAGTCLSQLFEQCAPQILCSEGFAALRLETFG

SEQ ID NO: 921739 - protein, 1987 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAAKYK

SEQ ID NO: 921740 - protein, 538 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFDFVRVSFSQVREFEMGGVQEFPWHVY

SEQ ID NO: 921741 - protein, 291 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRPLKISNPGSMLNEMNVDTKQQLYEDVKC

SEQ ID NO: 921742 - protein, 127 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVVRFNTGQTE

SEQ ID NO: 921743 - protein, 304 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNR

SEQ ID NO: 921744 - protein, 341 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDKEQAL

SEQ ID NO: 921745 - protein, 1261 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTGKFRLLLALGY

SEQ ID NO: 921746 - protein, 1854 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLILSPPPVSSPSLPFPCRP

SEQ ID NO: 921747 - protein, 194 aa, Homo sapiens
KYTPKTVVIYSFGHNASDKLEVAEVVGVAVGRWIDGVVTRSPGEVRNKAYIGLNISREMINTTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921748 - protein, 2852 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASSLLSAART

SEQ ID NO: 921749 - protein, 213 aa, Homo sapiens
AGWYAPEVRDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921750 - protein, 3183 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIGQYYFLFPAEQKG

SEQ ID NO: 921751 - protein, 3354 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTQQASPDILSGAINAISQAAPNEKSSVERFTTGVKRNLGAQSHWWVGMQAGDTPPADNEYRQYPSRGVKGHRKNARTQASVKHRGTSARTGMHEEDSDEKI

SEQ ID NO: 921752 - protein, 3406 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPGSPGTSSIVSCIALLLKNRGQE

SEQ ID NO: 921753 - protein, 3609 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISDHRCQWWAVLMS

SEQ ID NO: 921754 - protein, 2972 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKSCGSGI

SEQ ID NO: 921755 - protein, 3309 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLETHRTVLNQILRQSTTHLADGPFAVLVDYIRVLDFDVKRKYFRQELERLDEGLRKEDMAVHVRRDHVFEDSYRELHRKSPEEMKNRL

SEQ ID NO: 921756 - protein, 3827 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTWASVTGARRSCREQKSKELSRVLISWICLPMRALRSSATCYCWLSRSALKALGWPNKALPNSVGFFLPLLDLGRGELKKEPERNCQKPINEIHQLTVCVPAAPSSPAHTCSSSHSLPAACFLTFSPLSMPSMIPTPCVLKRQ

SEQ ID NO: 921757 - protein, 3637 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921758 - protein, 3035 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFLRFRLS

SEQ ID NO: 921759 - protein, 3719 aa, Homo sapiens; identical to SEQ ID NO: 921715

SEQ ID NO: 921760 - protein, 3669 aa, Homo sapiens
ASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTHSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921761 - protein, 1992 aa, Homo sapiens
MDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921762 - protein, 3724 aa, Homo sapiens
ASNLGSAVDELMRHQPTLKTDATTAIIKLLEEICNLGRDPKYICQKPSIQKADGTATAPPPRSNHAAVVTDTILMGAERIVNSGESKLKVLTNEIYTEAILKIVAAERAYSYSADGIYIPFVCMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921763 - protein, 3404 aa, Homo sapiens
MQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 921764 - protein, 138 aa, Homo sapiens
LHFLVPCPSQHRAQQVASSQWRCEHACLWIIIASIIEQDSVKGTVPGSDRGKLRAAENATWGTGAAGGPGLSPRPGRAGSGRLGAAHADFWPGAIPQEPLQGRPAEEPILAPSAPSTGPPGRFPGLQAPPRGRRPPPY

SEQ ID NO: 921765 - protein, 1016 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 921766 - protein, 877 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQEEWRGHQQPLCPKWHFQLL

SEQ ID NO: 921767 - protein, 871 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGECLSFDSGGRSD

SEQ ID NO: 921768 - protein, 877 aa, Homo sapiens; identical to SEQ ID NO: 921766

SEQ ID NO: 921769 - protein, 889 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPAQGEQEWRGPAALCPSGFQRLNGRLTGGPERSVKRRK

SEQ ID NO: 921770 - protein, 557 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAEEPILAPSAPSTGPPGRFPGLQAPPRGRRPPPY

SEQ ID NO: 921771 - protein, 434 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQEATPQATPAWPPACLAWRTASTPPWALRRSRRRAGLGLLGG

SEQ ID NO: 921772 - protein, 118 aa, Homo sapiens
MLSLSPGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 921773 - protein, 1016 aa, Homo sapiens; identical to SEQ ID NO: 921765

SEQ ID NO: 921774 - protein, 919 aa, Homo sapiens
MRGEGSGQAAKEKTCGRGLSEGNWDGRAGLGLSCGAAASPGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 921775 - protein, 179 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPGACVGIAGGELTGEEKCLNERSGEWKRME

SEQ ID NO: 921776 - protein, 600 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNIMADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 921777 - protein, 419 aa, Homo sapiens
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEARELALQQEEGKTVMYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLLSVAPQQSLVLLEDVDAAFLSRDLAVENPVKYQGLGRLTFSGLLNALDGVASTEARIVFMTTNHVDRLDPALIRPGRVDLKEYVGYCSHWQLTQMFQRFYPGQAPSLAENFAEHVLRATNQISPAQVQGYFMLYKNDPVGAIHNAESLRR

SEQ ID NO: 921778 - protein, 419 aa, Homo sapiens; identical to SEQ ID NO: 921777

SEQ ID NO: 921779 - protein, 419 aa, Homo sapiens; identical to SEQ ID NO: 921777

SEQ ID NO: 921780 - protein, 419 aa, Homo sapiens; identical to SEQ ID NO: 921777

SEQ ID NO: 921781 - protein, 419 aa, Homo sapiens; identical to SEQ ID NO: 921777

SEQ ID NO: 921782 - protein, 419 aa, Homo sapiens; identical to SEQ ID NO: 921777

SEQ ID NO: 921783 - protein, 490 aa, Homo sapiens
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEGVGWHRQAFWDIAGMGTFDIQMSSLEKWNKQAGVSPWEQGARRKLFGTAPPNGRISHGEENYWLYLIFSFPARELALQQEEGKTVMYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLLSVAPQQSLVLLEDVDAAFLSRDLAVENPVKYQGLGRLTFSGLLNALDGVASTEARIVFMTTNHVDRLDPALIRPGRVDLKEYVGYCSHWQLTQMFQRFYPGQAPSLAENFAEHVLRATNQISPAQVQGYFMLYKNDPVGAIHNAESLRR

SEQ ID NO: 921784 - protein, 298 aa, Homo sapiens [sequence omitted]

SEQ ID NO: 921785 - protein, 252 aa, Homo sapiens
MYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLLSVAPQQSLVLLEDVDAAFLSRDLAVENPVKYQGLGRLTFSGLLNALDGVASTEARIVFMTTNHVDRLDPALIRPGRVDLKEYVGYCSHWQLTQMFQRFYPGQAPSLAENFAEHVLRATNQISPAQVQGYFMLYKNDPVGAIHNAESLRR

SEQ ID NO: 921786 - protein, 339 aa, Homo sapiens [sequence omitted]

SEQ ID NO: 921787 - protein, 334 aa, Homo sapiens
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEARELALQQEEGKTVMYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLLSVAPQQSLVLLEDVDAAFLSRDLAVENPVKYQGLGRLTFSGLLLTLAADPDVPEVLSRAGTFLS

SEQ ID NO: 921788 - protein, 127 aa, Homo sapiens
PNAASPRCRRGETIETEGQRVTAVRGLSDGLPQTMWLEARAGVWARFRRGFLGVAEGPGTGELCLWPSMHRCFGILDPSSEAQPRSLLSAHLPACQAQGKVAGVRGWRRGVLETTLLLSLRILLSTM

SEQ ID NO: 921789 - protein, 72 aa, Homo sapiens
SRLPATSCHPMLHSTALAGELEHSICLLSLTDSSLSDDRLNHLLSVAPQQSLVLLEDVDAAFLSRDLAVESK

SEQ ID NO: 921790 - protein, 227 aa, Homo sapiens
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEARELALQQEEGKTVMYTAVGSEWRPFGYPRRRRPLNSVVLQQGLADRIVRDVQEFIDNPKWYTDRGEKQLGSWL

SEQ ID NO: 921791 - protein, 252 aa, Homo sapiens; identical to SEQ ID NO: 921785

SEQ ID NO: 921792 - protein, 252 aa, Homo sapiens; identical to SEQ ID NO: 921785

SEQ ID NO: 921793 - protein, 252 aa, Homo sapiens; identical to SEQ ID NO: 921785

SEQ ID NO: 921794 - protein, 299 aa, Homo sapiens
MQMIDLQTGTPWESVTFTALGTDRKVFFNILEEARELALQQEEGKTVMYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLLSVAPQQSLVLLEDVDAAFLSRDLAVENPVKYQGLGRLTFSGLLNALDGVASTEARIVFMTTNHVDRLDPALIRPGRVDLKEYVGYCSHWQLTQMFQRFYPGQAPSLAENFAEHVLRATNQISPAQVQGYFMLYKNDPVGAIHNAESLRR

SEQ ID NO: 921795 - protein, 419 aa, Homo sapiens; identical to SEQ ID NO: 921777

SEQ ID NO: 921796 - protein, 419 aa, Homo sapiens; identical to SEQ ID NO: 921777

SEQ ID NO: 921797 - protein, 419 aa, Homo sapiens; identical to SEQ ID NO: 921777

SEQ ID NO: 921798 - protein, 419 aa, Homo sapiens; identical to SEQ ID NO: 921777

SEQ ID NO: 921799 - protein, 153 aa, Homo sapiens
RELATGRDARLGVVVGEEVASTFHRYPSQVTGMTGVCDHAQLIFVFFVEMEFRYVVPGWSQTPELGQSAHLRLQKCWDYRPEPLCPSPWLIDSHLLPESLQGHPFVCVCVLISPYKNTCHTRLGPTLLTSFYLNHLYKDPISKYSTILRSCNI

SEQ ID NO: 921800 - protein, 66 aa, Homo sapiens
SEQRGLVRVGGPLTKKCRHALCQIRLGGDDKIKGRGQGQEAGSAVAQILRSTGRISSGLQGTDRER

SEQ ID NO: 921801 - protein, 66 aa, Homo sapiens; identical to SEQ ID NO: 921800

SEQ ID NO: 921802 - protein, 114 aa, Homo sapiens
MENIRRVPQAEQPRSRPGCPSPYPTPVSNLNLGLLFILATSSLGRLLNPRDQGEHQIKLRPDRAHWRKEPKQSHMNVTLAIMLLSKLLFKWLLLTCSSLIRTRKNTLLITFLPS

SEQ ID NO: 921803 - protein, 310 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 921804 - protein, 203 aa, Homo sapiens
MYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 921805 - protein, 145 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQVLFPFHLLPTTWSSC

SEQ ID NO: 921806 - protein, 270 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 921807 - protein, 115 aa, Homo sapiens
MNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 921808 - protein, 236 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 921809 - protein, 234 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKVFLQLTLPTNVESC

SEQ ID NO: 921810 - protein, 321 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSIGVELGWENGCRFPAA

SEQ ID NO: 921811 - protein, 165 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKESLEPGHASHILPASSLVETSFEDSYNCDSPTGQGFGKAGDWPADCSGSKIEAELSLLLHNVVLLSTNYLGTRR

SEQ ID NO: 921812 - protein, 360 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 921813 - protein, 234 aa, Homo sapiens; identical to SEQ ID NO: 921809

SEQ ID NO: 921814 - protein, 360 aa, Homo sapiens; identical to SEQ ID NO: 921812

SEQ ID NO: 921815 - protein, 234 aa, Homo sapiens; identical to SEQ ID NO: 921809

SEQ ID NO: 921816 - protein, 308 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSVRA

SEQ ID NO: 921817 - protein, 289 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTLCPLYSQPG

SEQ ID NO: 921818 - protein, 263 aa, Homo sapiens
MSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLISPGLKRSINPKCRDYRCELPHPAYLFIFQSHYFNQAGLELLASSNPPISASQVAGITGMHHHAQLISYFFLVETRFLHVGQADLELPTSGDPLASASQSFGITGVSHHVQPILFFIGIYYSSIPSLYPLDASSTPSPTVVSTKNVSRHCQMS

SEQ ID NO: 921819 - protein, 234 aa, Homo sapiens; identical to SEQ ID NO: 921809

SEQ ID NO: 921820 - protein, 418 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKVETRFLHVGQADLELPTSGDPLASASQSFGITGVSHHVQPILFFIGIYYSSIPSLYPLDASSTPSPTVVSTKNVSRHCQMS

SEQ ID NO: 921821 - protein, 360 aa, Homo sapiens; identical to SEQ ID NO: 921812

SEQ ID NO: 921822 - protein, 360 aa, Homo sapiens; identical to SEQ ID NO: 921812

SEQ ID NO: 921823 - protein, 155 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKESLEPGHASHILPASSLVETSFEDSYNCDSPTGQGFGKAGDWPADCSGSKIGLLSPWPEFYAYW

SEQ ID NO: 921824 - protein, 296 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTIGVELGWENGCRFPAA

SEQ ID NO: 921825 - protein, 167 aa, Homo sapiens
DVRLTLTQRQPLLSRFSRCEDGALQGVLGSVGCVGLGSHPWTFCHPEAATWSLWPGLGGPSKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 921826 - protein, 155 aa, Homo sapiens; identical to SEQ ID NO: 921823

SEQ ID NO: 921827 - protein, 259 aa, Homo sapiens
MALSRVCWARSAVWGSAVTPGHFVTRRLQLGRSGLAWGAPRSSKLHLSPKADVKNLMSYVVTKTKAINGKYHRFLGRHFPRFYVLYTIFMKVPPRRHQVSFPRYYFHSTFCQLPGLLANIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 921828 - protein, 317 aa, Homo sapiens
MALSRVCWARSAVWGSAVTPGHFVTRRLQLGRSGLAWGAPRLFDLPCRSSKLHLSPKADVKNLMSYVVTKTKAINGKYHRFLGRHFPRFYVLYTIFMKGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 921829 - protein, 203 aa, Homo sapiens; identical to SEQ ID NO: 921804

SEQ ID NO: 921830 - protein, 360 aa, Homo sapiens; identical to SEQ ID NO: 921812

SEQ ID NO: 921831 - protein, 152 aa, Homo sapiens
MAEVPTPGQDFQGIRCHPPGHRLHFKDLYTVLSGKNAWAWGPEALPVSSPGTSWERNRHFPFSVSLGSAGLKGLVPGRHFCQGRCHQGTQSPCAKGPCSRKRSHPPGGTDWPPLPGGGKASAPDWKYMFGTQAIHVGTSSAAIPAENSRCAG

SEQ ID NO: 921832 - protein, 144 aa, Homo sapiens [sequence omitted]

SEQ ID NO: 921833 - protein, 205 aa, Homo sapiens
MRKMWLPSQELEGRVKTLRSFLRQRPVYESVVLSTFLLLCSQSPELFILQNRSSDRRTIPTSPPRPQERERPPGGSGPISTINCANLEPQFSYLERGMNHAYIMGGRNVMRGAAGGKGGPLCSCCVPDPMGLSFLPTYGCQSNRTASVATLRMKAREHSEAVLQSANLLPSTSSSPGPVAKPAPPDGSQEKTSPTKEQSEAEKSV

SEQ ID NO: 921834 - protein, 169 aa, Homo sapiens
MQSEYFSAVTSLSCSCNPGSAGPSVSPPDQPTPIHIAPSPISLQPPQASLARGKVQTLSGNIYAKLCCVQVMPTPHSLQWLSQEHLPWLSCPRPFNQEIVFGVGGKSLRQEHQSSTSWVGLLSEFTIIKGALDGRIGGGCVSSRGGGRTFETAAGLQGTERLSLNGTLG

SEQ ID NO: 921835 - protein, 142 aa, Homo sapiens
MHFPWAPCKPVSWPQAWPGGGLWGRSHEGSSSGSRAVSEGAGVGVPAASMQALIWGDKVERQALQEPWRGRENARFGEGLKGQSWMPRRQEEESMGKEGTAGMSDEPGLITEGQEWEQGSWILFHRQQEITSNLRKSYESGR

SEQ ID NO: 921836 - protein, 135 aa, Homo sapiens
MGPWGLSPTLTKTKRAEAVETVMALVGAGTPRLALAPAIHMKLSPAEKELLRLQFGATWWQLLALAEISEDDSGLGGSVQLQDSSSCFRKYQGCIQGTYSLLLEVSIWQALLQCLYEALPTPQPPQVPRRLTADA

SEQ ID NO: 921837 - protein, 119 aa, Homo sapiens
MWNCSELRNLVFTSFSPSFGNSRPSLPDVQCVEVRGFIYFDWIFYCSKWEGKYVPCYFISKSGFDYYAPTRTANLQNIATPNAGEEVDQQELSFVAGAGGRLNSKIIASDSRPCVITCF

SEQ ID NO: 921838 - protein, 263 aa, Homo sapiens
MGHGYMAATAAKREPQRRHCGQHSRRPELGAQLAGKEREKNHGFDFDSFIAGTIQLSSQHEPTDVVDKLNDLNSSVSQLELKSLISKSVSQEKQEKGMANLAQLETLYQSSWDSQCVSGGEDCFLINQFCDVRKDEQVEKENTYTRYLDKFFSRKEDTEMLETEPVEEEELGERGNEERFLNNSGEFLFNKFQSRPCEETTKQALSWAPRPDKKQLESIGIPQFHSPVGSPLKSTQATLTPSAMKSSSNIPHQTYSSSLKLLN

SEQ ID NO: 921839 - protein, 144 aa, Homo sapiens
MTFLAPPANEPQTFSMAVKTLADSTTHLVPTSPHWILVGSWSWQDDDGISIEDELSILSLDCTMEFAMGGIILDHVDYVVEVNEGVIDGDNIHFTRIKSSPSDRVPNIVQSVGSGIHLHHGVSGKRLVVHEKMQLSVEPEEQRD

SEQ ID NO: 921840 - protein, 137 aa, Homo sapiens
MRQLFQWLQQDELGFVGRCYKWEKEEGERESSKGNRNREKRCFLAPGDVSNGCRFREGQLGGLEQSWKASWWQTLGLGFDRGLGYGSGSPGVVMLEEGSANPLSKPGHGTVVHISLDHPQYGTMETNHTYLQLSNFG

SEQ ID NO: 921841 - protein, 214 aa, Homo sapiens
MCQRVGASPPAAQSPGPACPEQHHPHQLHAALNTGQGFDECSFRNLSMFHSCGGEVLQLAMHRGSDHWRLSRHPGRMFHIPSPRWQIHATAQNEVSPEPQQTGPLLSYHGWSSLRTCLFQDYCFKVKKEAEVKEEEEKEEEEDDEGGEGGEQKQQQWGRDGKGEELRFLGCQKRVIVTCNENTWTQEEEHHTLGTVVGSEEAGGIALGDIPNAK

SEQ ID NO: 921842 - protein, 158 aa, Homo sapiens
MHRKSNASFLGPPSSPVLSKNPSSSVLLPGTRWTKNNSSPMLPLLDAATRCRYGRCSLQLALVESTKGKCEVGAPTRSPPTGPLPSGAVKRRPPFSRPQNGRSTGSLYPAPAKATSTKLRAATGDVLSEDLGRVDGWMVLEKSLYPHFLSLAFTRTGL

SEQ ID NO: 921843 - protein, 480 aa, Homo sapiens
MATHFQQAADTRGQKTCTICQMLLPNQCSYASHQRIHQHKSLYTCPECGAICRSVHFQTHVTKNCLHYMRRVGFRCVHCNVVYSDVAALQSHIQGSHCEVFYKCPICPMACKSAPSTHSHTYTQHPGIKIGEPEIIYKCSMCDTVFTLQTLLYRHFDQHIENQKLSVFKCPDCYLLYAQKQLMMDHIKSMHGTLKSIEGPPNLGINLPLSIKPATQNSANQNKEDTKSMNGKEKLEKKSPSPVKKSVETKKVASPGWTCWECDRLFIQRDVYISHVRKEQGKQMKKHPCRQCDKLIPQPVPAQPDQAQRHQESVCLLALPRLQTYLYQTIDAREARAITQPLKKLKINVFKVLKSAMCGFTTENLLQFHEHIPQHKSDSSSYQCQECGLWYTSHVSLSRHLFIVHKLKEPQPVSKQNGAGEDNQQENKPSHEDESPNGTVSDRKCKVCVKTFETEAALNTHMRIHGMAFIKSKRMSSAKK

SEQ ID NO: 921844 - protein, 118 aa, Homo sapiens
MRQGAVDEHLLNIRERSELTGPRREENASLVMPDQQRGVSGRTGSALNYLELPLSPSQDGCHSPDGLTEMHSHFIMPAVIPGNSSKCTIKSQQLFQITAKSTIPAAALSGNEAKQLGP

SEQ ID NO: 921845 - protein, 146 aa, Homo sapiens
MDVGPESGCGREPVSLLSFQWNQASKEQNAKGANPSSVLQHYSDFCHFCRLEHEPQAVSGEGRNLFLRLWLGSVLGLLPPASSPAVKSSQEVVNPGEQLMLHKGQQLKRSLRGSLSQRAPNLASPEGQRRGLPELSCQPEFGLQRF

SEQ ID NO: 921846 - protein, 173 aa, Homo sapiens
MHTGVLSLREVKSQGKPLSPELKRQTGSYGKPQLNRAETHKQKSPQESAPGQENLNCSGWIAEGKRGLIDSVSHGWGGLTIMAEGKGGAKARLTWWQSRDNENQVKGETPLKPSDLVRLVHYHENCMGEPAPMIQLSPTGSLPQHMGIMGATMQDEIWMETQPNQITMCYASS

SEQ ID NO: 921847 - protein, 137 aa, Homo sapiens
MQDKQSLGGNKVRVEAGPCLVLGQCGFYPIDNGKSLKVSIGGDTVGSAFEEDGITCCEEKDPEGGSGGETVSCLASKEINCKSCLVADDVTFAKSPSLSALRLYLKSDGDRTSVLPTSGSRRGDEEESFENWKCLKI

SEQ ID NO: 921848 - protein, 147 aa, Homo sapiens
MSGLALGVFGAPLLGREEKEGSCCARNLKKKGRNFAELKIKRLRKKSAQKMLRKARRKLIYQKANHYHKECRQMYRTEIRMARLARKAGNIYVPAEPKLAFVIRIRDINGGQEGSLVKDVVWTPPALPSNSPQPLLPHPNGVLNVTY

SEQ ID NO: 921849 - protein, 154 aa, Homo sapiens
MHVCYMGILHTGEDWASSISITQVVNIAPNRVIVDFQQDILEDNGGEEEMGRKGNRPRSPVRPPVCCPGPVISHLHKSHSRPEFLRKLFHYCAPETSSFAELLLPFLNGLAPGPTACAFLEVKEENVLSDPKVLNGPYGQQPAVWVECEMSLDS

SEQ ID NO: 921850 - protein, 137 aa, Homo sapiens
MKPRTFAVSVTALKGDVDPKSEQQRDLLWRAKEQRFHSMEGDPSWLPLLAAVTSFYSLICPHARPADWSILHSAADRSILQSTDWSILQTQRAMHMESFTSKIGGELNEIEKKEQYKNSKGDITNDTTEIQQIIRDY

SEQ ID NO: 921851 - protein, 138 aa, Homo sapiens
MPIRPKRQDDHHHFLDEETEVQGALRTCLGLHKFGKRFEHSNDGSMSAVKGSGSRRQLRIKRLHEGGEEEEGGEGGEGGGGGRGEEEEEEEEEEEEEEEQEKNISLISASVNDHSKSIAILMPFNPQKTIRRSNTHVP

SEQ ID NO: 921852 - protein, 222 aa, Homo sapiens
MCVLCGQRTEPSPLKLVPLRAAAVLLVLGIAMPIVLSMFCNSTPFPHAYFPCFRFATVCRHRKRSVGSDEDKAPAGAQIQNGVLVQLESDAGVLSGSECGDSLPACIVYHTFIPKYFLRMLKRRSRIQGDFTTADTGQEKGSIWSPGEERKFFHLQHIFILLGRGTGAWELLNVGTSCNTGKLGHASMQAGPTWGITSQKSLACKVTNKKNHTSKAEAAAEC

SEQ ID NO: 921853 - protein, 134 aa, Homo sapiens
MNSLERQMLLASVLLAGCFHPDTAGCDGASAADPRVLSPPSKLQQFHAMAFLGEYGIINAGDLLIIYEVSEKPSLSCSQYKSRCRSEARRSCWRFRLRQISDELMIGSDRVMPSCLSSAHVKIQESNKDSVCHM

SEQ ID NO: 921854 - protein, 137 aa, Homo sapiens
MCEFDSIIMMLAGYFADLFMWLLHNVTGERVSGTHLKKQSDCFLVEQLCCVGEILHWISSAPSQFGLSKAHRLDWLRYPNSQGGGLPCPLGTLPQGEIRTQSAVEHGWGWPEALVGKTHPVRRSGCGPHLKSSLTMP

SEQ ID NO: 921855 - protein, 138 aa, Homo sapiens
MRKLKSSDGSEEIFHLEARKLGNHPPALTVTGGGCHQREGVNLNTVSPFKDWPSMANIPGPTMNSSVITLPTLRAVRKFDIPFCHNPYLCQSSIDLGDPPREEKQFDRVSNDPTFLEPVRGSDFSTTSLEVLTGLSAL

SEQ ID NO: 921856 - protein, 142 aa, Homo sapiens
MGTTCVHQPKPPLPTTLSLTHSQTGVQSGCGAERKPTEPYGSQTHDPALSDIGLQLASHSGYTVYQMKSYSPGHELSLEINKFWRGQKHPNHRKEEKFRGPEKAKKNNTSRKEPNANIIMYPVSSVFWVWNETAAQSTKRIS

SEQ ID NO: 921857 - protein, 157 aa, Homo sapiens
MLSKSQIIESKALDIYLVFYDIEAKLAFKPQEVVLPILPPLPCTPFHRQRSLSPWPSAPQAYREYCEATANISLRPKDSLGPVEKLEQRGHCKIKKHKLCMPVGVDNIFKVCEEKNVIEEYFIQQNCPSNTKEKLRLSKIIKSGENLLSLDMLYKKC

SEQ ID NO: 921858 - protein, 135 aa, Homo sapiens
MISRKGQYTSSVVASLFTRLINTAVSKGTKFISLLFELYALKLVTVVHKLYQICCLSDSTAALAPLVSTPEPPRQVCPSNWLFSLKASAPKAATPGSAMADSTAFFQNVCYRATCRTLKPSCSLFNCVAIFCNAS

SEQ ID NO: 921859 - protein, 200 aa, Homo sapiens
MNRGSWEKTSAVGLSEVYWSGWWSGRWGGSITEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRGTSKIRTGVSNNQMPKLLHRPVKYLHCGGVRSIQ

SEQ ID NO: 921860 - protein, 159 aa, Homo sapiens
MYFNSLIDMLHGKVEQWQAQLLLHTDEVIPLISSNKMECTSGWQHVEKGEKEGDRGLQKGRAVVQVVQGAARNRRTPMQPMDSGQGLRAGRIPVGSWSLGRSSPVGRLKQTFLEEDQGHTTSSKASILLTPVSLHKHQAWDTGTQTAWMQGWAGKTQTP

SEQ ID NO: 921861 - protein, 489 aa, Homo sapiens
MLDPAEHPLPPAPAPAPAPRLHVHGGDCPAAAARKAAASRALCRLTGKEPGAGALTPEDAGGVCKGVNAFLPGRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKVSFHQTMKPEPDPAFRT

SEQ ID NO: 921862 - protein, 211 aa, Homo sapiens
MDRTSAGPQGTPNNRRGPQTSNNQHSLQTPNNRTNTARRPQITDIAYRPQITDAARRPQITDAARRPQITDVARRPQITDMAHRPQITDAARRPQITDVARRLQITDTARRPQITDAAHRPQITDAACRPQITNTAYRPQITDAARRPQITDVARRPQITDMARRPQITDAARRPQITDTARRPQITDAACRPQITDAARRPQITDTAWCT

SEQ ID NO: 921863 - protein, 139 aa, Homo sapiens
MVTELIGRSHRYHRKENLEYCIMVIGVPNVGKSSLINSLRRQHLRKDEEATVQGHAVVSERPLMFLLDTPGVLAPRIESVETGLKLALCVLTSAAASTGTVLDHLVGEETMADYLLYTLNKHQRFGVQLDKFGSMAIRL

SEQ ID NO: 921864 - protein, 142 aa, Homo sapiens
MVLLFYNSRPYSYERTKGFDSSVMYLGVDSCNSPSEKRGIRVGVTRFSRCRLSPFSLTRKGNSLTPCTSRVRQCLALLWLMHSALHPLSCAHCLALPCEMNPVPQMEMQKSPVFCVTHAGRCRPELFLFGLLGCHPKVFLRS

SEQ ID NO: 921865 - protein, 256 aa, Homo sapiens
MTSKNCSKNSVYLTPHMSVCTCPIRKATSEILALKNIPPSIATMARIGKPQPHSALDTGAQEPLHSGWCSIPGHRSARSVPQPQGRGPGKRLGEGGTPAMQRQKIFLDHGSQELHSEGVTTSWSTDNPLAGAKVYTDSCVISLFPLHPFNVDDIFLSVNLDYFANLLTFMVPSHNLNIIILSDGHGSNVVLLSQLFGKRGRHNCPVNVGRRIEMPFAVTTSVRSHKGIELHFGHSHFSDGHKGPHWLLMSFFNSNI

SEQ ID NO: 921866 - protein, 141 aa, Homo sapiens
MGLGALEQGAELVGEAPAAQEPTERVGGSGMAGCRFRALPLGKAAKAQREIECSAGPAGCSECGARQAHAHPEIQLARKRHAQPRAAKVGAQAEQAPRASEGYVLEIDFCVGNGIIKLVVSIFIIVIIKRGQPEIWDNDAI

SEQ ID NO: 921867 - protein, 173 aa, Homo sapiens
MYRLTPKRKPYLFCFLKLREVATRWNSCAFHSPRRFLCGHKFSAHLAKYQGMRLHKDLVQQERPELELDPLGICCGMEAGEPISKNQGGTLFPNTFQHRWDSYLMAAGAETGPPWNLLFTARTDVSRQVSLSTKILVCTIPPGPLEDGFGCRLKAKQGFSEDELNVILIFTPQ

SEQ ID NO: 921868 - protein, 134 aa, Homo sapiens
MPYRYSLAISLTPGCEPACTQPGRYRGLYRIGTPYGLERPSFLSSKARSTGAEVLEDILDLDLSVSETDDFIQLVSGEKTVFGSIPLAHPYGGQQGCEWETGVESAEEPKPTNCFKHKMKMLCSIHTKNHLILV

SEQ ID NO: 921869 - protein, 146 aa, Homo sapiens
MDGETDAGPVLPVHTVEVFYKSRIAEAQLSNPVPDQDADIFGGPLFDFLQQSKAITRFSETKMACLWEIMWLLKADWVFKEVVLVHLGGHNKVPEIEWHKTTEINGLAVLESRSLIKVWKGKFLRKCLVGACRQPSSPCVITWASL

SEQ ID NO: 921870 - protein, 140 aa, Homo sapiens
MLQGSHATPNPARSSPEKHRPLSLHTIPPNFRHTNTLPLFRFIFLINLRRQECQASEPKLSHHIPCDLHIHIQMADSACLHPGEINSLVAHTKPVWWSLHTVAHEKNPKESTNNLPEFSEFSKITKYIVKIQQSFFYRLA

SEQ ID NO: 921871 - protein, 246 aa, Homo sapiens
MLQISLLERSGRPSGVGWAAIHLKEKQPGCGEAAILGGILSKEPRNQRPINGTTQPNGQMPQAADSVSAVLEEAQAHAETWKVKPASSWHTFHPAVPQENCLSSGVPDQPGQQNKGSSLLEIKKLASPREPPGARSTPGPPRPQVQPAPPPPVQRSCDTSGSPATPPKAKGTGSVVFPAPPDYFLPPQPPMPPLEYPELPLPSPDFMETPLDFVLPPLAVAKRPPMPHPPQQARSINVHKQQMNKS

SEQ ID NO: 921872 - protein, 141 aa, Homo sapiens
MLSPLTSTLGGRGSDSPTSVSLNQGYGLIEVAHRISKEVQTSPHKIQNHPKDSPRKGKFCYLQIGYNSHLFSQTGLRRQELLLPQMVKDGVCAYSTSCNPQITGGLPITGTLICDTREALLKVYFPRTNRATRVHMRKAPL

SEQ ID NO: 921873 - protein, 1769 aa, Homo sapiens
MGQTKSKIKSKYASYLSFIKILLKRGGVKVSTKNLIKLFQIIEQFCPWFPEQGTLDLKDWKRIGKELKQAGRKGNIIPLTVWNDWAIIKAALEPFQTEEDSVSVSDAPGSCLIDCNENTRKKSQKETESLHCEYVAEPVMAQSTQNVDYNQLQEVIYPETLKLEGKGPELVGPSESKPRGTSPLPAGQVPVRLQPQKQVKENKTQPPVAYQYWPPAELQYRPPPESQYGYPGMPPAPQGRAPYPQPPTRRLNPTAPPSRQGSELHEIIDKSRKEGDTEAWQFPITLEPMPPGEGAQEGEPPTVEARYKSFSIKMLKDMKEGVKQYGPNSPYMRTLLDSIAYGHRLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKAHKVIVELMAYENANPECQSAIKPLKGKVPAGSDVISEYVKACDGIGGAMHKAMLMAQAITGVVLGGQVRTFGGKCYNCGQIGHLKKNCPVLNKQNITIQATTTGREPPDLCPRCKKGKHWASQWNKPVTTIQQLSLTTSGSAAVDLCTIQAVSLLPGEPPQKIPTGVYGPLPKGTVGLILGRSSLNLKGVQIHTSVVDSDYKGEIQLVISSSIPWSASPGDRIAQLLLLPYIKGGNSELKKIGGLGSTDPTGKAAYWASQVSENRPVCKAIIQGKQFEGLVDTGADVSIIALNQWPKNWPKQKAVTGLVGIGTASEVYQSTEILHCLGPDNQESTVQPMITSIPLNLWGRDLLQQWGAEITMPAPLYSPTRAATVEPPKPIPLTWKTEKPVWVNQWPLPKQKLEALHLLANEQLEKGHIEPSFSPWNSPVFVIQKKSGKWRMLTDLRAVNALIQPMGPLQPGLPSPAMIPKDWPLIIIDLKDCFFTIPLAEQDCEKFAFTIPAINNKEPATRFQWKVLPQGMLNSPTICQTFVGRALQPVREKFSDCYIIHYIDDILCAAETKDKLIDCYTFLQAEVANAGLAIASDKIQTSTPFHYLGMQIENRKIKPQKIEIRKDTLKTLNDFQKLLGDINWIRPTLGIPTYAMSNLFSILRGDSDLNSKRILTPEATKEIKLVEEKIQSAQINRIGPLAPLQLLIFATAHSPTGIIIQNTDLVEWSFLPHSTVKTFTLYLDQIATLIGQTRLRITKLCGNDPDKIVVPLTKEQVRQAFINSGAWQIGLANFVGIIDNHYPKTKIFQFLKLTTWILPKITRCEPLENALTVFTDGSSNGKAAYTGPKERVIKTPYQSAQRAELVAVITVLQDFDQPINIISDSAYVVQATRDVETALIKYSMDDQLNQLFNLLQQTVRKRNFPFYITHIRAHTNLPGPLTKANEQADLLVSSALIKAQELHALTHVNAAGLKNKFDVTWKQAKDIVQHCTQCQVLHLPTQEAGVNPRGLCPNALWQMDVTHVPSFGRLSYVHVTVDTYSHFIWATCQTGESTSHVKKHLLSCFAVMGVPEKIKTDNGPGYCSKAFQKFLSQWKISHTTGIPYNSQGQAIVERTNRTLKTQLVKQKEGGDSKECTTPQMQLNLALYTLNFLNIYRNQTTTSAEQHLTGKKNSPHEGKLIWWKDNKNKTWEIGKVITWGRGFACVSPGENQLPVWLPTRHLKFYNEPIGDAKKRASTEMVTPVTWMDNPIEVYVNDSVWVPGPIDDRCPAKPEEEGMMINISIGESTRMFNACSPKLVGRSTYCQSHQ

SEQ ID NO: 921874 - protein, 217 aa, Homo sapiens
MRTRRRHGCAASVPSLKEPQKPEQPTPRKSPYGPPPTGLFDDDDGDDDNDFFSTPHSKPSKTGVESKDGSQSTRENDSLVNLERVQTDAECMQVSVKMTVNEGKVQSTADIFGDEEGDLFKEKAVASPEATREPSGGHVAFCVPALEVNGGPFASFVGQDGHNGPSRFMGRGHRLPFLMDLFSSQSASNLKGASLLPGKLPTSVSLFDDEDEEKPHG

SEQ ID NO: 921875 - protein, 140 aa, Homo sapiens
MCPFFHFLFSTETYFLDVLFCPAILGASSTPNRLPKGASCGMEIRFHIISVMPILLISVQQQTVTPGHCWQVIKNSSGWIWTMGYDLPAPDLHGCLKYSSSTRAERKDKENISEVESVKLIDEWRIKSKRQFINTICWPT

SEQ ID NO: 921876 - protein, 132 aa, Homo sapiens
MSHCAQHGPEVLIVFLYPYTNLSSSTSPSCPSQTVESILLLTVSTDISWTANNHMKRCSKLLGFREMQIETTISYHYSSIRMAKIKNHDTTKCCNVKEWMIDACNNLDGLPGNYAEQKTSIQKGYINVILLL

SEQ ID NO: 921877 - protein, 161 aa, Homo sapiens
MSLYMTSCLTCLACSMQHMRISVYGHMNIAKLAKVCYMCNIHFARFHLEQTSWVTAFYRCNTRDTLTRGIGLYNSSRLAARQMKHTKGTEKANRGLSSSCNGIEKKQSLRSIATRGQSLGIAAGDAKPCCNAPINLMCALIALKSRSSHHHLDFFGITKIG

SEQ ID NO: 921878 - protein, 139 aa, Homo sapiens
MRPVMRVKPTTKQAVTRWKLVLRLMMVENNCGDKTAFTEGKTAEEEIHRCLEVMVSPGDGDYEHVCHDGGQDPPGPTGRLQTRQTSLGDEQSHLETNVPLGSLVAANWALLEIEIYYTSIIATLSLCVQIYLRNDNHNI

SEQ ID NO: 921879 - protein, 183 aa, Homo sapiens
MKLKPDIVIADLIWGSRDGALCEVTCEVRAHDRESLAVRVQLQLRKEVSWQEELQEQGHGQESSWDEGSATSSEVRAAWEGGTGQSSWGLQTVRRSWNFTLGATGICRSILVRAGAASHWSLQTCRQFSGEHYGCSGISSIKKMFQWEQVKNNGGHLEMEPSEICFEGRMEWMWSEERGIRDD

SEQ ID NO: 921880 - protein, 158 aa, Homo sapiens
MAKQPQTPHFPSGPRQRGLETGAAAAQKSVDQLYVCTRAGTGSSAPSWRLHSAQTPQPSALGASQGRAGLREGGCVPHGDPLAFWVQPCSHHRGLSCSWHLKVAAAVPTLEPGRTPPLRLSQALGPGLQEGGNLQQSLIPAAVQGPEVASLSCQHWQS

SEQ ID NO: 921881 - protein, 153 aa, Homo sapiens
MKQNVDICAEDTCGMTAERYAVACGLNRCLHLKTRAPPSQDWGPAQEEGPDTGAQDFCPAADPLFHLLPLSRGHPPHPTLKGRSSHSCHLLLQPQLRQGTAPLLRIFYVQVDGPRLHIIPCKLPGVAPGGSSVHLSDIPIVDDLRVFGGRPAE

SEQ ID NO: 921882 - protein, 292 aa, Homo sapiens
MNPSLLLAAFFLGIASAALTRDHSLDAQWTKWKAKHKRLYDMTNEEFRQVMNGFQHQKHRKGKQFQERLLLEIPTSVDWREKGYMTPMKDQGQCGSCWAFSATGALEGQMFWKTGKLISLNEQNLVDCSGPQGNEGCNGGFMDNPFRYVQENGGLDSEASYPYEGKVKTCRYNPKYSAANDTGFVDIPSREKDLAKAVATVGPISVAVGASHVSFQFYKKGIYFEPRCDPEGLDHAMLVVGYSYEGADSDNNKYWLVKNSWGKNWGMDGYIKMAKDRRNSCGIATAASYPTV

SEQ ID NO: 921883 - protein, 135 aa, Homo sapiens
MNINTCAIQCLKFAKVYVYIFPNVDAVRSPSHGEAPGRCSGQQPKLNAQPTPASATSPVREALQMSSLVKPCRCLVPSSPTDVSSTDRAYRCLPAKPHSQVQAENVKDVSTKPLSFWVVCFTVIEENQNVTGCSG

SEQ ID NO: 921884 - protein, 194 aa, Homo sapiens
MRDTSLFISDWLMQVTVYFLSPYDEMGTGSSCVAGGLVQVLDFAAQKKSYFESESNVKVSKRGYCKVNVHSDSRSEWAAERNLQAQGPESDFSWKALGRASQSRLELGCNSRDKVEEQQGSCGEQPLEPGPGEGRPRKPEFTRAQVLGQKPDTEPGQPDSLRPGLWTHPRICGPCSLPGVAFWPYLPRGESSRQ

SEQ ID NO: 921885 - protein, 212 aa, Homo sapiens
MSDKSELKAELERKKQQLAQIREEKKRKEEERKKKETDQKKEAVAPVQEESDLEKRRREAEALLQSMGLTPESPIVPPPMSPSSKSVSTPSEAGSQDSGDGAVGSRRGPIKLGMAKITQVDFPPREIVTYTKETQTPVMAQPKKDEEEDDDLTEEEKQQILHSEEFLSFFDHSTRIVERALSEQINIFFHYSGRDLEDKEGEIQAGAKLSLN

SEQ ID NO: 921886 - protein, 409 aa, Homo sapiens
MKATDLRHSPLNPTEELLVKVGPHLSEIVVPDMPGYVLDGQEDVVESMVVQLLMELGLLVLTPLHLQPLHQGLDGQAPENDCEEDDDGGADKQVLLLDLVSVRKHDHDEGHGPMQASIGHDHLVYDLQLHHPIAVQESGLDDTMARYMKVKANEQVHGRDAQGYEDGIGATGQHLHGVVHGGGRLLRDVDFHVLMTADATEDDGQDGRQQQYDDEQDLIDMNLLKHNQDGCWVHSGDQAAQQEEVQQPYLQVAHEPTKGNDIEGQYGGGCIAHGADDLVQQDGAQFAKEEPVGHEDADHNHVLVLDIGPFKGGHVGALTHIMYTTVLLLDTPSPIAATQHQCHCYQQPPAATSLCQDKRLLFEKDDFQKGQNLLPGSKGSLGQGPLSFGEGMKALHYVKEANHKRPHSI

SEQ ID NO: 921887 - protein, 447 aa, Homo sapiens
MLLFYRFWALFGLYSLAAFLFWLIPSLLNLKDSRCFLMDLSKISCSCFSSSVGVAVAMHVLLPRLAQVLLQRVVRDRVLPIPNVCHVQGLNVQTDGTDALPQKNPTEELLVKVGPHLSEIVVPDMPGYVLDGQEDVVESMVVQLLMELGLLVLTPLHLQPLHQGLDGQAPENDCEEDDDGGADKQVLLLDLVSVRKHDHDEGHGPMQASIGHDHLVYDLQLHHPIAVQESGLDDTMARYMKGYEDGIGATGQHLHGVVHGGGRLLRDVDFHVLMTADATEDDGQDGRQQQYDDEQDLIDMNLLKHNQDGCWVHSGDQAAQQEEVQQPYLQVAHEPTKGNDIEGQYGGGCIAHGADDLVQQDGAQFAKEEPVGHEADHKDADHNHVLVLDIGPFKGGHVGALTHIMYTTVLLLDTPSPIAATQHQCHCYQQPPAATSVMLPHSTLGNH

SEQ ID NO: 921888 - protein, 399 aa, Homo sapiens
MVKLCTGLYLGSFLLGMLLFYRFWALFGLYSLAAFLFWLILSLLNLKDSRCFLMDLWKISRSRFLSSVGVAVAMHVLLPRLAQVLLQRVVQLMEDIEDPIWRLLGQHSHENPTEELPVKVGPHLSEIVVPDMPGYVLDGQEDVVESMVVQLLMELGLLVLTPLHLQPLHQGLDGQPLENDCEEDDDGGADKQVLLLDLVSVRKHDQDEGHGPMQASIGHDHLEDEGHVPRPDEQVHDRDAQGYEDCIDTTGQHLHGVVHGVGRLLQDVGLHVLMTADATEDNGQDGQQQQLLRHDDEQDLIDMNFLKPNQYGCWVHSGDQAAEQEEVQQPYLQVAHEPAKRDAIEEQDGGGCIAHSADDLVQQDGAQIAKEEPVGHEVVGICMMGDVNMKDHGDALWDR

SEQ ID NO: 921889 - protein, 147 aa, Homo sapiens
MLPLYLPIVMVLGGGAFGREEPVLVNLGCDNKIPLTGWLKQQKSVSHSFGGKFKNSTNMVRFYKRSSKWSSVKKRRERPPIDQSLCALHLCNQCLCSATMVTKPKRRVEGDVKGDKAMVKDKPQRRSERLSAKPAPPKPEPKPKSAL

SEQ ID NO: 921890 - protein, 152 aa, Homo sapiens
MKLPEEGSGSNICCSAIFAVLQPPLVIPRQTGININKKVIYTKTSSVGHQHQRPKVDKTTKMGRNQSRKAEKYKNQSASSPTKDRSSLPATEHSWMENDFDKLTEVGFRRTNSVEKTLNDLMELKTMAQELHDACTSFNSRFNQVEERVSVI

SEQ ID NO: 921891 - protein, 392 aa, Homo sapiens
MPEPYPAAVGSWAAQASLMSTAPCSAAPGAIDRPRAEGYRPMARDWQAALTAAPVQDPLGEASFTPEPAKPRAHQKEETLDVSKHQKEKTLDTLPLRTVTLTARVYGFILEVRTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQVCLKLGTHRLKHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTESRLFLTDFFRNHNLELSKLLSRLGQPVPSWLREELQHSSLG

SEQ ID NO: 921892 - protein, 267 aa, Homo sapiens
MWESGGCVAKRPRPADISDHPMLLSQDKTLQQACACLMKGKEEKEVVILDDPLMQNPRVQRGVLGGAELPSISCEGSDVSVLSPFSPPESSIENPSSSPPYKSSPILYPPLPEELSPVRTTHSGASHQPPKGNLCPLREVANGEECTVRVHVPFSMSDLVLCKEKFGHFSEDPGKFIDEFKKLTLTYSLTWQDLLVVLSLCCTVKDNQHILGTARTHGDEVLAHNPNHNIYQAGGIAVPDQDPEWNYCKVHGCALVNNRLRRTSGPK

SEQ ID NO: 921893 - protein, 251 aa, Homo sapiens
MGVKTLSLPLYAGREEQGGPDSQTVCKAAALPWCSAQGADSWRDDDDKDDDDAGAHRTQGPRRPSQHCTLEVGNLAGPAHSTTGAVKPSDWGNHSGNRLEDAPQADGKADAWPVNPMSSVTVLVRVPVIHTRLSLIGSTPAGTITASIRVHISPTSRGLCWHPAFYAPATSTASLEDGSHRQGQMTRREGTCYPPAYRGAHGAVCGTCHGPSRPGLRCVFSTWESSSFNPGAQSQKAPAPTPSYEPPPGPI

SEQ ID NO: 921894 - protein, 180 aa, Homo sapiens
MCSGWILVTLSTASRLILGSVSATSRIAVGTWGRDRVNCSAIAEPRANRTPWGSPTLCREACTGHWLWKGTVRATPAPEDGKICIVRLGAVVSVEEDSPTAPGMPGFALKSVAGMNLAALEEVPSLTAAVLWALGDGPAGHRCPRECISWVHLAGVGTEAVTGEIYQRGNGFISGGGDYG

SEQ ID NO: 921895 - protein, 144 aa, Homo sapiens
MPRACLLQTTELGVGAVSCRAQHLQRASVPHFTLHRPSRGGGRPCSAGGQSPWKSLEATKARAESTMAVLAGHSWCQQRPALRAGVLCSRYLPKQGGPSEEQALSEQAQLAGAGVSLEAVAFSPVRTVLGMGPSSAHSSQQESC

SEQ ID NO: 921896 - protein, 159 aa, Homo sapiens
MQAPILNLKAFYVARPHGTTEREGAGGVVEEWQVTGQKQLLEEAPCSPGGPDLVKLGGCGACLCVPHGQRGRARFVLDSRCAAPSEMWVDAIGILAVQPCTALLALSGLSFVQTLIFSWVPRVTNLFAENPSAATDPTPPAPMPSLHTFSAPMSSASNP

SEQ ID NO: 921897 - protein, 153 aa, Homo sapiens
MGQVWAVVRSTLELFHTDNEEEGEYNKVTVEVTDQVYLPPKAKAEKEGEVHPYPSAPPHYYFEENDPPDLSFLEDTGGKAHLVDYNKACDDIRDTLLAQAMAGLRVDKGNTLFPGACFNCGKHGHTKKNVKKEISKSGHQIGEKRKLLILKYV

SEQ ID NO: 921898 - protein, 1679 aa, Homo sapiens
MKRNGMIWNQPECNWNGMEWNGMEWNGMEWNGIACNQSWWNGMEWYGMEWNKKAWNGMESTREEWNGMEWNGMEMKQTEWNGMVWNGMEWNGMEWKQCNAMVSTGMECIGMEWNGITLKSTQVEWNAMEWKGIITSGMEWKGMQWNGMEWNGINTSGVEWNGMESTVVEWNGMECNRMEWNGIQWNQPAWNRMVWNAMERSGTERGIEWKGMHWKGMERIQHKWNGMEWNGIQWKGMECNGMEWNGMKWNKPEWNGMEWNGMEWNGMNWNKPEWNGMEWNLMVWNGINTKWNGMEWNGMERNGFNWNGMKWNGMEWNGMECIGINKSEMQWKGMEWNGMEWNGIEWNQPEWSEINWNGMEWNQPEWNGMEWNGMERNGMQWNQLEWNGMEWNGMERNQPESNRMEWNGMEWNGMETTGMEWKQPKWKGMQWNGMEWNGMEWNGINTSGLQRNEMEWNAMEWNGMEWNGMERNGTELNGMESTEVEMEWYRMQRNGTEWNGIKWNGMEWKQPEWNGMEWNAWNGMEWNGMEWNGMEWNQPQLNGMEWNVTEYNGMERNHPKWNGMVRNATEWNGTERNEMEWNRLNASGMEWNGMDWNGMEWIGVEWNGINTNGMERNGMEWNGMEWNGKEWNGKEQNGINTIGMEWNGMESTRVEWNGMECNGIERNIMELNGIIPSGMQCGIEWNGMDWKRMEWIGMDWNGKEWIQPEWNVMDWNGMEWNGINTNGMERNGMEWNGMNGMEWNQPQWNGMEWNAIEWKVMEWNGIQWNQPEWKGMVWNAMEWSGIEWNQRELNGMEWNGTEYNGMERNHPEWNGMVWNAIEWNGTERNEMEWNRLNASGIEWNGMDWNGMEWIGVEWNGINTNGMERNRMEWNGMEWNGMERNGINPGGMEWNWNGVEWNGMQWNQHEWNGTEWNGMEWNGMEWKGMECNGIEWNQPEWVGRKWNGMKWNGMIWNQPDCNVNEWNGMEWNGMECYGINPSGMEWNGMECNGMEWNGIKKSGLQRNEMEWNAMEWNGMEWNGINPNGMEWNGMEWNGIEWKGMEWNGMNWNKPEWNGMEWNLMVNGINWNGMKWNGKEWNGMECIGINKSEMKWKRMEWNGMEWNGIEWNQPEWSEINWNGMEWNQPEWNGMEWNGMERNGMQWNQLEWNGMEWNGMEWNGMERNQPESNRMEWNGMGWNGMETTGMEWKQPEWNGMQWNGMEWNGMEWNGINTSGLQRNEMEWNAMEWNGMEWNGTERNGIEWNGINPSGKEWNGMELEWNGMEWSNRRGMGWNGVEWNGIEWNGMEWNRMKWKGTDWNQPQLNGMEWNGTEYNGMERNHPEWNGMVWNATEWNGTKRNEMEWNRLIASGMEWNGMDWNGMERIGLEFNGINTNGMERNGMEWNGMEWNGMERNGINPIGMEWNGMESTRVEWNGMECNGIERNIMELNGIIPSGMEWYLMQFNEMEQNGMEWNRKNRLNPSGIEWNGMDWKGMEWIGMDWNGKEWIQPEWNEWNGMEWNGINTNGMERNGMEWNGMVLNEMERNGIESTQVEWNGMEWKGINTSGMEWNGMEWNGMEWNGMEWNGINPSGVEWNGMESTPVEWNAMECNRMQWNGMEWNSMESTRVERNGMECNGMEWNGMESTRVEWNGMEWNAIEWNGMEWNGMEFNGINPSGMEWYGMQWNGVEQNGMEWNGID

SEQ ID NO: 921899 - protein, 1060 aa, Homo sapiens
MEWNGINLSGTEWNGMEWNGMECNGINWNGMEWNGTERNQPESNRMEWNGMEWNGNYWNGMETIRVEWNAMEWNGVECNGMEWNGINKSGLQRNEMEWNAMEWNGMEWNGTEWNGIEWNGINLSGKEWNGMEWNGMEWNGMEWNSMQSSLVEWYGMEWNLTEWKNDMESNRVEWYAMEHNGTEWNGIKWNGMEWKQPEWNGMDGMEWNAVEWNGMEWNPPQLNGMEWNGTEYNGMEWNHPECNGMVWNASEWNGTERNEKEWNRLNASGMERNGMDWNGMERIGNGNERNGINPIGMKWNGMESTRVEWNGMECNGSERNIMELNGIIPSGMGCGIEFNGMDWKGMVWIGMDLNGKGWIQPEWNVMDWNGMEWNGMEWNGINTNGMERNGMEWNGMVLNEMERNGIESTQVEWNGMEWNGMEGNQHEWNAMEWNGMEWNGINPKWKGMEWNGIQWNQPEWKGMIWNAMEWSGMEWNQRELNGMEWNGTEYNGMERNHPEWKGMVWNAIEWNGTERNEMQWNRLNASGIEWNGMDWNGMEWIGVEWNRINTNGMERNGMEWNGMEWNGMKWNGKERNGINPSGMELNGMESTRVEWNGMEGNGIERNIMELNGIIPSGMECGIEWNGMDWKGMEWIGMDWNGKEWIQPEWNVMDWNGMEWNGMEWNGTESTRMEWNGMEWNGMEWNGMEWNEMERNGIESTQVEWNGMEWNGINTSGMERKGMQWNAMEWNGMERNGMEWNGINPSGNGMELNQPQWNGMEWNAIEWKGMEWNGIQWNQPEWKGMIWNAMEWSGMEWNQRELNGMEWNGTEYNGMERNHPEWNGMVWNAIEWNGTERNEMQWNRLNASGIEWNGMDWNGMEWIGVEWNGINTNGMERNGMEWNGMEWNGMKWNGKERNGINPSGMELNGMESTRVEWNGMEGNGIERNIMELNGIIPSGMEWNGMDWNGLEWKGMDSTRVECNGLEWNGMEWNGMERNQHEWNGTEWNGMEWNGMEWNEMERNGIESTQVEWNGMEWNGINTSGMERKGMQWNAMEWNGMEWNGMEWNGINPSAVELNGME

SEQ ID NO: 921900 - protein, 138 aa, Homo sapiens
MVGEGKGRRPLRTLWKQPRQEVEWRFNRQKKRERETALSVETKVSKRKGPAGGKCARFYRRSLDVSLQRRVKDSAITFGLSYKNGETICYNDKEDRGVGFGGKWKPPAPVEISTKASLSPSFSEVKLLETLILRSSET

SEQ ID NO: 921901 - protein, 150 aa, Homo sapiens
MERELLSHLVSADGSLLAYLGWVNMGSTHAHLGSTSGCHMSCWLLVALAALRSCLSSQEWEPPHLPSPKSSPPALAPAGSLRPSCHTQGKEWRLQGAGRAQEESWYKIVLPTPEQRLPMPWGTVENSGLQPFWHQGQISWKTMFPRTSGG

SEQ ID NO: 921902 - protein, 152 aa, Homo sapiens
MLEAPDGGSRSWSLSFHSSQCWLNEVTAAALSKHPDPWGRFKGRATPDLSGSCVLPLKLEASSSWYPSGMMEMTPRVLQGVGHNDPYSEKDMTGGIQFCPWTNSYHVSFPASSGSDGLCRASPFGISATLTDSNIYKRKAILHWKNLADYKR

SEQ ID NO: 921903 - protein, 347 aa, Homo sapiens
MVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPISVCWCMCCAGEETECTCWVNCLRYPSIGSTLVEHPLCTDTALSMSGEGRPYTVVLAKDPPSGSLLFNMGSERDAEMPAEQPGVMCQKVTVHGAFQVKRQCMWGKPGWGPTVNSGEASGRGKEEKMWRLSDKG

SEQ ID NO: 921904 - protein, 134 aa, Homo sapiens
MEWEGSLPLESGHPAAGLFSDKPQPNSPQCLDIPLLLSLTHRSTVTGLPVCRSVPVLLSMFSCLYLCLLRSWVYMGTGWGVHGRPEWSWKMQHLGVKTGVPVSLMSVGTGLRVEPSPGTPPFSTQHFPAPLPYQ

SEQ ID NO: 921905 - protein, 146 aa, Homo sapiens
MIFLKHNTRRATAFALMGVTDANPDMLLSPVINEAHISFKSKALTLFNSMKANRGKEAAEENLEASRGWFMKFWERSFLYNTREQVEEASADVEAAASYPEDLAKITDGGGYIQQIFEMEGEEGEELGGFSGRGNGNYKVTGAWKS

SEQ ID NO: 921906 - protein, 255 aa, Homo sapiens
MLTHRTNHHGVPGSSQDLADAPPSPPPPPKGRRTASRLHFCLIRCSYTLNKKMSDFPPTSPVYFRPLSAAMTVPQSCTLDNEDPREKQGHPAAMHQNHWVLAKMQVTWPIHTPESEYLHLSKLFRDLRAQSFVVKFPGPFPTSFESITYRHVNHMTLLVLLLSGSSQLTWSSLLPIPSIHYNKSQEDSGSAPATWLSLDQSLWTGKGLLGYLITKEQARQCDHLAGEEGHCPKASVLDRQPATSIELTCSELSPE

SEQ ID NO: 921907 - protein, 135 aa, Homo sapiens
MKPPVERSDSNICCSPIFAVLQPLLLIHRQAGSGVDLQQTPTDLQLRVLTVRRKTNKQKGHPHQNPICTSPSSKTKDVWLTRITNAEKSLKDLMELKTMARELRDECTSFSSQFDQLEERVSVIEDQMNEMKREV

SEQ ID NO: 921908 - protein, 151 aa, Homo sapiens
MRSGVCMFGKNAQWDAMAVLSPCVEGTGERVCGSSVRGHSVTSEMRQLRPDKSSTLPKVTWLPLFVEAFSAPGAMLDPNLLLNRIFTMALEEAYRDPLGLWALDFELEESQGESGITVPCHGLAVSAGVMSISAIPLDSQLWAAPVATFGI

SEQ ID NO: 921909 - protein, 164 aa, Homo sapiens
MESEKGQRRGSGKLLGKFFIIIIIIIIIIIIIIIINKSSLFSPQPPPATQRCTLLRSKGAENNEILVNNQHLPDASSLLDPVGGQLDERRKQATSCNHTDTSAAATLGWEPWHFEGCIPLPGKPLIWGALGPPRCLALAQEQLIVVLEKIPICIYLGNLQHELN

SEQ ID NO: 921910 - protein, 135 aa, Homo sapiens
MLRVSSPPLEGRNEWNLKEVKCLQNAPQLFNNRIEMQNWAFHASVPLFPLSSNHGDMHSTMHCRIMSWKQPGFLSDCVEERCTTESFNPDGMRPYPELIDTSDPFSSAPDLIKPKGQFATCFLSHLNYLDCVAFA

SEQ ID NO: 921911 - protein, 231 aa, Homo sapiens
MSTVNWYQKQGATEKIPENVEVTLELGTGREEGHHPPPQNGRSTDSLHCAPGKAADTQCQPVKAARRKAMPCKVTGAEPPKTIGTHLLHQCDLDGRTLPQTNIAGPDPICLCVQGSQSLPDPAMLHHVAPSLAEADQPREVAHMTQGCVSLHCPSWEETFLLTLKKQAALLGRPMGQVAEGGQQPARTEVLCPAACKEPVPSNKHTSWEGDPSPAKPQKRPVTDDTLTAAL

SEQ ID NO: 921912 - protein, 158 aa, Homo sapiens
MWHLSPLPLLQQLHLLTSGSLQPHEVPVVATPIIRAPGATCMTSVLSKSSEQADVFKGDTQWIKNMRSLPFSLGDNHMPMQEMIEISSIRFKTVFRLFGISIKPYIEGLSSPPTDWAYTGSQWPWTAYNTAVMQQQAPPVVDSAQRSPLAACWPDILW

SEQ ID NO: 921913 - protein, 144 aa, Homo sapiens
MTAPLQPQTTGTNTVANTHGQDFHYCTAVMRNKFPLECQQRPNGKPERLPPLAVMRQCLPLPHQGEVTASTHKWTSTTLIAGKVLCTQSLAGLYKGLVLLSLEIFPSPASTSHHLPTLTTQGSMSLLERHPLLILSGQAVQQVP

SEQ ID NO: 921914 - protein, 137 aa, Homo sapiens
MEAVAGPHALSYTPCHSTPDLPLAESKALTLFNYVKTERSKEAIEEKFEASRDWFTRCKERSHLRNIKVQGKAKGAVEEATVSYPEDLAEIPEEGGYTRQHIFNVDETAFFWKKMPSRFFIAREEKSMVASKLQMTS

SEQ ID NO: 921915 - protein, 248 aa, Homo sapiens
MSLCGSRRRPNTFRGPQNHKLCSTHSLQPNRHTPAKAGYAIVSSTTIIEATTLPTSTTSQQAEFIALTRALTLAKELRVNIYTDSKYDFHILHHHAVIWAERGFLTMKGSSIINASLIKALLKAALLPKEAEVIHCKSHQKASDPITQGNAYADKVAKEAASIPTSVPHSQFFSFSLVTPTYSPTETSTYQSLPTQGKWFLDQEKYLLPASQAHSILLSFHNLFHVGYKPLAGLLEPLISFPIMEIYP

SEQ ID NO: 921916 - protein, 258 aa, Homo sapiens
MALVPSARYVSAPGPAHPQPFSSWNDYLGLATLITKAVDGEPRFGCARGGNGGGGSPPSSSSSSCCSPHTGAGPGALGPALGPPDYDEDDDDDSDEPGSRGRYLGSALELRALELCAGPAEAGLLEERFAELSPFAGRAAAVLLGCAPAAAAAATTTSEATPREERAPAWAAEPRLHAASGAAAARLLKPELQVCVFCRNNKEAMALYTTHILKGPDGRVLCPVLRRYTCPLCGASGDNAHTIKYCPLSKGRRRPSHR

SEQ ID NO: 921917 - protein, 157 aa, Homo sapiens
MGGCTRSWLRNFPALTVQRTPKMLEGTGECANSGAFQPCFAEWNNEAHLPLPEPPSSHRPSLYSGTWKASRMTNAPPAGVAGHDDGKRVSNGPPWLTPDLIDRRPSPQPGSAVQAAAEEFKGQPWSLVSQPAINNVCICDNDKPAVLEESLLRSVYK

SEQ ID NO: 921918 - protein, 124 aa, Homo sapiens
MRHSLIHSFTHSFINSFTHSFTRSYISQFSGPFQASVPGVSTFIIRLGATNGNVEANTHDLGCSDSQIARPKFMIFCCVIGCHNGNDALHNGSSGEETEIGESIKCLEPAGVRAPPGSLACHSA

SEQ ID NO: 921919 - protein, 176 aa, Homo sapiens
MEHLPGTGFGLGARPQPLPDGLVEPRALSLWPVFLLPNDSTPKHIKSNCRAWRIFLTVSSQGKLTSLLPSSFDLTAFLPFSWQVAAHPPVPDPNLASSVKLFIAASAEGTMAWSSRPSVCPMITGLALLPPALNFVSVCLICLQGLQEQLLCSLLGFVTFLTFVTFWAECFLEVTC

SEQ ID NO: 921920 - protein, 140 aa, Homo sapiens
MKSQKSLDRCYLAPCLLCTGKIELEDQGNEDPPHSGLGTNTTTSGKPFLILGKCPQWIGGCPPTLRRVISFTESSSANADLTQKQCLAKYLGTPYSVKLTHKLNRNSKGKKGPIPAEGQVKLEKLSKGLECQVRRFDLTL

SEQ ID NO: 921921 - protein, 196 aa, Homo sapiens
MARDWQAAPPAAPLRDPLGEASCAPESGGDLKVCKHTNQHPVSSSGFVNAPIDTLYLATLVGTWRTFVSTLCIYLIWWGGGEPFFTPEASETTSPPGGTNNSRRAALRAVTLAAKVCSFTPEPARPRTHQKEETPNTSEHQKEQTPDTPPLRTVTLTERVRGFILEQPEPHDTQSSPESATNQVDDTNGLQWHLKI

SEQ ID NO: 921922 - protein, 155 aa, Homo sapiens
MDRFLSVIFCMEVSLLSPGHILLTSEATLYPRHAAPAPYLHNELLFWGLFLEEHLIKWKEFRLVETALGAPYLSRILRAFVGCQSWLSEQPQCSDSTRVVKSISGLYQLDASSTPLAAVLTTKNVPRHYQMSSGEQNTSCLKIIGLDICILFAWG

SEQ ID NO: 921923 - protein, 181 aa, Homo sapiens
MWKEREAYEGRRNREDTGFELMNRVFIVGFLTSQLGIAGLVLPAVIYWIKKMWHMYTTEYYAAIKNEFMSFTGTWMKLETIILSKLTQEQKTKCHMFSLIILDAGKLEDEGPSRLGVSRGPVPHRWKLEDEGPSRLVVGRGPVPHRWNLLPVFTWCKGWTSLLAPLYKGTDPTDEASALIT

SEQ ID NO: 921924 - protein, 146 aa, Homo sapiens
MAGGPRLLHVLLLFGITRARGVKPDDATLTTILTWSKHTDCLRSVIECRNMPRNVDFKGTLSTVDIAVTLYWRVPITDPVLLLTRRFNGPVGIGRPSGLIQSFVSLSLLLEPLTGDMEGSPVEQKEPWTAPWNLASPLCVTDLLWG

SEQ ID NO: 921925 - protein, 141 aa, Homo sapiens
MIPLLTWCSQRTGLKLYRALYVGAIIGIMENHRQMEASALQINICSKGTDLCMIDAGKAKLSQDTLNFTQAHKALGVVPRFYSRFYSGPQSQWGWLPQWPQFLTDFSAHAYCSVTEVSHIEEVEPVSYLRIWTGLRTCFDQ

SEQ ID NO: 921926 - protein, 148 aa, Homo sapiens
MKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGVYEKCKAGIENDGGLERWTCRPTGGREDEHQYCYIHNDNGIQ

SEQ ID NO: 921927 - protein, 513 aa, Homo sapiens
MTVDYHKLNQVVTPIAAAVPDVVSFLEQINTSPGNWYAAIDLANAFFSIPVHKAHQKQFVFSWQGQQYTFTVLHQGYINSPALYHNLIWRDLDRFSLPQDITLIHYIDDMTLIGSSEQDVANTLDLLSKTVKIFVSYVSVHQQVTSAEEDFNNQVDRMTHSVDITQHLSPATPVIAQWAREQSSHGGRDGGYAWAQQHVLPLTKADLAMATAEYPICQQQRPTLSPQYGTIPQGDQPATRQQVDYIGPLSSWKGQRFVLTGVHAYCGYGFAYPARNASAKTTICGLTECLIHCHGILHSIASDQGTHFTAKEVWQWAPAHGIHWSYHVPHHPEAVGLIEWWNGLLKSQLQRQLSDNTLQGWGKVLQKAMYALNQPPIYGTVSPIARIHRSRNQGVEVEVAPLTITPSDPLAKFSLPVPTTLRSAGLEVLAPEGGMLPPGDTTIPLNWKLKLPPRCHLPLSQQAKKGVTVLAGVIDPDYQDEISLPFHKGNKGEYAWTTGDPLGCLLTVYYCAL

SEQ ID NO: 921928 - protein, 212 aa, Homo sapiens
MTGPPGSALLAGDLSRVRRRTQSPLCLLGLKTSALEVLPGIQVTQCSSVLGGPLLNATHARSMLLGLCTCGNNPAVGGSWEEPKCFATLLPVVCLALGQMLPTLACFTICEDPSLWDFWKASLSLIYFLLKVGALATHNTQTNMKAGTLEYLQELYQSKSSPERGTKRDKAGPGHDWKILKDFIKHPAETQKFWMYSNLLIYVSSDLNKNGD

SEQ ID NO: 921929 - protein, 134 aa, Homo sapiens
MAVITCEMDVLKTACQWVLVLYPAYHSVPFNWGHLAHLHSKLILIYVDLILVLAGAGVPDTMCAFATVVEAMQLAGKGGPCWLVTITLVVVLTWGEEHWQMQLRAFPTLLFPSLLLLEAAEKALLASRRALLIP

SEQ ID NO: 921930 - protein, 143 aa, Homo sapiens
MNASPMGRGVDNSKRHSMSCTEIPGITFHINCLHTVPSFRPCFGGCRWLTVIFYCEPMMLHDEMFCHLFWCIAVHDAEASFGSGLRIVFIHLFPYHRCGFYQTFISESRYQLLTDLSAATLNLPIPHTTWRFPIVLKCLDQAH

SEQ ID NO: 921931 - protein, 361 aa, Homo sapiens
MERLAERWMAAQMGIGIRRPLLAAAQRRCLWVRVHKTRDIFSAHQNPPEDSVEPRLWALSPEFQSQWGLRSYVSNKFPGLAEAAGGGPHSENHCPRLSVKDLGSHPIPLPAALGPLAPPLCTSVSPLGHGSRTCCPLPCCPGGSGSCSAAYHQKGFSRVPLVCILARSTGRPQGTGLHLCCKGGWETEEPEFSIAADRHGIASKYKRRAQIWGRKNILVVTPIHCSPPLASIHMQKATIIIIITIIIITIIIITIIIITIIITIIIIFIITIFIIIIIFISTIIPTLITTTTTITIITIIIIFITITIIITTTIIIIIIFITTTIIAITIIIIVIIATTIDAFAYSGPSSWIALHSFLLHV

SEQ ID NO: 921932 - protein, 155 aa, Homo sapiens
MLTIVLEDGLEVVETRSRETSQEITESMRGGGGESVVGEERGEAVGRQNEWQWRLLRCGDEEKIDALTCLGAERERVGKRERGSQRDWQTQSLQINENQQHLLTIGDEVCPRGVWSCTCGRVSMALCEFVCAAAWEFVTCMCVGTRQQLWLLQSF

SEQ ID NO: 921933 - protein, 156 aa, Homo sapiens
MGLPTADDMVDCALLVSKLDCQARLLVRIQLSLIAISGSPGNLASDAWGSRSSRTLPCFCQASNNKNLFFARETDMSQAAHRELGGLYHAAAICTTRLFPRALKTCQEVTKARQFRVHSPVSSKHNSMLSKGTFRGCGLQSQRSFPPSSLGSGEMG

SEQ ID NO: 921934 - protein, 180 aa, Homo sapiens
MRSCSLKANVSWGQRGENSECFWFPVQYYREQDKQPSICGPLSYAFSISETLSFLVLSRLGYCNLESTAAAAHIIIFQPSFKKRIKKNLDGLQYCGKATDLDQRAQTPSPRLVNEKPWVYVPYPQKSYKVYLLFLQQTILGLDLNYAGEGICVPHVGPVKGYSVEISTNKSKDEFPALNR

SEQ ID NO: 921935 - protein, 138 aa, Homo sapiens
MASPLSQHKFEINPQSILNGVVPELSLQEASELPFFSGFSQLSLEESQRSSVLELGEALSILSQPSLDLGDEHKWTASKALLSSGFCLCLTKRRYQKIKEQEDAVAAPSSHLIFSFIYLFIFFVTPSCYCLSPLKTSS

SEQ ID NO: 921936 - protein, 239 aa, Homo sapiens
MFTFIIIGAPTSGQCRDTRRRAMSRRLREPGALRAPAVRVLELGRLRAAAPLSCPGDAGTQRSGSRRRPSRRHDRPLGGLAGRAASPQSSRRADGGGGAMSQRQVLQVFEQYQKARTQFVQMVAELATRPQNIETLQNAGEPGARTPVAPRALSPRRLRPAALPVELLGSRSVGTGVRKSIHSFQRVFGGQAERVKLPDGCGRCALSLFPSSLHTGKCQVESRGPRNCLESFYVNGTLP

SEQ ID NO: 921937 - protein, 485 aa, Homo sapiens
MSLLFLYTQLYLTLLLCFPKYQRKQSGLQSWTLRIPFSASLYILTLNSCLPLKILQTQCLNSPGLFYPKGSGIAPIYLARHPRLLAQDLSQFSYLDTVVLRYMDDLLLAAHSETLCHQATQVLLNFLATCGYKVSKPKAQLCSQQVKYLGLKLSKGTRTLSEECIQAILAYPYPKTLKQLRAFLGITGTAEYGFPVRWTPEAEVAFQALKKALTQAPVLSLPMGQDFSLYVTEKTGIALGVLTQGRDLTVWISYDVNGLLTAKGDLCLSDNCLLKYQALLLEGPVLRLRTCATLNPATFLPDKEEKIEHNCQQVIAQTYAAQGDLLEVPLTDPNLNLYTNGSSFVEKGLRKAGYAVVSDNGVLESNPLTPGTSAQLESFAKETSSPKSNLEKENLEYKVENERLLQIISELEEEIQINLKENSGLAKMSVASIDEKLSALSHTWILNLLLNPYLTGHLNSRKKAANVKGSCEGHSPARPCVHYAC

SEQ ID NO: 921938 - protein, 139 aa, Homo sapiens
MVALGHMDILVLSRKNLEPWIPVPFLELGPLGPVPVSSFLFLPGVLCGLNEIMNESNTSCICVGLPAAATVDSVLMNFILGGRQTRSQRAQYRELSRRLVFYQLTTQPPAPSPATAAPCPAYGGVFGFQLITTSMSLLR

SEQ ID NO: 921939 - protein, 145 aa, Homo sapiens
MSVSSAGAQKAKMPKKALKEDQAVNLKARYSSTVTLLRAEVVLVVKVWKAMVGVTLVAFGCIRQEHQIASDQNWNNLVCPHFADVAQQQEGAYDNRKKLYTAPYFNKVNTCVLTTQVKKEGIRSGFTVPVAHPVPVTSLPNWQIF

SEQ ID NO: 921940 - protein, 137 aa, Homo sapiens
MVEKFQARAKFIKDKTTLSAFGCRHTLPASLANGKQIHRRKMGLALEKGRLTRAVWVEEVVKGNTYLIMAWSKFACRAVTGAYHLLRDRPLGRTVVGLCGVKACRRNVSHSCLRILAFHITMWRKAPEKAHYFIFSI

SEQ ID NO: 921941 - protein, 137 aa, Homo sapiens
MFKSAEVVCCLLFSYALATEKRREKIQISSVRNENGGITTDIADMQKLSLHYYEHLYAHKLDNLEEMNTFLETYNHPSLNQEEIEVLNRPITNNEIESAKKQKNANKKKASAPCIHSQILPDIKESVSILLKLFQRN

SEQ ID NO: 921942 - protein, 148 aa, Homo sapiens
MDPFLVSPWHQNEVKAACCAQKTFPWSASSQCPSTTPAPLHNCSTTHPQCHPTGTLHLPATLPTHLWTRCSPSTLILFLSFFFFFLFLFLKWSLTLLPELECSGELWAHCNLCLPGSSDSPASASRVAGVTGAPHLAWLIFVFLIETG

SEQ ID NO: 921943 - protein, 132 aa, Homo sapiens
MLSYRGFHLLSTCTGGSHCNSFFPNRSFPVCPPSPHPESGFGNPAIQEPTGSMTQSCFPYSSDLTLLFPFWVTVRQETKSRLSGQFLHKEMCVFGNTECGTVTCRLFDEWKTGVRFLCVQTLHHEERNRNKN

SEQ ID NO: 921944 - protein, 140 aa, Homo sapiens
MLPEEEPVNEEVPYDLIPESSGKISQPCGDEGRKFQAQKGRGKAQELSCVWFTPHSTNYREGAWDRERTTGKTLQAWSSGGPSGAAFHFVYTRYTIATRMIPRMLREWTLALGTVIPPWTPAAPRTPSSTLASHTYALCE

SEQ ID NO: 921945 - protein, 164 aa, Homo sapiens
MMVHKAFNRVDTFVPNKSYLSMELCSQEDYDSLCCVRQVIRKVGENQQSQASPSSYGKEVSYETIQKASLTPTVSCLTAPILFPGSGKAGLRTCPRLPASQLRKQAGLLYLPCCGVCKPDLCPFPSSGQETLHLVGIVTKFSWSFPSPCGLFPVPLAALPKGPL

SEQ ID NO: 921946 - protein, 174 aa, Homo sapiens
MGKLHVAEVCCMDNPVIQMRRLRLCEMTMPVRAEPGFLARNVQARIPSQILQTHSVPPKASMKDLGERCESSWAFTSSPEITRCQSAILVKERASNSSLTIPIRRRKLAMFSATDTLYSHSHLFCCQEIFTTAQCVQHHESERKQARGLALITRGRGRAVLRRRGRADLGRCQG

SEQ ID NO: 921947 - protein, 137 aa, Homo sapiens
MDGMTEAVLWPPSLRLYWLLKSVAENWAYDMTVWPKIAFSLFNIFHMRLHRFYLGPQQYGCCPLTLDEGRSSNVSLFQKYPHRYTQKQCFIISGYPLIQSSRHLKINHHRWNVSFINSSEKLIENIFNVVKYKWKYL

SEQ ID NO: 921948 - protein, 178 aa, Homo sapiens
MKKINFIRTYDQTQMNIHKLKTIQENMTSQNKLNEALVTNPGETEICDLSDRELKRAVLRKLNEIKDSAEKKFKLLSDIFNKDIEIFLNQAEILELKNAIDILKNAPDSLYSTVDQAEEIVNELEDRLFENSVREDKRIRKNKAHPRDVENSPKMANLRVIGFKEEVEREKDWDGKFI

SEQ ID NO: 921949 - protein, 204 aa, Homo sapiens
MILGVPISCFAEGAKKLSLNEDYYISVFCGQGWQFEITYKIPVSRILSSVNIMEHNSFTGSFLNVGGRLSAYFEDQSENIWQKTSYDLGPMIGKMSTHSSRGIIDIITTVAYVLCKNKYAQTLHWLKGCLGKFNHEDELEIDLKNELQIIEVNPQKSIIQHRCRHSFDQFGFLFMLAPVLGPSLPLGWFWLQSDNLQGPLWEIK

SEQ ID NO: 921950 - protein, 124 aa, Homo sapiens
MGVNPLYLEIWGREVIPLGCTKGIQIGKEVKLALFTFGVIVCNENFKESTESEKKSEKLNQINLLATLRSRRADPKDSRDLYILCTRERAPYVEMWGLKIQGPCWARRGLRVQTGADDEESDKH

SEQ ID NO: 921951 - protein, 149 aa, Homo sapiens
MISFDSMSHIQVMLMQEVDFHSLGHLCPRGFAGYSLPPGCFHRLMLSATFPWAWCKLLMDLPFLGLKDRGPLLTAPLDSAPLGILCGGSNPTFLFCTALAKVLRERRTFRAHKAGGKEGPWAAPRLRANHGRYGFRYVTKRSPTKAETV

SEQ ID NO: 921952 - protein, 180 aa, Homo sapiens
MFAQDPSILQSSSGKASQACVLPMKAVRAPKPWMGPEVLSGNQGLESKTLEIYKKEADPGKVSFNEEKMEEKAVPERAPKALEGPVLFGKYWHSREERRKWSSHHCPWDDKCEDKSQCNKEGQNGQARDSALEGHKDKRLAFPGAKHRNMSPGAVSYASPVSSMGDSDGLLSNINLFIVS

SEQ ID NO: 921953 - protein, 136 aa, Homo sapiens
MTFSVVEKPVADRNIYFCESCQTLLSNLLLSHVSRQVVPGTVGQVPLSVQSVLTISWSPSRLQFFPVGTEREVFHVISDCAAAEIGVSCSELQARAIYIFPSQAQVREPWPYLHIEPSSTSWAAGIQPLPSEDGPV

SEQ ID NO: 921954 - protein, 142 aa, Homo sapiens
MLQMNSTLNKSLQAAPRPSADRQWRVLGGCVARGRGQGSQGNGKTLIVGRTSSYLLRSVEVHLILVIHNEKALVVVAENKDKEQERHPREFVVADWLSYGSASWVHTTHTCRGTLSNELDLRFSPAANTRAVCQKQRLIRKH

SEQ ID NO: 921955 - protein, 135 aa, Homo sapiens
MTYSEIIIYLPVLYFTRVHVKRPPNRLCVSNKAFNQLGAGGLSPKRESAKGDGVGLFYKIWEGQHSPASKDYLFTLRVKSGSLGIAPGDISCDDLEKQSAKPRRSGKESVREPWARVPGALEVAASFISCWEQIG

SEQ ID NO: 921956 - protein, 140 aa, Homo sapiens
MLCMKNIALQEKQGFEEQNFTGRIGLAEGAGLYDSKVVKEEKAFGGEAFVVEVLPEEQLGFEEGAGSVGMSIILYLIASGKSWHCKVHGKGWGAKWGCTWLPAKYYLHVPQPHEEQSDSQASHAWPECKTPLSLSKPVKR

SEQ ID NO: 921957 - protein, 130 aa, Homo sapiens
MCFIPYKNVLVIVMVNIECHLHWIEGCKWTGKRDLPSISCQQGLNKSREKNMERLDWFNLVAYIFLPCWMLPALEHQTPTSSAVRLRLESLLLSLQMAYLQVGPHLMIVERAEIVENQTQALIMCVADLQ

SEQ ID NO: 921958 - protein, 268 aa, Homo sapiens
MAAATPRQCNSPVVLTLALSSKQAPGGTHKCILWGSECTVVLPPKAVLLPSDNFIITFHHCTFGREQVSLVELQYLPWRHVKLDPLSDLQSILTWSISPALELMTTLLSYELGFKRQESKSGAQGDTGWGGSHRTSADVKDKVPGGAGSLCGLRTRLTWMGAHGAGVLLSQDCAGTPRGALEPCIQEATALLTCGPVGPWKSVVLEEEQEGTGTSLWGNLSSDDVLPAGCKEWRAQPLAYLPQEDWAPMCPTRPAPPDSEGSSNSSDY

SEQ ID NO: 921959 - protein, 353 aa, Homo sapiens
MPWFRAVRGNHEQMMIDGLSEYGNVNHWLENGGVWFFSLDYEKEVLAKALVHKSASLPFVIELVTAERKIVICHADYPHNEYAFDKPVPKDMVIWNRERVSDAQDGIVSPIAGADLFIFGHTPARQPLKYANQMYIDTGAVFCGNLTLCKVCGEYFVPKFHDIRIRWCSPEHGAILAMEERKKDNVKAAAKRIKEQKEAEKDGRKRRKERLAELRPDGYYKAQAQKAFNAFIRARDADLPCISCGETNPPDLHGGQWDCGHFKTVGAYPELRFEERNAHKQCKSCNAGAGKYTAKEATVAQQYEAGLVARYGQGYVNWLNGPHEMTNYRREDFIRIRDEYRDKLKALKQREAA

SEQ ID NO: 921960 - protein, 161 aa, Homo sapiens
MHRLQSLTRRPSQAAGPTSDRIPYRGNRRKPRAPETARRPSPSRDTATVKAISLSEKPSKGRIPYLPGERHLDGHGDHLGQQAAVESRHEGSRIIVGEHQCHLWDRPERVSINVGSWLPKTPRKSLVLGERARFSENQILCKMHFSKLCFNKHHTPGLEFI

SEQ ID NO: 921961 - protein, 162 aa, Homo sapiens
MSSGSWMVTEDSPLLIHRPRAADHRGENMNVHTHKKDGLQRKTTIVKVSCRTGVLAISAWFSAPVSDALFILGAMVEQGPQNRSTSVNLRLSSRMEGVKIETKTNSLTGAFHPIRSLCVCLSACVSVLCIHACVFCKCVNSVCTCEYEFVHVRACLCHVLHG

SEQ ID NO: 921962 - protein, 157 aa, Homo sapiens [sequence omitted]

SEQ ID NO: 921963 - protein, 149 aa, Homo sapiens
MVKQSQKPPREKAGRKHRQVLSPGSLYGERLVGGRRRTWRGRRRLAVFTWTNLLVVVVELDGSEQEALDLVPLVTNVVLEEHYLIVGVVVVVDIGVIPINSRGEKQRMHLRDGFLADQLDPIYRCRHCSPCPLKRADTGQHSPEYSHLW

SEQ ID NO: 921964 - protein, 137 aa, Homo sapiens
MTPCAKQPLHRSSVTASVQVDRPFLVRGAVENAEHNFTVANPILTHLRWNTHTPALECTHARPKGGPTGAVLLVTWFVLDRSRSWAKDAAFGCQMDKDNLGWNSQVLVLPDTQRFPTIQLIESICTQDSRCLSPNYQ

SEQ ID NO: 921965 - protein, 142 aa, Homo sapiens
MKSFKWFYELRSMKEKTVEKTSPGPVPISYVLKFDDFSPLAASYKILNSLQCRIFGYEMKNSRSTDSLHHVSGKATDTQCQPMKAAGREAVLCKATRAELHKAMGTHLLHQHDLDVRHGVKGDHFGALRFDCPAGFWTCVGP

SEQ ID NO: 921966 - protein, 171 aa, Homo sapiens
MLLRQLHYDACLATLFRFPWSMGKHCPSFSSLKLNHLISPLSHPVIACCSSQSLAFSVLEMDGNQAKMPANACGCSLALLRTLVVLYGLEAAPGPVMSGLCKHPARKKGTHTESHGHLSLEQSQLGATLRAQIPGIYRHSCSCSKEEEARLGAPMHPREGACHSAISCCGD

SEQ ID NO: 921967 - protein, 152 aa, Homo sapiens
MRHWAFYWSNNLILLCTKIKEERKNSLECITNIPNALQFTSGLKTERLKENKIFLVQLKKNIFLTKHSKEMYFRNDFQHLLCAKHHARCYVGQEMKATQFSPSHNLTIQLERKIPLAQDRMQNGILQVGQPGLGGYRIQINRKQNKIDENPV

SEQ ID NO: 921968 - protein, 151 aa, Homo sapiens
MGMPPSLGTSRVPGVKFQFKVFYIASQISTAFVITADGRGGTSAILNNSYFFYICIYNLKVQGEAGSADAEAVTSYPEDLAKITDECGYTKQHIFNVDETVLYWKKIPRTFITGEKKNRHSHANLQQHHPDQSAAINVEATPFTNKKIMTR

SEQ ID NO: 921969 - protein, 136 aa, Homo sapiens
MRARTNPNSTFTHRIPKAPTPRMGEKKDVLTSCCTSNCAVQDSLNIPEQMQDPCSLAPLNFSTALPLTRLSDGVAQCPSERLKSLGQWTVDSEGGCLSEGRQWHSQGPHSHLLTYGVWGSRVLHRRACSFCAYFLL

SEQ ID NO: 921970 - protein, 150 aa, Homo sapiens
MSRPPSTQGGLQQVSRKWDCEYNDIFLPFWIQIVCNLAYHVCSNDSNSLSFKNKYIFSADSKATYVCVSKKQAQLANKNHKEITVYNDSKSQKSEKEPNRNLKLKISINEMKNTIKSFNNGLDQTEERISEPEDRFSEITQSDKKRKKKE

SEQ ID NO: 921971 - protein, 173 aa, Homo sapiens
MLGVFYPNIQVGCTGSIVASASGEASGSFQTWHKAKRKQAHHITKIGKEREEKGATRFEMTRFHENSLLQGQHQGDGANYSIEQRKTSYRDAYLTVWDNPEEIPISGIGFGKDGLALDDKVLTYYCSVNEYKDEQPLYMYGRFDGESTSLRGTELPFGALILLLVLNGGLVVT

SEQ ID NO: 921972 - protein, 152 aa, Homo sapiens
MLNDELTVSGESCSLLPRCRCNAASFREEMKTQHYQKTYYSGEKGNKSEVTEFTYNSDIHSSLLKGNMSGKAFIFLPCWILPALEHQTPDSLAFGLLDLTPVVCQGLSGLRPQTESCTSFEALVNCAKCPSSRAEKRKGNTKDSVKFQGQYV

SEQ ID NO: 921973 - protein, 150 aa, Homo sapiens
MQVDRLLQNPLENLALGHNRNKKHVVPGWPQRDRATSRLLESLIPELASWTAFLDLPGARREFTGLKEARVQTSSDSEDCNKYLILQCPDTNKHLKVLRQSRKIGPHQVNEIRHQGPILEKQIYDLPDKEFKIAVLRKLKEIQGSEIKDE

SEQ ID NO: 921974 - protein, 134 aa, Homo sapiens
MTDDSSMRVTAPGGLSVGEDVEVEDSDIVDSDPYHSEAKIQQRNNNNKRKLQANIFDEPRCRNLSKILANQIQQHIKSLIHYDQVGFIPRMEGWFSIHKSIIVIYHINSTKNKNYLNILIHLEKHFDKIQHSFM

SEQ ID NO: 921975 - protein, 143 aa, Homo sapiens
MGAIPPCCSHDSEWVLMRSDGFIRGLFPFACHFSVLPSCNNARDITKVSRNIVHLISLTVTVFSLCFYYPPNGCVQSVDGSQSNDHNQGRFNKEILLLATSKENMGDNFQSNASPNSNKNRAFIGLLGCIIVCRGGVKAAQVQ

SEQ ID NO: 921976 - protein, 151 aa, Homo sapiens
MCGVLSGLRDRLMMENIRELKADSLSTKTELFCGSHENVSVQLQGLRLNKGPAAGSEIHGSRGAIPLGCSQPMTVQQGFWGHLVAEQSKCKQGNCQTLIKPSDLMRTHSLSQEQQAGNHPHDPITSPGPALDTWGLWGLQLKMRFGWGHKA

SEQ ID NO: 921977 - protein, 177 aa, Homo sapiens
MDVISIDKMGENFCLIYDTKSCFDVHLITPEVAKYKLCRVRKIFVGTKGIPHLVTHDAHTIHYLDPLIKVNDTIQIDLETGKITDFIKFDAGKLCMVTGGANLERIGVITNRERHPGSFDVVHVKDANGNSFAARLSNIFVIGKGNKPWISLPRGKGIRLTIAEERDKRLAAKQSSG

SEQ ID NO: 921978 - protein, 216 aa, Homo sapiens
MRRKKQQKKQKRKRKKRKRRKKRRKKKEEEEEKKEKKEKEKKEKEKEKEEKEKKKKKKKKKKKKKKKKKKKKKKKKEEEEAEEEEEEEEEEEEEEEEEEEEEEENRKKKKKKEKEKEKEKEKEKEKEKKKEEEEEEEEEEEEEEEEEEEEEEEEEEEGESIQCGLHLRLWEKSRPTSGVILTMVDNDFPSNSSRTAFSKDTVRLQEAMRWVRGRNC

SEQ ID NO: 921979 - protein, 264 aa, Homo sapiens
MIGRDTDLQRLGSSAMAPSRKFFVVGNWKMNGRKQSLRELVRTLNAAKVPADTEVVCTPPTAYIDFARQKLDPKIAVAAQNCYKVTNGAFTGEISPGMIKDCRATWVVLGHSERRHVFGESDELIGQKVAHALAEALGVIACTGEKLDEREAGITEKVVFEQTKVIADNVKDWSKVVLAYEPVWAIGTGKTATPQQDQEVHDKLRGWLKSNVSDAVAQSTRIIYGGSVTGATCKELASQPGVDGFLVGGASLKPEFVDIINAKQ

SEQ ID NO: 921980 - protein, 150 aa, Homo sapiens
MGKHCPSFSSLKLNHLISPLSHPVIACCSSQSLAFSVLEMDGNQAKMPANACGCSLALLRTLVVLYGLEAAPGPVMSGLCKHPARKKGTHTESHGHLSLEQSQLGATLRAQIPGIYRHSCSCSKEEEARLGAPMHPREGACHSAISCCGD

SEQ ID NO: 921981 - protein, 157 aa, Homo sapiens
MIQGSVLRGTFHVRPLTFGVVYDTTGANRSKHNSGEGWAFSEPITKTVNTVPNRGFPHPVLIKSVQSSSWDIVESALGKHFLQCSERTESCHSTELTEQALQLLLASLLVNIFQLPARTDMALQATEREGKYERTISVPIGSQQLIGYGQQGKPGVD

SEQ ID NO: 921982 - protein, 146 aa, Homo sapiens
MIVAAKPPFAGSITISPLSISNPSIDNEDIVEPCYDTRLDEVLIFKFLPIDGLATSAIMACEVTTLIHKPWNNSVKAGTLITKSFLSSAQSTKIFCCLWELVCKQLKGDAAQGLAVDGNVEEHGLPLPSCEALQAHVPFHKLHPPY

SEQ ID NO: 921983 - protein, 260 aa, Homo sapiens
MPKGKKAKGKKVAPAPAVVKKQEAKKVVNPPFEKKPKNFVIGRDIQPKRDLTRFVKWPRYIRLQRQRAILCKQLKVPSAINQFTQALGHQTSTHKYRPETKQEKKQRLLALAEKKAAGKGDVPTKKPSVFQAGVNTVTTLVENKKAQPMVIAQDMDPIEVVVFLPALCRKMGVPYSIIKGKARLGHLVHRKTCTTVAFTQVNSEGKGALAKLVETIRTNYNDRYDEIRHHWGGNVLGPKSVVRIAKLKKAKAKEFAIKLG

SEQ ID NO: 921984 - protein, 149 aa, Homo sapiens [sequence omitted]

SEQ ID NO: 921985 - protein, 238 aa, Homo sapiens
MSDLMFFAHFNSWHVVMMRDLVILGWDLVQSLTSWPTVTSTPNISFLPKWGCRLRAFLLPMTLEKIAPEGAHYVDGKHQRQDSRHISVSVDVDMWLPSSASWSVHISGQHLVAVEEDAESEDEEEESAKLLSISGKQSVPGGGSKVPQKQVKLAADEDDDDHDEDDGDDEDEDDEEDDDEDEDGGDDEEDDDEDDEETEEKVPVKKSIRDTSAKNAQKSNQNGKDSKPGCLKISEQHL

SEQ ID NO: 921986 - protein, 179 aa, Homo sapiens
MGPLQDMRAPDPWNRQARPLSQTLLVRTDGSSQGKPEKPNSSEEVLLYLLFNNQVYSNGTLQNSKLEDKTAPPPSLFWLYLAIAPWATLVLLVGTLVSELCHLLFFGQEQLPDKPLSHCEYKQWGCPAHPPRAEPDLNPDPLPPSSQQALLSHGQMDDGCIMRNNSAHPGRGPHDARGV

SEQ ID NO: 921987 - protein, 143 aa, Homo sapiens
MGVFNFWLLLTKLSYPLLILKLQQGLPVFLVIAGDAWTAFYPLDSGSTEQGGSCTALLRRIYDPGYHRPHHFSYYVLNTTFIYITHNAKKAFESGTPGLDLPNQDWDGDHLMLAQLYIHHCTQKGCSSWNQESRNRKHKAQFC

SEQ ID NO: 921988 - protein, 145 aa, Homo sapiens
MGHGQPVKAAAGVVPCRATGAKLPKALGAHLLDQHALNLRHGIKEDYFGALKFDDCPLGLTWQLSKLITSNIFIAAPYLLVENDRGRSCRNSIALSFTYIDQLPVSTIPSGFNEMKRSFSHTRRLGYPEFKYVGHLLTWSLVQDS

SEQ ID NO: 921989 - protein, 148 aa, Homo sapiens
MSENMWCLVFGPCDAVGLLEFAGGPLQNLFFWVSPVEDAEQQILQNSKYCCLLLLLEAWSQRGTHLYEVYALPPEVESTEAASLAELQCALPSSSFPGCFFYLLKPQQWRTPLPLPGCCLTGRSQTAALAVSKALWVWVPHPQYNLLV

SEQ ID NO: 921990 - protein, 141 aa, Homo sapiens
MITGAESQQVQVQCGLCGEHAELPSDNCKHQLFLPDGLQIGISVLCVCPIPMAHSADVEHNSLHNCGNICLPDHTITAAITKVFEMEGISPNSNIWSSCTERKKKDSEKFILKFMVKGGLEPMNHNYLWFLLYQALCTYIG

SEQ ID NO: 921991 - protein, 134 aa, Homo sapiens
MPFSGLEITPPHPPQLAAEHSSQRPDDGPTLPAATTTVGTHLHAPPAGLETDTPSPLQPLLTPAWATRESEGCPTTTTATAHAMPTVPLTCSSLAHHLLIHPRTCPLTLLIKDDVQDKCVKYSFLKTLPSNQRV

SEQ ID NO: 921992 - protein, 156 aa, Homo sapiens
MRARNTWTAQGGKSHKGILKPHSILFDKTIAVGGGDYCKRTTHRPQDLQESQERPRMCDHEGRLLHMPMLAQVKGHANSLGFLGPLARELPYSSGMQFNPQQLISGGPGVLNTHQSAAEWSVHAPGTSKDDPLEVCEPPDPPRPYGVFHKRERSFP

SEQ ID NO: 921993 - protein, 150 aa, Homo sapiens
MAVFCAWTSQLPGVTGAGLVVFFRVTLQGLAKLLPSTYRSQSTDATLPLKWSEQVPKTSLTKFQMSGLQVPVPSQCLASVLILHGGLPHTALAMCPTGANAYQGALSGSASLGLVGVCCRDVPQGRLKSPKELPRPSTNHLASQSGNQEM

SEQ ID NO: 921994 - protein, 140 aa, Homo sapiens
MEKGGNFQVLPLQCKLTWYWRKEETISEESLFQVGKAEEYISVWGYLQISGSKRVVFQREEKEEEAASFHRKCQGDHKFHMEIQEIQNIQNDLEKNKFGGLTLPDFKTYCKVTVIEISLYQNLAKVSWEWEMGNKSKPTD

SEQ ID NO: 921995 - protein, 199 aa, Homo sapiens
MAVSEGLVPPLACQRTQRWVTGAGSPWDTIQSPQLGHLYHCPRVELNSDPMVRPSGNRLLTPGTSVLPGRTRQEDASLHPGCPPNLWNAAPGHRGGPTVADTYGNPEAGLPFIQPGPHSDLSQPIICQMGQSAHMGHLPDPLTLLGSSCWRCVCLPGRVIQGFIRQSIGDGSSGDSHGLAWTYGKFQQVDEKNRGKMKI

SEQ ID NO: 921996 - protein, 222 aa, Homo sapiens
MFLNKCRCKMSRKWKGRMMAVSEGLVPPLACQRTQRWVTGAGSPWDTIQSPQLGHLYHCPRVELNSDPMVRPSGNRLLTPGTSVLPGGTRQEDASLHPGCPPNLWNAAPGHRGGPTVADTYGNPEAGLPFIQPGPHSDLSQPIICQMGQSAHMGHLPDPLTLLGSSCWRCVYLPGRVIQGFIRQSIGDGSSGDSHGLACKTVSAGFRPPNPLLDNFPLPSIP

SEQ ID NO: 921997 - protein, 144 aa, Homo sapiens
MQSYSWLQQRQYITEGWDRVCSGQHQWHGTVGCTSSPTLTGVEKQGPPVHVCTGKAVREEYGEHWEMGIPGHAPLQTFPHQTLWALHRLKPCPYYLSSSSPRQLKCQWMLCIPCCQDSRVPWVAPQLLNSSLLQESMRVKNESW

SEQ ID NO: 921998 - protein, 250 aa, Homo sapiens
MCLKGMQTLNTISCGGRTLQNHSGEATQDLRSLPLASVYPGYKSQLQPMWLGVYLILVFSEKPAASGNGLIHEVNNDFSSLLSPKGEWVLQMPRDLSGHTVERAPLHQDLCTGRAGWLRLLNRVLRMPGDLLGCEAERATLQHDLCTGRVEKLRLQNQVSGCSKFLEIGLGMEWIGPALLQSQPMKSGVAQAASPCKWVLQMPEFLPEGRAERVLLHQGSSLGHSAMAHADLLQVSKLPLAISLTIQRIL

SEQ ID NO: 921999 - protein, 142 aa, Homo sapiens
MCQEMTFRPHKKKHQRIYTRSLHLDNEMLDPSSMMIAPLSLPKHEPTGRNEQLQTRRLKSSSKTTNPPEGRNSEHIRTSVGTNSGHAAFKNCNIHREAKIRVLVTEPGIIRHVDTLKECQQSCCKDIESLLYAFQFLIGQTQ

SEQ ID NO: 922000 - protein, 174 aa, Homo sapiens
MLWGLAVFHLAHSVSCSLLLPSKGLWFLSVFPLSSKHTHINMLETINTKHITDSRISVPREQTQVDGHQEEHAGRCQQAIDGGTKRTPREIRPRTGRNPGIQKALCPCNKAEGLIELINTSYLQMGKLKEHTVTHAHWGFRSCKHNPRRCTPKLPVIKSKQFVHKKIALQQVKI

SEQ ID NO: 922001 - protein, 144 aa, Homo sapiens
MPRICVSAHLGYYHKNTINNNKPLLLTVLEAKSKIKILADLVFETSRKPVQLKQCEESGNVQDESDKSGELAGHCKDIKSYFKTHKITKEEAIGRVKTKGKGITNHMEKFDFKRNNKERLTIPTTGAVVGRRWRVMKVEKDTSS

SEQ ID NO: 922002 - protein, 141 aa, Homo sapiens
MWDLDDNGLCMGRDYSISCSGLKIYYSEYLKVLYLVADIHDCYRCFVEVQKDYRSRPVLNLKLQSRILSPCEEEFSEEIGKPAEFSEEIGKPFKNPHIEDYEKAELFQVCSCAGQNQLLDAAARIKLADKAVLVTVGTSLP

SEQ ID NO: 922003 - protein, 165 aa, Homo sapiens
MLSVDLPIFLRQFSYSSISRKLTISTCLVDNTEMKRGPPCLLPGEDDTNLWFWFASTCKELWEEVRGRTEHFSGSKTCLLHSLAAEPKTEKTLPQGDSAEATIEFTNNLPVLKKIIDETAIELKCTCSRIVDERKGIRDRNNMFGTKGYALQQRVGDKYLLFVNM

SEQ ID NO: 922004 - protein, 140 aa, Homo sapiens
MDQSGLCKTDQWDLCKMDQSAGCGFTSKPKRPRTHQKEETPNTSEYQKEETPDTSPLRTVTLTTRVRGFILQVSETKNSPIPDTEVYWAVLLETAILRGGSWEGFVSDILSQCISKTMGLNNILPGVTYHRALGRGKKSL

SEQ ID NO: 922005 - protein, 180 aa, Homo sapiens
MVAKGISSKPSWLICGVGPVYAQKSRIKVWELLPRFDRMYGDVWMSRQKFAAGVNPPSVRTVWKGNVGSEPPNKISTGALSSRAVRRGPPSSRPQNGRSTDSLHCPPGKATDAQCQPVKAARRKAIPCKATGAELPQTVGAHPLHQHDLDVRHEVKGDYFRALGFPIIPMCRGNNSRRCN

SEQ ID NO: 922006 - protein, 135 aa, Homo sapiens
MQGICGRENSEMPSCQGFYPLVRCPILSLLECGWEHEYNAFRFLLRGLIGKEWECATCNGDVWEDPDDVGDTEFVNSDEPFLLEEIASPSPIVATSPPQPMLPSAFTHLFEEINSALPETTVMASTKETKVLVGP

SEQ ID NO: 922007 - protein, 145 aa, Homo sapiens
MDSADYSSLSPWEVAKSTNDGVKPGKAATLSMPQNQLRREDYSMNFGGHIATRRSLESMNPISVLPLSKITLNRNLPKESYECSNSYDSKSAQVILYMVKTLTPQGIVSKEIVSKETVPTSKAYFINLKMEYVNCRLGSICLTLQ

SEQ ID NO: 922008 - protein, 150 aa, Homo sapiens
MLRLSGPWASIPAKVSPPYSPAAFSTPPTCISVTQSGNSNHTSLCLCYKRSSPLAPPPNHIKPPIGEEVPRSLKPLGVWTGCGPPCSSSERSLCQLLPPHIERQLAGPPLYDPLQVLGVESGVFKNRGSGSEAAPHFWHQGWQLLGTLPC

SEQ ID NO: 922009 - protein, 151 aa, Homo sapiens
MVWHIVPGLETCIVCDCAEYCRQLQHNGLREVLRAGVVDEEFRQNRSIDISTVIKPVFGASSTRIPVLQFLVYCSDYGTATTVEEIKLPLKISSLMSQRQNLTSPRDSGPEIPQDGERKLFGVLRFTHQYLNSFLCESTKLTVSRCKDAWL

SEQ ID NO: 922010 - protein, 139 aa, Homo sapiens
MRALLQTKYCSLCLEHSIDLRWYKGFIRECEKDVLNQRGASDMGGRKPDHLVFPNDTPELGVWSAWPGKLICCFLPENCPHVAELVVMSEMENVLYGWSLGQGILVCVAQLGEEVLWLVFGTRHSSFCDLPWRRMNGER

SEQ ID NO: 922011 - protein, 195 aa, Homo sapiens [sequence omitted]

SEQ ID NO: 922012 - protein, 161 aa, Homo sapiens
MVSGSLIRSLLLWAGEYPLAPPSASIWLFQLKVLYSLAPSVPLQIMPPSKPHPPVVGKVTHHSIELYWDLEKKAKRQGPQEQWFRFSIEEEDPKMHTYGIIYTLLCSLTWNGPAWSTLASFSDLMSYHCPLVNSLIPRWLPLSLDRPSWFPSQDLAQKSEM

SEQ ID NO: 922013 - protein, 154 aa, Homo sapiens
MNMLQCCRDCLWPVLGLVYRQILGGLLPTGRAVVSLASMEIESGKEEEEKNQPMKLADANKTSLNKFKKIEIISSTLSDNSGIKSKINSKTNLQNNANTRKLSNLFLNEHWVKNENKMEILKFFKLNDNNDTTYQSLLDTAKVVLRGKFIALNT

SEQ ID NO: 922014 - protein, 174 aa, Homo sapiens
MPQLLLLLLLALSTKMRRNQHKNPDNSKSQSTFFAPNDHITSPARVLNWIEMAEMTEIEFRIWIGIKIIELQKYFETQSKEAKNHDKMMQELTVKIASLEKNLIDLIELKNTLQEFHSAITSINSRIEQVEERIPELENWLSEIRHSDKNREKRMKRNKQNLQEIWDYVKRPNL

SEQ ID NO: 922015 - protein, 165 aa, Homo sapiens
MEINQRKVHQMGREVLNPVLQLKTGSLSIPRPRQFRLIDGLKACFLPSRLNSRFHTGRGGVGLLAAAKGTNFCIFTPVRIPSAQAGQSPTQSKALTLPNFVKADNGEEAAEEKFEASRDWFVPYFREACSPFPQPQACSVYPEIRSYLPKGLDRMVCTPLGWAGH

SEQ ID NO: 922016 - protein, 176 aa, Homo sapiens
MAQVAEQLAQQPGPIADPSPVLDTTQNRQPFRTLNKWESKGILLALPAEGELLLVGLMDRNGEKGICQINGCIPGAKYIYANYAFWHWGNDHRMSPGTHWTHLSTEFISSDKSGKADGSVGQGGDVATTGGGKAVSSGKKRFIRVHNSVSPASSRSSHTSPFQVVRSHFFQSMSSL

SEQ ID NO: 922017 - protein, 218 aa, Homo sapiens
MAPFLGEISQLLIGRLLIFPSLKAQRFVLTGIDTLDMSLPILHTMLLPRLPSVDSQNAFSTGWGKVLRKAMYALNQCPIYGTVSPIARIHKSRNQGVEVEVAPPTITPSDSLAKFLLPVPMTLHSAGLQVLIPEGGAFPPGDTTIPLNWKLRLPRGHFGLFLPLSQQAKKGVTMLAGVTYPAYQDEICLLLHNGSKKEHAWNTGDPFGACLSITMPCD

SEQ ID NO: 922018 - protein, 140 aa, Homo sapiens
MLNAGPLGPLISFSILSLCVFFFSKSLVPPNEKHPQCRTADRAPQEPVVDKVQRQSAGEFPLTRGAILQEHSMGQSNIGGSGLRELQLFETPSLCFVRKKPCGEAHIKENGASADLTAAGHQITPSGDREMGFRGPKSHY

SEQ ID NO: 922019 - protein, 151 aa, Homo sapiens
MQPMKAARTGAIPCKATGAELPKTIRTHLLNQHDLDVRPGVKIDNFAAVKFDCPTGFQTCMGPKSGALCDREKQAADFRVTSRNFSQGQAECSGSGRVLRCMAQWQQLLRRPKGGSPAPGWGWLSEHLAAASMLKWEQGGWAADLSQSQVK

SEQ ID NO: 922020 - protein, 156 aa, Homo sapiens
MPGSVGSPCQLGRVWGPCWNHLFPAFTSSMEHTAAAALPLLQLMSLQNFSRWVAATITRTFKEYTSLPCYLHWSRCWYPQPHPQGKEERTTSREHTVGKKNLNNSPGAPDLPSVIIYPNEKEPEKQFCNGFKLRKKSQGCQKKNSEGQLLNYSKRY

SEQ ID NO: 922021 - protein, 170 aa, Homo sapiens
MASPKKEEDMEEEREGEREEREEEELSMAGHGVVTTLPPAPARLLWAEHLAIWALWAPPYSPILPASKEKFSNNMVGTQVFKSACGRGGPIPPEEWGESDPGPRQWAVGGGQWAGPLDLGVWLLLETPAQPLPWDFCLKMQTTQNPLPKTFHFALKSIIKSFNEFVWSCR

SEQ ID NO: 922022 - protein, 148 aa, Homo sapiens
MRRPHTALIHLAQGLPENVPAQRKIILTPTPTAGARHLLSRLLGQECCRQPGGPGGMIPIQGQGHFEIQQEAHLLQAAAPQLPDSNKQPGPAAASRLPPWRLLQLSSLLLRFLELLQRVEAPAGIPPPFSKGLTIPAAEQGSSGPEVN

SEQ ID NO: 922023 - protein, 156 aa, Homo sapiens
MLGAEGGRTFQERGTTHAKIRWDENKHGDFEVCKKADEKINWFGESSRNTSLDRVRGHSKALPTQKMRQTLLDFTHFTKSYITSGKIDNSGGICIKAEKLTYYLKLNRIKPPSSTVRDWALAGATDTHYKGPDTPTEHQAFKSSMDKCGLTGLCWH

SEQ ID NO: 922024 - protein, 155 aa, Homo sapiens
MDLHLSIPSTAAFGSGKRQWVLSLFRNWKQWRPAPRLSSTRQQSLDYRHIVKLQKNIPIPSRKRGLLQRQECRAQRAPPRTRDATPCSLLAPSWPQLLPYPWAFTLSSALVCSAVSLWHLESQHRASSLQFTPREQPHVTQRRGSHVILNSDPQK

SEQ ID NO: 922025 - protein, 234 aa, Homo sapiens
MKERGLRHPLLPSIPAALTFTHGADLHLGCIKTKSYGPGFAPGRGKCDSGVGPGEAWGGGEAGVTSVQTGERHGHGHTDGHWNTGASQKENPPAGLDPEPKTINMARMSVDSVHSSACPSRPQGWAPSCSSRLTSSCGCSGDSCSSCRDLPVPDTFPPSSLHLTGLMFSLPGLCAQTPMVRVFLPEREHLHPAQGPPPSKCQVTPLVPSCCPRQLLSWGGVPPALQIPQGVLSV

SEQ ID NO: 922026 - protein, 307 aa, Homo sapiens
MHLLPSGDECGSCPGLGGKTEIPEKSRKGSCGHAGGQNTAVARQVGSVPGSRRGGSTALPGTRASEKRAAVPVCAASELGPQTSRRFCEVPSIQYPRPHGGSVRLGAPSSMVLLHGSGSSSPVGLVLPHPWCSSTVQDPPPLWAWCSLIRGAPPRFRILLPCGPGAPSSVVLLHGSGSSSPVGLVLPHPWCSSTVQDPPPLWAWCSLIRGAPPRFRILLPCGPGAPSSVVLLHGSGSSSPVGLVLPHPWCSSTVQDPPPLWAWCSLIRGAALLHPSSGKDTAGWQLPGSPFHLEQQARRDKIRYPSG

SEQ ID NO: 922027 - protein, 145 aa, Homo sapiens
MQMTNLAGRKSLRHSDLAYPTPENEGWKRHRDRQRIVNPLRPPGPGARAGTAQSPCAMPPRLTPWASVTLQENEQAYYHLQMLVRTFSSLRCEDFTKNKGFFLISLRENHIIQGSYNSILEVQCKCSSIQPKPPFGGGFAQGKFM

SEQ ID NO: 922028 - protein, 176 aa, Homo sapiens
MAGYSSGTKLPEEQSGSNICCSPISTVLQLLLLIPRQRGSGVDLQQTPTDLQLRVLTVRRKTNKQKGHPHQNTICTSPSSKTKAMEQRWTENDFDELREDSFRQSNYSELKEEVRTHSKEVKNLEKKFDKWLTRITNAEKSLKDLMMLKTMARELHDKCISLSSRFDQLEERVSVM

SEQ ID NO: 922029 - protein, 163 aa, Homo sapiens
MVTWMQTFRWDQTDPLRTDALWDTRCAGRDPQRRRPRDHGDTEVGGCSSKPRTAQEGKGHQEPGEGTGQTLPQRLEREPTWDSDISTMDKTALSSFRERHVTEKSLTAANFCIADGFMFNIIIVPGFRLAVLFDCDSAGVSPSWTSTIMLKFTLIKNRLNPKG

SEQ ID NO: 922030 - protein, 146 aa, Homo sapiens [sequence omitted]

SEQ ID NO: 922031 - protein, 147 aa, Homo sapiens
MRMMQGTGELGGESGEKGAGPGISEWPQLKVSPRLRISGTQSRSSKEEVWALQPWDELLCMWPSGGGSGSSAPDLQTHAIHPSLTPPTKALQPAQPPRTLGCFHSSSHALCILLALGPGSMDPRSLVLVTFQIPPTPQIPLTCIDRV

SEQ ID NO: 922032 - protein, 139 aa, Homo sapiens
MERGTSQWGDLSQPTTATTVSEESCQQCAIYEENLRQIPTEECPAMHLTRAPQTIKVINGKGHLRPCHSQEESKEIWQRNVMRSLAEMENWVSAFSTWEKELHKIVFDPRYLLLNSEERKQVDNNSDEIGVVQRTLAAQ

SEQ ID NO: 922033 - protein, 220 aa, Homo sapiens
MTNSCRLATSSHLMDRERASIHGIAQGPGTLQSAVAKPAGPMSFPSGEQGPPGPDHKLCSLAKKLKTLKKRLDEWLPRITNAEKSLKDLMELKTMAQKLRDECTSHSSRFNQLVERVSVMEDQMNEMKREEKFREKRIKRNKQNLPEIWDYVKRPNLRLIGVPESDGENGTKLENTAGYYPGELPQSRKAGQHSNSGNTDNTTKIFLKKSNPKTRNYQID

SEQ ID NO: 922034 - protein, 265 aa, Homo sapiens
MHDSCIWIESILETGIFKLSSIESGSCSRKEDIHILSVALVGTCLGGCGEPQSSREDPSTVRAAKDRLLESLTLEALTWRPSPGGPHLETFTWRPSTGDCHLETLTWKPSPGGSHLETLTWRFSPGYPDLEALIQRLSPGGLHFETFTWSLSPKDPLREALPWNPSLMTAESRARVRFIHRYLPSGMLFEVARMTVDTNENSPDDPSDAGEFTRRLTQCQRIHQATYLMPGNSPDDPLMPANSPGPYSPMDLCRFMEENCCLMCR

SEQ ID NO: 922035 - protein, 143 aa, Homo sapiens
MLISYHSQNSRAKKEHKSKKPYPKDSSAPVGTLYGSYNPTFSFCTGLAEVLHEEAAMVWGLHPLKQRPELYVGPFFLWLGCRAPSLETAQSSKALDLAHKTQYTTSTVNQSKNRQMGSYQVLHNKGNNQQSEEMAHRMGENIQ

SEQ ID NO: 922036 - protein, 128 aa, Homo sapiens
MLRMLKNILPQAYIVFGKSASEIQGLFLLESILVDFRRVHDPSILFRIIRGIRNTRELDVAHGKSSGRKAFMARTALSHPLLLLVDPPFSEKMVRNLAGHSVLLMKFLPDKPDSKEKYDTTEKSIMNV

SEQ ID NO: 922037 - protein, 167 aa, Homo sapiens
MAWYSWGSHCSSGVISVIMFFPQLGGSKGTSVVVWPRGLLLFFWRLHLTEMQESLMLDDLRWNSFKPKPSPTVRGKTVFHETGPWCGKCWETAALKGQLLSNESISQLLFTVAFTVVLSALRVELFQSHPLGYTGIKGALCSISCFSFWAKYLSCCSGAPGRESNRP

SEQ ID NO: 922038 - protein, 147 aa, Homo sapiens
MNIGCQQLLPPPFVGESHLAKQDPKVRLWPMIDGKGVQYGLKIRLAQSHGQDHPAEFRSNSSPGVKISYGSKETLGATNESWCAVAPFRLPSFLSHQPSICVFPLSTVNDFPLKICSEQASLPDFLVLRAKCSRVAEIAECCGRQYP

SEQ ID NO: 922039 - protein, 146 aa, Homo sapiens
MATPAVVEKKQCRAWSLASEGASPKPWQLPHGVEPVSAQKSKTGGSAEGNVGLEAPHKVCTGARPSAAVRRGPLSSGPQNGRSNDSLHCVPGKVTDIQHQPVKAARREAVPYRAMERSCPRPWEPTFCINVTYIQDMESKEIMLEV

SEQ ID NO: 922040 - protein, 268 aa, Homo sapiens
MLSGKLGQLVAFIIGSLLLLSLSLSVLSHLELGVWSCKHSCGHNYWDYTGSDLKPVQHWVLFISTADFHLKPKGSSVSLVEFCQAWNSPFRAVGSPLVHGRSRNADPEARPGIGDPRACLLLYPVLDVLEPKVQDKVPFTFLSAFLKQKESFTVATAARNVLGHTDSQHISEPQAHGIPPEHHCWLFRAQGLFSQQKCLGARAWKGGLITLAPYPTVAELISKMQEKVLFILCSPPLTQKIRGYTCLFVTCVYCILVGMRLLAYRISK

SEQ ID NO: 922041 - protein, 144 aa, Homo sapiens
MCGIISEASVLLHWAPPSGAVRRGPPSSRPQNGRSTDSLHCAPGKATDTQCQPVKAARRVAIACKATGVELPKTMRTRLLHQNTNKRLLNYVNQWIWGGLLSFLCLKNGIQERSQSSQALEINMNSTGSMNDSEVQFLLLFVSQ

SEQ ID NO: 922042 - protein, 169 aa, Homo sapiens
MEELRLTSTTFALTGDSAHNQAMVHWSGHNSSGPSGCKFQGRNSPASSNSTKRGCFENWGFPAHVLPYKSAPRPIQDHRQCTSCEPFSPLAKSLCYEESLIMTTPAFKVQMHGNYRLLVNLVRNSGWFTHLLPFTFLPPQLLDLSSCIKTCLFCLVCGCDVIPLYCSLD

SEQ ID NO: 922043 - protein, 156 aa, Homo sapiens
MNAVRTLAAEWLESRGPLLSLSRPLLQVAPEKGLLPLTRSRKGCSSPVLCNSHPCGRSRPQMKADFQLKSYGDRKGKMDCQCDEQPMTEFYYTALLNLGEDGSLSKKGLYQTGSTESKEYDAPGETKVLLPKDVGKIMRRHQQEHYPGLAPPPTPQ

SEQ ID NO: 922044 - protein, 139 aa, Homo sapiens
MYLLLPTHGKFGILQFQLSFKGTIGDVQRTLIQVDFGDGIAVSYVNLSSMEDGIKHVYQNVGIFRVTVQVDNSLGSDSAVLYLHVTYGEIKDWRSTVTLASLYAQSKSEQEHNRVTLSGILKMEGVMSDCGCQSAMIWQ

SEQ ID NO: 922045 - protein, 142 aa, Homo sapiens
MGDPGWREPKGPLWCPGGGPPSSLQLPESPGGSCMVMVIWTIGARERSPGTCWSCWTICETGSGLGDLHLQGQSALQWSPLQIGQGGDKLEEKLLLGGPSEAGLEGACSPPGDASGVCFFSFLGLSLAALPELANRRVGSVL

SEQ ID NO: 922046 - protein, 141 aa, Homo sapiens
MLFRGLLLLFPAVWKNATQCLPLSTSVLVANCSTLYLWPGRELGYRERYTDLIFLLTSHLLWCLAFAEPDRKPEEKEALSQQNTQACLPGTKMRGEKWIVNPWRTKPKTQNMALFLEGFFPFMLSHFCVYTFNLRTLAAMG

SEQ ID NO: 922047 - protein, 169 aa, Homo sapiens
MNFAASMVFFSVLLQSLYSKYNYFLFLSAFSALVWILYSALAWIKWEGIWKHMKTKNRNIILMIDNAVCEIWLRSEGQIGFQKLLLLCLIPNRWGTGHTSSPIYLWGNPPQEKCEFFRALLKSVSFNGPEQYPVVQDRQYNGPVDEDRVCRERGPERTQEVALNNTNCF

SEQ ID NO: 922048 - protein, 225 aa, Homo sapiens
MAAVGHPEWPLPLCLSQQGLGAGVAAGMATGVAVAALSPAAAVGRAWGRSGQSPDPSALGATVMGLGRVNCQQGSCAIRHEGVIREGPQGGAGPGVVLCSMEQVKASSKQQPHPLGHDCSCPSHCCGPGPPCALGGQEQAGALPSWVQLQMWTQSSLCTLGGLGRPLLPPQAQRYLLPLPGLFLLLQPTPILEQEWGKPGAVAAWPGPEVEILSGQLENEDRESP

SEQ ID NO: 922049 - protein, 140 aa, Homo sapiens
MSKKSSEFMFFCCGFSRPLHSGSLTSRNLFCLADAHVQSRWNLPPVSQGDLLSYGMVFAIWLQFQRPKHMEGLKKMKCGRRMSFLVGVPWGEPWRAQVAQSSQERSSSAWVLRVNPVLHRQGPACSQGTWKAPLKGCRRG

SEQ ID NO: 922050 - protein, 140 aa, Homo sapiens
MQTKIISVTYPFLPTRVAVIKKVGLDRFYNLRLTSYDLVLTSVDEAVFGFSVRTRPGGAFQRSLQGDQRGGSFKQSELMSLANQKDDIWAIARISGVVESQNASSAENYEFIPKWKFLERVTVYFGLLCSKLEKLLVASG

SEQ ID NO: 922051 - protein, 155 aa, Homo sapiens
MKSSSKDRSWESQDAGEDGYKGEKTERLWRDGEDFTEGSPSSQLDPLQGIFSAPVQSQPKPTALAEQHQKRTFPKGGKALHGGREEAEQAKCTQVTGPGHRSCLRWRFQCKVLSPGSGDDGKDSRDVEVPEVWNQLGTSQPLDLDSWHQDPANFI

SEQ ID NO: 922052 - protein, 140 aa, Homo sapiens
MELLRCSRREVVFKSSQQAKSQRSALATAGGIECHAEHPTLVLMLFASVLVTCLEAAKLTVGFQTPWNISHPFSMQRLGAGLQIAMDKVNSELVDLGNFTTYTNSACSTKESLAIFNNQVQNEQISALFGPACPEAAEPG

SEQ ID NO: 922053 - protein, 149 aa, Homo sapiens
MLASPSPSSIMGSEEDGKMKEGFKLPRELDTSVENADSDMDNEVQAEDFSDGDEKLIGNWSKGHSSCALAKRLASSCPYPRDLWNFELEQDDLGYLTEEISKCQRKQDVSCLPLTAYSHMHAQRDYLTLEVTFKREAEHKSLNNLSPTM

SEQ ID NO: 922054 - protein, 137 aa, Homo sapiens
MEAMAAGPFSCLSLCWMMDYSQDPGQTQPFSCLLYSEDRHNTINQVVPQLRGCPEVLIPPFQENQQLIIILSRSAPAARCRSGLSAQKASRINCTLCVINLQALKNDQASVSYMYSVSLQGTLRQEGEAGPSRHFKV

SEQ ID NO: 922055 - protein, 241 aa, Homo sapiens
MPQVSMRTTPVNTVPAALLSTSRPLCTRTAHPKGRTKGEEMQTPEPCQHKKPQVKGGWSTETSHIACLALFRSDVLPHAKVYQGIQDVVENKLHDLVQGHIQKKPPGGPMALATKYDDLEIPRECPGRHGLQRRLRTVRWAGVCPGKTWTPEEAPNSQVGRCMSRKTWNPEEAPNSQVGRCMPRKTWTPEEAPNSQVGRCMPRKTWTPEEALNSQVGRCSLDITVPGPGGKKKIHDAHQGI

SEQ ID NO: 922056 - protein, 147 aa, Homo sapiens
MCKTHNKHESKCLLRRSKLVLNFMVLNGRGPASAITIDTSNQLRLLRALSRNGLHLSQTQKKLTSVCRTGSTREQIQGGETVRVQNMTQDEGVMVSSFDRSACPPPTAFFTELQEPPSLGFPSTPLVLIFSQSGSSSSPSSDKHSVL

SEQ ID NO: 922057 - protein, 149 aa, Homo sapiens
MAAHQEVNKEKLLIKITKAIKVKNSGCVAGARSRGTCQDEKKPTCTWPLPSLEVRGRPSKVSHGKIISPNLAWRCPNPASYEKPKLHFSPMVKPVVKPLAHRRVAHVVEQRQCQPRARNLCAPFSKAVTHYKYFKHVDKKYSTGKKIPH

SEQ ID NO: 922058 - protein, 157 aa, Homo sapiens
MLTWIKGCSSLHPCEGKHANLPLWTGWGWMLLHPRPRLCCTLPVHAAQPAEASVLPFSRCLRSGTAIDLDREATPTLAEPLPSPLGPTSARSLGPAGASVQVHGDVSAQGGEAGTWPLSQREMGRARTHELSYAADTGHGKGGGEDAERYQGPSPSP

SEQ ID NO: 922059 - protein, 147 aa, Homo sapiens [sequence omitted]

SEQ ID NO: 922060 - protein, 173 aa, Homo sapiens
MGISPVYQQPLPHGLTFPQPLRGLSFECYHSGVITVIFETGQYMLLTLLAVFGEQVVFGYMKQCFNTVYTRGFLVQTVFTQDKNNIGKNYLSLICAKKESKRESSGAFSSFKPTRRRLIKVWSTVIQMDFAKTWSVCLKFLAREKYKRQSHPKYFWSAECHIDGFIQDVAFSD

SEQ ID NO: 922061 - protein, 168 aa, Homo sapiens
MHLLTKEYFTPAGDCIIVGTGPVLITWNVVESELTSCREKSPHPVSNNVGSSGESCGSVCSHRLPLLLAKSLSHFSQAGAGTVATSLKVTPALWAEHGPGEAASSFLIWISVCNLHHPGPPGCRGPEFRCSWLVFPGVESLSSERALGGQGSPKLSRNLSSASRSCGG

SEQ ID NO: 922062 - protein, 139 aa, Homo sapiens
MSAHGDESATGTNHHHSHMQRTGDADPPLYNTGGAQLPSILKQKQQSVTSAEQVLETQRKRRPGPELQMVLHGMQAAHRSGCWQHQAPVRCPQRTTDNGNPPRAELQQCPWMFFFILLVFSCVCVCVCVRAHMYVCVCA

SEQ ID NO: 922063 - protein, 162 aa, Homo sapiens
MSLISNLLIQTKTCEGCRANSADIIPPGRDEGDIVFIVSSLTDTAPNCRHSFMEHLAIFGECGGNGPPGNESRSWRSWSRLWGAHRRPWAPQRWLQCTAAWPARAQVQRRSQKPLRINSLTRRELVHNAPSSHKPRSGQIPAKGSKLTSVDLQPGLRSTYSQ

SEQ ID NO: 922064 - protein, 187 aa, Homo sapiens
MLSNNHRKKPLCLGPRHKGKMVHFSAPDAMLAVREGRWRRGWELAAGGGELPFRLGRKALAKHFLWGAGLCSTQQLSSSSSQRREVICLTVRYENLVGFQGANTQKCGVLLRLQPHALLIFVSVHDPPQEICHKTSTHSGKFVALWLWLQVSCRGLSLQIQGSPLSFWGFWNGQQCSIGLVFLLGSG

SEQ ID NO: 922065 - protein, 135 aa, Homo sapiens
MKGDGLAPVPGALKLAWNSKLSSEERRPGHVAHTGEHTGEHKEHNLKVRADIGWDGCNHKPGIPGTAECGRGKEAHPLEALEGAWLPNTSILDFESPEHRENQCLGVQALHLAALLDGSPGKCVGSQGQTRGHGL

SEQ ID NO: 922066 - protein, 195 aa, Homo sapiens
MMMMMLLVVVIVKIRIMRLYHHNYGGDDDGIDDDGDMILMGIVMMRVMTMVLVMMMVMRMIVNDGYVMMRMMMVMILCHGDDDVDGDEDDEGDGDSDDGDDDGNDVDGDSDDGGDDGDSDEDDYDNGNDDGGDDDNHYVTKETGLCPHMEITELLKPFLPGGIPNRHPVSKLGFYGAADKRGMYCTLLIGALKNG

SEQ ID NO: 922067 - protein, 137 aa, Homo sapiens
MRSDGTVRESFSAQALCFPSAIHVRCDSLLLAFHHDCEASPATWNCKSIKPLSLVNCPVSSVLELPQDHWIPGAAVICNHTEPVDILHILSFLSLRGSLSGSSELSVTNEDYKMEGTGAIISWYNTAFLWSTQKSLP

SEQ ID NO: 922068 - protein, 149 aa, Homo sapiens
MATTIQSCILNLGFLYQPLWQYPEIDRNCTSFCCIKVGTTSSGSYIPATEQNRPSSSIEQNRPSSSIEQNRPSSSIEQNCPSSSIEQNCPSSSIEQNRPSSSILPPGHKWSFLDAYSSVSFHKFLKTVKGNADGLNYYLLLPEHAVRKD

SEQ ID NO: 922069 - protein, 155 aa, Homo sapiens
MPEDTISPHIQISQSQLEKTVKDALSKPCPQDRLGVTNPTPPGAATHYSSAQAATIRIMIQVASEPWGAPAWPLASVNNPQRQKVTITLAKKAMKEADSQNKNDPSHGPGPGSILAIHFHPQSHLLLQVPQPQQQVHWSLLFARGVSKISISQEE

SEQ ID NO: 922070 - protein, 164 aa, Homo sapiens
MCFRENSRHGPSDVASAGPHQSCGGGFCLTTVLVFFAHKPRNALDLCVFHSCSSGFIKVKLEFKKYPKYKMHLHPMQAETVTNRGDEAGMRLHRLPAGCHEGSGILECSENKAALAELKCKKFSALEKIAPFLHCTNCSKSPRIENREIIQHTFHYLPPQPPSL

SEQ ID NO: 922071 - protein, 159 aa, Homo sapiens
MKLFQNIKMLRYFEKLKQEVNKRQPAPSFCLLVCFIPLSIPQPTVKSLRVRSPHRKQTSTVSLSCRALGIQWVPSQNLFSTVIAAAFAPGLPGPAFSGTVEHEFHGCPTVHSTCMVIYAFNTYDNTIPCPRHYSNWQEHHDEQTHPLSTWRSLDSLPAC

SEQ ID NO: 922072 - protein, 186 aa, Homo sapiens
MAGMEVYLKRAYNRKERKVPWHMKVKERSSVRFNRDLKILIDSPLFHDSSLRVHCPHAQSPPCPGKCACAVCLGTDNTGPAEVSFPCGPSGKGASPALLDYHPQRGNAIIAEPSPDVSRGWGRAVSCPSQPVQPPVTHVRSSVAFRAGAQARQHVEDAEETGLEMCRARTDERIGFEKEHVGSLVI

SEQ ID NO: 922073 - protein, 190 aa, Homo sapiens
MPKHVYCYDSKVTVKPASAFPSFSEPKFLEYEIYNELAEREAWQTSRLEGPVCLGDICRPHCPGFWIQKVWCLSTGTHSTLVLAWSLNASGFKTPRVREAEHRDLYVGMLQTCRYFSLMKLIPMSLQIFLARESDPCTSLTATNPVLIQVLERPTELPDFKPLFPRSQLPLLVSSSYCPLHMELSCSMIA

SEQ ID NO: 922074 - protein, 197 aa, Homo sapiens
MRETLRCLSGVRLSLRAPDARGSQDTQLHGSFAPHLPLDLSLALPVSSVGTQVQPIFKVLHSTSIHTSPTNHEPMGLSNHWKPGIASRTHTRPHSESMSRIAPGPGSLLFLHVTECRFSLQDSASIIALFPTCKFSSHAQPGLLLEQTANCDVPTPSGPRRQQTMLQCDTWHRMTPSPPKPLCSGGSKETEVNHSHS

SEQ ID NO: 922075 - protein, 135 aa, Homo sapiens [sequence omitted]

SEQ ID NO: 922076 - protein, 133 aa, Homo sapiens [sequence omitted]

SEQ ID NO: 922077 - protein, 145 aa, Homo sapiens
MVLTEGRYLIHITGPAMSPGIRGDGQKPTPSAPFIWSPLSVHVRLGEQASKKGLSEQILMLPAMSGVSTFFVSDSGVSGHATIIYEVVIAEHVRLQTSKQEISDVASCVVWDKHVKRKPGALLTWQKLTQNCPPESHSKELQREG

SEQ ID NO: 922078 - protein, 158 aa, Homo sapiens
MGLPASRTIACMHLAKPVGFTSETLSSKKATSAPALPLSSVHYLLVSPNTATGPTAGAEDGTVNTASHVLPPRAHILMEGVRRKAEKCNRTRETLSFSKLRSERNSLSIPHTVQSLSSATVGTVHELRQGCSAKALSEDESVIDAVFWKHSLQLASRP

SEQ ID NO: 922079 - protein, 233 aa, Homo sapiens
MLWASLPPLLLTGETSDKYQLKDILQNPDLQSSRWSFYKPPTSSPPDGHSTNPRPAVLQMVILQTPDQQSSRWSFYKPPTSSPPDGHSTKTSTSSPPDGHSTNPRPSVLQMVILQTPDRQSSRWSFYKPPTNSPPDGHSISPDQQSSRWSFYKPLTSSPPDGHSINPDRQSSKWSFYKPDQQSSRGSFYKLPTSSPPEGHSINPQPAVLQMVKVIPQGLRKCHSHKEPKRPDS

SEQ ID NO: 922080 - protein, 152 aa, Homo sapiens
MWSVSSEAGGLQNRSAAGETCVCRKARVKMQESLTTTKYKSPRPQQINGIVKLGNNPSQLSYHLSLCRLAAGCSVFLYNHAAQAALRLRLTPQGSVSSKGSTAMQADWTEMAKSHIFIKCRACFAIVAVLNVDNIQFTIVTIVTVQLFGIKY

SEQ ID NO: 922081 - protein, 278 aa, Homo sapiens
MRTSAFPIPKHKHQSTVGGIRVFIEELLLLQDRQELKVERKQAPERGQVREHPRLSDSTSFPAGRQDGNVRPHGEKREWTSRGFLDSDEQRRLARADGGRSCSWIADFPFSSLDVWIWISADGNAQIHNQKLKSSQGKACPIYIHNSKDTCAFRCLCKVHTINLCGFTLACLVYTILLDQFQSQKRESMLKQQLSFFHICANLFNSTSMNEAMTRCVQDMAVGSTSHKLTKSYRWYHGSCIMLQNRGALLMKMKGFPAIKNEMRLNLTVEQVEIVLKY

SEQ ID NO: 922082 - protein, 162 aa, Homo sapiens
MTMKAVHIPPFSSRVGRAAAQESFVIHRSPGESATAVLLMHLQDQGRYRDILTSHELLSNREPCRGSPFKWEVNCQMIRRCERKNQSQKKNRRQPSTCTNRADKCTCSLVTGGSTKSLLEETFLLGVELTIPRTMLSNNTSVCVVAKVTPKKELCVSLSQSC

SEQ ID NO: 922083 - protein, 169 aa, Homo sapiens
MGVCCDEKSLHVSKQPFSISGGIPGFSQDSQHRSRGVTHTTAQTLCGFPPNSLKANALPVAEGPACEGPNGHSGLCVVSGDWTMPWNFKHKGVEKGVTSPGNSLGARLRKLGSESRSPKSTVLPRTELPVPLPEHLLHLLYSKWGIYAIPHPLTMCSSSKERFYSSSLK

SEQ ID NO: 922084 - protein, 143 aa, Homo sapiens
MNRLYQWQSWRCKVTTSDTDWLKAEIGLRVLRPTPPHHVPPFSAAVPKGHEISSDGPIFIFDVGNLPLIILPLFSIVLTSTEIGLHSNILASNTGVCRVSPGSVHCQPVFRRQQITMDKVTEELYLLFQIPAPGYRTTVVSPT

SEQ ID NO: 922085 - protein, 182 aa, Homo sapiens
MKKERDDIFYSVFTPDLHCEGSTSERVALFHLFGPTLRGPVDSDFPATLYVYPKCSMVIFEETLASLTEKVPCGGSRSEGRISWRRRKTEPPASARSGLGPPRCPWVQTSTTPQLSMEQNSLRAWGMVKAATARSLWAGWQMWLLSAPRGHRPSSWDPNKCPPWHQPAFPHFPDNHHTKRIL

SEQ ID NO: 922086 - protein, 137 aa, Homo sapiens
MHAGSIRSMENHAQRKTWTIFLSVRSTGMVKRVKMTIPFATKITITKKCMLLGNVIEVTFMPTATFPAPSAGSAATSTGPTLLEAGSTELSMGPTLLEAGSTVTSTEPSLLEGFGPGSFDLQCLHSLPFLFLESLLK

SEQ ID NO: 922087 - protein, 188 aa, Homo sapiens
MTPCDSALRCGDGCTITDTHTHAHAYTITPAHTCLSHEAGRSRVTTHAHAYTVTHAHTYSLTHTHTITYSNTVTHAHTYSLAHTHTITHTHAHAYTVAHAYTVTHAHTYSLAHTHAITHTHIITHTLTITHTHDHAYTITHTHIHTHAHACTVTHTHIHTHTITHAHTYSLAHTHTPTPHCHPHPFPT

SEQ ID NO: 922088 - protein, 778 aa, Homo sapiens
MRRRLAVGRRCEEALSTGETLNCEEVLCCEEMLNCEEALSCEEALSCEEALSCEEALSCEVLSCEEMLNCEEALCCGEALSCEEALCSEALAEALGSEEALCRGEALGSEEALCSEEALCSEEALGREEALGSEEALCHGEALGSEEALCSEEALCSEEALCSEEALGRGEALGSEEALCSEEALCSEEALCSEEALGSEEALCHGEALGSEEALCSEEALCSEEALCSGEALGRGEALGRGEALGSGEALGSGEALCSGEALCRGEALGSEEALCSEEALGSEEVLCRGEALGSEEALCSEEALGSEEVLCRGEALNCEEALCLGEALNCGQALNCDEALCSEEALCSEALCRGEALCSGEALGSGEALGSGEALCRGEALGRGEALGSGEALCRGEALGSGGAELWVGTKLAEALGSEEALCRGEALGSEEALCSEEALCSEEALGREEALGSEEALCHGEALGSEEALCSEEALCSEEALGRGEALGSGEALGSGEALCSGEALCRGEALGREEALCSEEALCSEEVLCRGEALGSEEALCSEEALGSEEVLCRGEALNCEEALCLGEALNCGQALNCDEALCSEEALCSEALCRGEALCSEEALCSGEALGSGEALGSGEALCRGEALGSGEALGRGEALGRGEALCRGEALGSGEALGSGEALGSGEALCRGEALGSGEALGRGEALGRGEALGRGEALGSEEGLCYQRRRAVGRRRAMGRRCEETLSCEEALCCGKEPYGFNILVLPQHSKAEDSDFLFSVCFTLWTRHQNG

SEQ ID NO: 922089 - protein, 572 aa, Homo sapiens
MLMLIIAVAGHVVLWWMLVIAAVGRVVLWWMLVIATVGHVVLWWMLVIAAVGHVVLWWMLVIATVGHVVLWWMPVIAAVGCVVLWWMLVIAAVGHVVLWLMLIIAVAGHVVLWWMLVIATVGHVVLWWMLVIAAVGHVVLWWMLVIATVGHVVLWWMLVIAAVGHMVLWWMLVITALGHVVLCLMMIITTVGHFVLWWMPVIAAVGHVVLWWMLVIADVGHRVLWWMLVITALGHVVLCLMLIITTAGHFVLWWMLVIAAVGRVVLWWMLVIATVGCVVLWWMLVIAAVGRVVLWWMLVIAAVGHVVLWWMLVIAAVGRVVLWWMPVIATVGHVVLWWMPVIAAVGCVVLWWMPVIAAVGHVVLWWMPVIAAVGRVVLWWMPVIAAVGHVVLWWMPVIAAVGCVVLWWMPVIAAVGHVVLWWMPVIAAVGCVVLWWMPVIAAVGHVVLWWMPVIAAVGCVVLWWMPVIAAVGRVVLWWMPVIAAVGRVVLWWMLVIAAVGRVVLWWMLVIAAVGRVVLWWMLVIAAVGRVVLWWVLIQFRTHVALGCLGPQHTGKLIITGVACSLSTAHPQL

SEQ ID NO: 922090 - protein, 121 aa, Homo sapiens
MRLRSSGLEELEEGRKDLAILLSRNCQDLCEAEAFSELLPGPVDTGMSQCPGFEESYLDIIQPMTVNMWLTPQATSVLTGRFQDQTYESISEIARKHSPKESNLLVFYKTQCRPRISLKVA

SEQ ID NO: 922091 - protein, 140 aa, Homo sapiens
MLLTVNVTECAIMVSFDNSSASRYWAERNSSPTLSLVREQGHLGSQLRWGKIQILKKLKHSTDLGPLGGRGARGRAQNPPWPEAGCASNERCPRAVDAQVTGKVVLAGGLGADERQELRQVLVRQERGSGLLPSRCFCIK

SEQ ID NO: 922092 - protein, 146 aa, Homo sapiens
MAGNMGDAMEYYAAIKKVEFMSFAETWMKLETIIFSKLTQEQKTKHCMFSLCVTVTRLCHNASWWAAQSLGLSGVGPGLTICISSTSQVPLLLSLGPHFEDPGKYLPVRAKPRNQPTKSLPSQHQQRLLEAPARKTPKTEFCGISP

SEQ ID NO: 922093 - protein, 161 aa, Homo sapiens
MVLAVLCVLLSLICLLRQTRVNHFSGKADGIKPAASSTRVCICIMDQDTLLFANDTRRFLSRDQGHRRAGGSFISEGHTQGFCVTSAGIAASTKCCERPREETLLNTTGICPHTPPRHRGLTSCAPAAAPNPTHHVESTSFSMAHKPTMTLVTMLRSLRHP

SEQ ID NO: 922094 - protein, 169 aa, Homo sapiens
MEALGTAWECAKTRTLGRESTKTRTLGRESTKTRTLGRESAKTRTLGRESAKTRTLGWESAKIRTLGRESTKIRTFGRESTKIRTLRQECQNKDPQMGECQNGNPQVGENQDGDPWRRRGLQTDGSSPTNPIAGSTLPKGDLISYVEKLKALLELINEFNKVAEYKINT

SEQ ID NO: 922095 - protein, 195 aa, Homo sapiens
MVVIINMIVTILINIIITIIIVIITIIIIIIIVIIIIIGINIITIIITVIITTIIIVINITIIFITIIIIIITFISINIITTIIIIVITITIIIVIITIIAMIIISIVIIIVIIITIISINLITDIIIFIITITIIIVITIIIVITIIIIIVILVIIITNIIILSSSSFSINIIISINIITTIIIIVITITISLS

SEQ ID NO: 922096 - protein, 171 aa, Homo sapiens
MRLRAPWWLRALTVTDLHPSPGQASCRTSMDVSAVPAAGEDTRYGQRLRLDLGLAKLCVSMKLVSFSQTWGEPSKPAWQSRWETPRRPLESLAYIIVFTLASKEVRSRLAQRSLGLSMKAGELSEEFGAFLEEESMNRSYFVASGRSRSIYKNLDNRASFPAFTACHALGD

SEQ ID NO: 922097 - protein, 333 aa, Homo sapiens
MRRQQEFGEVIVALQEEDPEPRRTAVIASHTLQSALLPESAAGRCRLQETGLMVAVIPVDVVGALESTLLADFQYAMSSAVVFILHVRSPDIVTLPECKCVSIQCRSINVLVSSVDSINTLVCSVDTIHMLVSSVDSIKVLVSSVDSIDVLLSSVDSIDILVSSVDSINILVYSVDSIHVLTSSVDSIDLLVSNVDSIHVLVSNVDSIKVLVSSIDSINFLVSSVDSIHVLVSSVDSIKVLVSNVDSIDVLVSSVDSIDVLVSSVDSINILVCNVDSIHVLVSSVDSIKVLVSSVDSIDVLVSMHSSLGDSVKKERERDRESFGIESSIYNGI

SEQ ID NO: 922098 - protein, 149 aa, Homo sapiens
MDRGFIKKLCPCVRVLPAKMLYVFLLVSKYSLPSYSLLVLRKLCSVEDALMSVLTSHCAPSTPAATRAQQTGTRGHIHPACPCQQSCVGASRPPGRPQIFLPLTTALSLEAYAADTCSAADFLHNPSSWGKVWYLNEASFDLYSYHYFW

SEQ ID NO: 922099 - protein, 161 aa, Homo sapiens
MIPHGHPRHGGAGSNHGGDAASKPGQPHTAHRGLDTLSGPFPKSSKASPQLTAWLPEEHLLKPEGPFKNHLTLWEAKAGASPEAKEAGPMVLMELDAQTVDAWTMDAPTVDVLTMDAPLGHPTMDALIVDAPTMDALTVAGSSVLICIDLVICEALHIFFS

SEQ ID NO: 922100 - protein, 162 aa, Homo sapiens
MAALPSQDPRPELQREGLDIRRRSQRRFTLHCLPHLGANAMALPSRPAMLCSQQPSRLKCACPSPEKLGIPSSPCWGGSTALDVAQDSLPSPVTHHPEAQDARYGGCVRVHSCPGGALSTRESVSYTNVDTTWQGRDCCPEYHSPSLRKVGAPTQWGSNTVL

SEQ ID NO: 922101 - protein, 134 aa, Homo sapiens
MGMSALLLPAKPVLELSQEADCIQEADRIQEADRIQEVDRIQEADCMVLPRAGLRACSVVSHVALEEKSPEPSGMSQGLGIREDQETPPALELGELYLGVSPWLAHSTRPFTSSLMITADPYPKKALGSNMTSL

SEQ ID NO: 922102 - protein, 153 aa, Homo sapiens
MQVFRNQKHVSTPSHMYFLLNCIFLVNYEFFYKFKNLLNKYCVLDPVLGTLGKEIIKAGMVPGFYRTRGLVQKSNIEWKVHNSSEEMSFGDLRQQDLRCPKTSKVGKLTVHPSLCGRRPESPWQTIGVRPRAQKLKNLESDVRGQEASSMGER

SEQ ID NO: 922103 - protein, 165 aa, Homo sapiens
MGLSHGLLSVLGPTCCLEGRREAGWVELYWTSLHSGPLMLGARINLDGGLKKVSGPWRNVHLRSGATAGVLRFQHEKGELVLTPQPEDRKMWESSELPKDLLNGFDQNSDGDMNTEVKAEVVSDGVVELLGNWSNGDSSYALAKRWQHFSPVLEISGTLNLRETI

SEQ ID NO: 922104 - protein, 225 aa, Homo sapiens
MNVLTLQQDSSESSITEIGRSIFLVGVKGRIPHVVSATPLREQGVCLLLASEEEVGISSSLYRLDLARKALHWSTNPEILGGLAGGCCWSLWAGWPGSWVSRWVGLVPGSTKIGLEPECKVVGLDLGLLSHSIWPDAKVGMETGFTELSLELGSAQASLGPGARGAILALVCLEPGDLRVNLLLGQPGTGTGLGPKSAGAGLVLVWAWRLSPQMPAWSLGPLGLA

SEQ ID NO: 922105 - protein, 156 aa, Homo sapiens
MLEAPDSSQALHSLPILKAAGARIIAEAIVVGLGITSGSSVTCQSAQAEVGWLHWGPRPVGFACLASLTGGATAADNGVFKDLRPIGLPMGLSVALPRFQATRCVSLQAPGMPQAGQKGFLACWVPVLLESYHHPEDSICFCCIGSSISWIPYCSP

SEQ ID NO: 922106 - protein, 143 aa, Homo sapiens
MGTGSARSGHGSSSPALLSQGRRCREKASKDTVKEQASKPFAFISFQLYMLGLLILTSLYLLAPQPFLQVFDSKESPTPMCVDSPPYSCRPLHQTSASIPYFTSHSISAFPVTSTPAASASANLTHQSALDIAASSGLLQALG

SEQ ID NO: 922107 - protein, 145 aa, Homo sapiens
MNITDINYIKYDYFYIKKKLERGEEAAEEKLEANRRWFMMFEERSHFHNIKVQGESVSASVEAAVNYPEDLAKVMDEGGYTKQQIFNVHKTAFYWKKMPCRTFIAREEKSLTSFKASKDFLTFLLGANAAGDFKLNQCSSTILMI

SEQ ID NO: 922108 - protein, 274 aa, Homo sapiens
MSLSRPECFPSERQNHPQFWFVCFSPCPRTQNSPWTLLIRIVALTNAAAGVLQLLKVVHPELFVSPGGFVVSLTSGVKPQTLTVSVTAHKGSVDPKSEQQQDLLQRAKEQNFHSMEGDPSGAGDGGVARFFGALLLKTPSGSMQTNRQVLGSLGSDPTAASRGVCLQLPSGHVSRAAQHAGSPSTAPVKLHVIPLVDGPPVCQCLSVCSYAGVFLSTTTEFSRNLGTQMRGVAGFPSTCICYSRGAARVLDLVRERGKLKKDLGCESWHSPSAY

SEQ ID NO: 922109 - protein, 136 aa, Homo sapiens
MRAWGRLIYHFADITPSDDECCQHWVLSFKAVGSLLAQGVSRNVWEVGSETGASQLWPVPYLAVAELVSKMQDKILSSLPSPLLKQKDEVCFGAISFAAWGRGGTMPALPWLPQLVSQSKANSVAPDISLSENIAS

SEQ ID NO: 922110 - protein, 187 aa, Homo sapiens
MVYEQMHTYNHLIFEKADESKQWGKDAIFNKWCWDNWLDICRRLKQDPFLIPFTKINSRCIKDLNVRPQTIKILEDKLGNTILDTGTGEDFMMKMPKAITTKAKTDKWHVSKQKRFCTAKETINRVNRQPFNYQQSKQTTYRIETINRVNRQLTELKKIFANNASDRGLISSVYRNLNKLTIKKNFF

SEQ ID NO: 922111 - protein, 180 aa, Homo sapiens
MSHPGLALCGAILCPCPLAPTYKRTVRTFTCLEAFTHGLNKTKQCTKASCNGNAVLYLYKNNSKCKRPYCETISCPKKILNYKREQFKKKTVLRMTASLLVDCCHNMREMPSLGLLPVTEVAVPTTHMSCPKGATHLSDSTAVLTFVTEIQKYDFSQCSQWRSKAEQKVFLTLINLAYNP

SEQ ID NO: 922112 - protein, 154 aa, Homo sapiens
MATGVSIGNCAYSHAGGVVNTGQGADGHRRFNLLTVLYGRGSLGKLTIMAESEGEARHVLHGGRDMDEAGNDHPQQTNTGTESQAPLLQVCWSLLDVHSRPCLPGSHWQRLQTSKDCCLFLLLEASSQRGTHQMPARALLYEVSVSPYWEVSPS

SEQ ID NO: 922113 - protein, 204 aa, Homo sapiens
MWAAEHCLDKPGAMCIIEGPVDSWDSPVMPKGLVRSGQSTYLDGPGRSCSEILTGQRIPEHCYKALSVCPSHRIPEHCCHCLNVCPRHRIPEACCWGLNVCPPSRIPEHCCEGLNSHRIPEHCYKGVNIFPSPSIPEHCCKGLHVGPSYRIPEHCCCGLNVCPSHRIPEHCYKGLNVCPSHTIPEHCYRGLNVCPSHRIPEHCY

SEQ ID NO: 922114 - protein, 1080 aa, Homo sapiens
MEGNAMEWNGIELTRVAWNGKEWNRIEWNGINPIGMEWNGTEWNGMERNQLEWKGMEWKRMECNRKEWNAMECNGMEWSQPEWNGMECNGRENRNGMEWNETNTMEWNGMEWNGKESTRMEWNGMECNGMEWNGINPCGMESEMEWKGMEWNQTERNGMEWNGMEWNRMERNAIEWNGINPSGKEWNGMEWNGITCNQLWWNGLEWKGMEWNGIKGHGMERNQPEWNGTEWSGMVWNGMEWKGINLKVEWNGMEFNGMEWNRIVWNQPEWNGIEWNGMERNGREWNGMDTTREEWNGKEWSNRSGMEWKGWNAMEWNGMEWNGMEWNQPELNGMEWNGTEYNGMERNHPEWNGMVSNAIEWNGTELNEMKWNRLNASGMEWNGMDWNGMEWIGVEWNGINTNGMERNGMEWNGMERKRTEWNPPDWNGMERNGIHPMEMNGMEWIGKEWNGLEWIGMERNGMEWYGMKWKGTEYNQQKWNGMEWNGRESTRVELNGKECNGMEWNGINPSGVEWNGMETTPVEWNGMECNRMEWNGMEWNSMESTRVEWNGLECNGMEFNRTEWNGMELIESENGKDSTRVECNGLEWSGMEWNGMEWNQQKWNGMECNGIEWNGMECNGTEWNAMKWNKPEWNVIGTECYGMEWNGMEWNEMEWNRIETNGINWNGMEWNRMESIWVEWNGMEYNRMEWNGMEWNGIQWNQPQWNRMVWNAIEWSGTERNGIRMEWNGMEWNGMEWNGVEWNKHQWNEMEWNGMEWKGMERNGMEKNEINPSRMEQNGMEWNGMEWNGMEWNGMERNGINWNGMKWTGMEWNGIECSGINKSEMQWNGMEWNQPEWSEIKWNGMEWNGIACNQLWWNGMEWYGMEWNGVRNGMEWNGMEWNGMEMNQTEWNGMEWSGMETMQCNGINGNGMHWNGMEWNHPEWIGMEWKGMERNGMEWNLMERNLNNPKWNAMEWNRMEWNQPELNGMEWNGTEFNGMEQNHPEWNEMVWNAREWNGTERNEMEWNTLNANGIEWNGMDWNGMEWIGVEWNRINTKGMERNGMEWNGMEWNGTEGNQPEGNGMEWNGMESTRLEWNGME

SEQ ID NO: 922115 - protein, 143 aa, Homo sapiens
MRDIFLLPLKPSYSVKSTWYQTKQISSAAALDSPGSANPVVNCTCTGSRVRTPYESLMPDHLMWNSFIPKPSAPTPESVEKSCSTKPVPGAKNTSRYFLVKPNLFHRPPKMPTAQSLSISPPCNPTASPSHLTRSSLSTLLFH

SEQ ID NO: 922116 - protein, 165 aa, Homo sapiens
MWSKKKSDDGGGGGGGGYSGGDGGGDGSSGDNDAGGGVAVMVGGGGGGDSDDDSNDSSGNGGGGGDGSSGDNGGGDGGSGGDGGGDGGDGGGGGDDSDDDGNGGSDDGGGSSDGNSGDNGGGGDGGSGDNGEVVMAVAVRAVVVMAAVLVVVLVMVVNGMYVNVK

SEQ ID NO: 922117 - protein, 196 aa, Homo sapiens
MEHEALLACTGEDATQNALTGLRKPEQRLPRWGQAGSREGQTPQRETRGGQGGGERSREEGAGPEQTQTWGACFRGSKLIRQLSSPSSSAGSSYWVLSQPQQMPSYWKHRAWFLLAKGFTSQRQATPSHSEKTKKERELLQGGPSDSKCPRELFHGSAEPVQPVPHQSRPPLAPLATPCTPECLVSSFKDTSCICG

SEQ ID NO: 922118 - protein, 115 aa, Homo sapiens
MTSEFPHRQNGGLGLFWGQGSTVHVKHTTQRLPRSSCPGDMLNNRVSTRPDGEGKGRRRDPFPKNIDFDLEPKQLAMKDCYCCSAYVEAGPERLSDSSWVTQPFKTSCTFIMSAI

SEQ ID NO: 922119 - protein, 144 aa, Homo sapiens
MLSRQLSWCVDGPGWRPSQRGPLLPNHKINLLVSGVSTSQTFMCRESPGDLVKLQLPGDAVSWGHTWSTRAEPSGRASVPWFSALGPEKNTSPGPYLQNLCLLVESEPAPIHLHWLRLRGNRIENTAFVLCLQEGSAALSTHSS

SEQ ID NO: 922120 - protein, 140 aa, Homo sapiens
MPMPLTQSEGILHYFESYSEGKLLPKQDVKFQEANTRQRLQTLGFLSQVVRRWGKSWGIPRAVGPCPFSTGGPIFQAGLLEPLPRNERIPGVLFLLWKQKAIVGSNVLGWLERQPEPHSGETKGLSGYWRVICLTSGDEA

SEQ ID NO: 922121 - protein, 166 aa, Homo sapiens
MSRCWGWGQLLHLFQLTLLYSAFLAWAKSWIFGLALKPFDPAAAKGVSIFYCQLLLLSHQHVWETLTSAVMVLHGAGEGHEVPEELWFAGRQLEGGRVGFKPSPCSFDNILKESRASDKDGQRLALREVCTSLEVSWDNEVGLDPSDHYTSLRSTVVLLNEMPSDV

SEQ ID NO: 922122 - protein, 138 aa, Homo sapiens
MAGPTEPGEVSAPGRPAGLEAEAQAPALVGKRAEGDPGESAEEQTGCGARRPRLEAAVNATLPCALIFTASPLPSSCRTFSTAVVRGAYTPRFTVTLHPPCLAAQQPLTRLKCSPPLSFRAAKLPFRRLGPCSVLFVF

SEQ ID NO: 922123 - protein, 136 aa, Homo sapiens
MGWAVFLAPTWGWLSFPSLLLLSVQALVSWHSSLKVLLGSSSLPQRHQISMLVHSRLVCGFLVSCAKHLSLPRGLLLTGWMIEEAEAQVGEEIQGHGIAGECQVSGHARTKVPDSQAMFLSQFQAASPVSGKAKRM

SEQ ID NO: 922124 - protein, 166 aa, Homo sapiens
MICGGGGSAKRGTATWLLPLAKFLPLWPELPNQPEKQTENQRNLALAAQDQRLPGSMTEDLLEAGKAHRLSAEERDQLLPNLRAVGWNELEGRDAIFKQFHFKDFNRAFGFMTRVALQAEKLDHHPEWFNVYNKVHITLSTHECAGLSERDINLASFIEQVAVSMT

SEQ ID NO: 922125 - protein, 173 aa, Homo sapiens
MTQEQALCGAHSQISLMDSGMLAAQAAPFSTLARGSWTSLALLQLLFCGAAALHHPGQQRAYTYLLTTNLVVGSQPGSHHREKGKSMENMKKDTSFLWGHWGYGNYYHNERPLSTFFTEIILCCSFWNPVTLENTKGHWSLQLPIMSRSAGITVALSSGSPLLQLLEEQKAIC

SEQ ID NO: 922126 - protein, 141 aa, Homo sapiens
MVTDRYKLLTFKIHTYIYTHLTDFHTCIQPCKRLIDQDIEQLQQPRSLIVPFPVSNLPRGIAFQDPNQTPPPLESQPFCSQPWLIFPGFGGTGAYSPFNAVKERILASAYTLWAGTVSSLSHLPRVSGDAGARSALVDFRR

SEQ ID NO: 922127 - protein, 164 aa, Homo sapiens
MGHRDGDSTCTPPRNEGARGKFSKEDPAVKVLRQRNKDGSWRLGQCALKWEGRGDIGGEPTVFATVAEFFHHQGYVQAHGEHMHASYHMTAGWPSVLTLQCGLRQGRHLKDLGDVSTGSSRTLTSPLPWTPGRDEKGQRHNRACDLWPAQGPPTLPKRHAGAAG

SEQ ID NO: 922128 - protein, 140 aa, Homo sapiens
MCFHDNTGHRHFSHENTGLAEDGWEAEQVTGLSLQSQHLYLATRLSHTPAHSLHHEVKLCPLTLMARHTGRSRSDSGPVALGNRGFHLLLLESFAVEIQPPFWEPAWAACLCLSHLGSEPLRTQHPCLCHGAHTSCHFYP

SEQ ID NO: 922129 - protein, 134 aa, Homo sapiens
MGHAEVDRVDSLSQKCNSFNFLQNSAWEFFSFLVLLCWRYIGVYGFLGFILTDLFMVGILSRTLISRGTQNEIPFTRSPTRSTNSDKFVHGPNFCGASVENRNPLLNKRDIPLRQFRRSYLLPCNFLISISTSR

SEQ ID NO: 922130 - protein, 157 aa, Homo sapiens
MATEAEAKKPQEANMKDPEPFFLLQLVGPSGALYCRQLAGPSFGILDPKMQSQSGSKPHSLDTQELFSVLQLKLASDPLGGLPGNLQCNDSVHRPLSCRRPPAREEGSNADLTFCSRGGGDGCCPGAVGCLGAPPRGSEEPSSPRELFRQLRVEMEA

SEQ ID NO: 922131 - protein, 129 aa, Homo sapiens
MFGGVSRGCHHCSFCPNCSESADRNSDSMLFCQDGKLVWKTFGSIHPRILLPYLGISVILFPTKNYLYHSELPSTEHNCEIPRFLEIFQIGKGDKMNQAAKFHSLLFEKQECFCPLCFFFLSCSPFFYL

SEQ ID NO: 922132 - protein, 137 aa, Homo sapiens
MSLEIKGKNVRTKITKHKILVKILSFPEVKSVVIATVTVAKEKEVCSEERPCLGQSDVSSSSSSSRRENRGSPRNQPRSFYLTDKIMNESWSPHTLTLTRTSTTLPKENWKGRSLNPATLDEIEMEPKRKIKQDHLR

SEQ ID NO: 922133 - protein, 174 aa, Homo sapiens
MCDVVDVFFLKLCEMHGTDTRSPIQQQDINRFGSFLKVHPSLVADLGVNASSVKLGRLLGSLATQTQRYESAGAVMWTSGLQNSETSVSAVDKPPSCGILLQQPKETKTTANGRRGSSVYTERSSSVATKLELGRAGVPRTHDWYPTFIPQHTGLLVVFRPSKKVPPSGSSPAT

SEQ ID NO: 922134 - protein, 167 aa, Homo sapiens
MGVCYMGVLYDAEISDTDPVTQVVSTLPNRTSSAPVSVTDQSKNLSRIWESGALHLMSSSPCERAREATSGLHEGLAGVEPGEERRAFSGKMRGGNGDVCVLIGLFRKMMMSAIQAQHPEFLWEYQGQGYFPHGAVRVESAPISVSFRVPAPPPLSAFFPNILTSVR

SEQ ID NO: 922135 - protein, 134 aa, Homo sapiens
MPAHESSQEGCILHKATEVELPKTMGTHLLLQRDLDVRHGVKGDHFGALRFDFPAGFWTCIGPQSVESVPWFLLTAYSKHVKEQREFEGEIVTQMDPSLKNLKGSQPVHIGKHQKAYLEDKTKGVVNYDLEKSL

SEQ ID NO: 922136 - protein, 170 aa, Homo sapiens
MDSNGTESNGMASNGIECNRMEWNGPKKSTGMESNGKESNGMESNGMDWNGMDSNGIDWNIMDSNRLEFNRMEWNGMDANGMEKECTGWNGLEWNGLEQNGIEGIGIEQNVMELHGMDSNGMELNGMEPKGMETNGIEPNVMELNGMALNGIERNRMEWRVMERYQTEWN

SEQ ID NO: 922137 - protein, 149 aa, Homo sapiens
MTFTGTVWATCPCRSQSPHPAWPDLAFMKPLQEASQKDLGWVPALPFTSCTTSEKLFSSWTRAAKETVDLYLYEGKDENITWPVFMHQGTCCSHEDVSSQPASLYKLHPQPHYAPFPGTFQGALRICIQLSQAETRVTSWKTCLVIAKV

SEQ ID NO: 922138 - protein, 132 aa, Homo sapiens
MGGNQSRQAENSKNQSAASPPKDCSSLPAMEHSWMENDFDELTEVGFRRSVITNFSGLKEDVRTHCKEAKNLEQRLDEWLTRINSIEKTLNDLTELKTMAQELHDACTSFCSRFNQVEERVSVMEDQMNEMK

SEQ ID NO: 922139 - protein, 173 aa, Homo sapiens
MIPFHNPFHSIQFESIPFQSIPFGSNPFNSTRVNSIALHSIRIHSIPFVLSPFNSIRVHSIPFRSIGVHSIAFHSIQVYSILFHSSPFLSIPLESILLNSVVFHSSPFHSIPFHLCPFHSIRVHSTRVHSIPLHSVRLESIQFHSIPFKSIPLHSIRVPSTLFLSTRILSIPF

SEQ ID NO: 922140 - protein, 140 aa, Homo sapiens
MASQVFALPGSSQDPLCLKKERRLFVYIFTWLEQSSEISSRTVLVCLHAADKGIPKTGQFTKDSGRVYLQFHVAGFTIMVEGKEGQVMSYMDGSRQKESLCRGEENLSGGGKENIQLSDYTLKEHTKCMVLLHHHKVEKS

SEQ ID NO: 922141 - protein, 135 aa, Homo sapiens
MAIITDSRPVEGQGKIHRAVEEADLIISEGLPPSSRLQLSIRLLLHTRAEPVPKRGTRHMVRNRVGKACQLLMRPAGCLCFIGPSEHSANKTCSDPGKGPDRYPKNCSWVEISEPLATQGAQYCEMQKREPYDAG

SEQ ID NO: 922142 - protein, 138 aa, Homo sapiens
MPLFAKAKQHIHFKRHQVVEGRALFRWEHPQATALKSELPECTTSGKRPAVKFEMMDNLTPKRPCCNLNSCWLSESLTGLKDAQIAGKTLCMGMFVRAFLEEISIRISRLSKEEQLHQYVWTSSSPLRAQIEQTVEEG

SEQ ID NO: 922143 - protein, 125 aa, Homo sapiens
MVPFSLLLQEAQGDFSSIFTYEPGRTLGDKTQNCAPLPQRLGYPQVFLSETCLHNASNSLLIIVQHWVHVHNMQNHGDFHGVQQFTPLILRQLLPFLECSVAAALVLHLQDRSPERGPVHDLIGN

SEQ ID NO: 922144 - protein, 142 aa, Homo sapiens
MCLLVIYPVQRCTPVLLICHPGLPPAKVSGSTCVLPNPTDVVLTAASGRCYLQNPILSPAFTEYFWDQLSQALGQNLGCTWRRPMAERGTMRRNPRWNPGFGQECEQQLKKFSVLKSISFGEMLPKWSNKNHSGPIVSTEDC

SEQ ID NO: 922145 - protein, 242 aa, Homo sapiens
MNKNHEVKNQAKNTVKMEKCVQMKACAPLYHWRTLKPTPEKDPVGTCYVAIQNFSAYAEFSPCRNSKQLLFLETDISSSAFLSSSKKQTSRHGQEVHRSLTQSQLVHEHMNGDLIVGGPGSFYWQAMVVLTVKEEKFEKYFGGKISSLNDGLDICWECGSAHGGPASCFHSVNVLICLNTGQVITASVADIIANYSFKDILRKLAGEKQTEVAPASYDDSYLGYSVAAGEFTGDSQQGERHC

SEQ ID NO: 922146 - protein, 425 aa, Homo sapiens
MDHFIFFLNACDWALSGFAVITCINRVFIAPRRGPCSSDLETPESDEDNTSQCRSSMDEAFLWLWILTPSSRRTGEFLRLKAIVSQREGSGGTLSCLDYPMKTCSFINGHFRSSRRGRSLDHCSLPVCPSSEFTLSIFVSIVVPPNIAELKNLEVLNFFNNQIEELPTQISSLQKLKHLNLGAFIVYRGSQAFSKGLRAWLLVTPEVSGQAGKMVLGLKAPSDPIVMYRGAKVKVMVPDLTYWGKAGYKQEQTNEVTDMLAVVDQQGEQQDRGALYIGFSEEVTCQVRAHDRESLAVWVQLHLRKEEQQEQGCGQESSWDEGSAASSEVWAAWEGGTGQSSWGLQTVGGSWNFTLGAMGICRSILDRAGASPHWSLQTCRQFSGEHYGCSGIRPIKKMFQWEQVKDDGDHLEMEPSGIYFEGRLE

SEQ ID NO: 922147 - protein, 139 aa, Homo sapiens
MATCLRTDSNKYLHSLGLGPYRQANDPIVTQSREDEQQNQELVRAEVGLQGTQGCSFRESIKEKNPCPRGRNSREMTVTASGESRTHHHCVPRKPWAIDSLWKTTSQEFSAKRTSAEAGIIALWRTEPSTHFDTQETTI

SEQ ID NO: 922148 - protein, 138 aa, Homo sapiens
MSPIPRACSTYTPKPAPHTLMPGFQAQNLQLPEQNAFNSKCQFCCDLHFRLSSNDPLPSTTPTHLSVIPQTELLVLIEGAVFLSCNYSLLAFHFAPLPSFPYSILGIFFILPSVKATRCTIYSRSVSVKIIFPDSHIV

SEQ ID NO: 922149 - protein, 434 aa, Homo sapiens
MFLSAQAQQKPLRHGRLLLTGKETVRKRQCNTRYEHQGHEHQGREHQEHENQGHEHQGHEHQEHEHQGHEHQGHEHQRHEHQRHEDQRHEHQGHEHQEHEHQGHEHQAHEHQGHEHQGHEHQRHEHQGHEHQRHEDQRHEHQGHEHQRHEHQGHEHQRHEHQGHEHQRHEHQRHEHQRHEHQGHEHQRHEHQGHEHQEHEHQGHEHEAHEHQGHEHQGHEHQRHEHQGHEHQRHEDQRHEHQGHEHQRHEHQRHEHQRHEHQGHEHQRHEHQRHEHQRYEHQRHEHQRHEHQRHEHQGHEHQRYEHQRYKRQGPEHHCHEQQGHKHQGHEHQRHEHQRHEHQRHEHQRHEHQGHEHQRHEHQRHEHQRHEHQRHEHQGHEHQRHEHQRHEHQRYEHQRHEHQGHEHQRYERQGPEHHCHEQQGHKHQGHEHQVS

SEQ ID NO: 922150 - protein, 155 aa, Homo sapiens
MTIYKCHGNIRKLPYSCQRSEGTGYTAAPKIGERDRTQRITTYPSRNLPAEASAGTEPGWENLSSPWHHWGGPVDWVHRDGSGAYSLALWQTCSLNPWRQAGLGPESMEAGLVPVSAGVVLGSWFVRAGLLLEFIEVGLDPGSARIHLDPGSSRA

SEQ ID NO: 922151 - protein, 179 aa, Homo sapiens
MRGLSASTLGPALYSNFSLHWKTVIPSGQTHISGCQPSSPRSKLGKQFPDFLGRRTIHFHAANIDIPKTGQFAKGKGLIELTVPHDWDSLTIMAEGKEEQVMSYMDDSRQRDNEEDAKAETPDKTIRSHETHSLPQEQYGGNHHHDSIISHWVPPTTCQNDRSTIQELEVALDESVSEW

SEQ ID NO: 922152 - protein, 149 aa, Homo sapiens
MAVLGVEGKVSDLNCKLGKASLRSCYWSKVLKHQRDDSVSLVDMSGRNFLGRGSKNTSIKALGWECGCGVYDRAGDTGARKKLFRQIVRVKESLARLPFYQKAVLQNHFFSNKEQPEKSSCIDKQAGSLHRGMLAAVPIEKGYLGPRHV

SEQ ID NO: 922153 - protein, 172 aa, Homo sapiens
MAPTSTLLQPISMDTTKLLLLLTHANQDGSRCQLTMKDLADATHGSVVTGNLGAPQLPQCSGFLTLRCQRTKSGLNTSPQETHQVVLRKSGCIKLDTKEILAWWCRLQEREKRPQWKKLKPTAISVSPMKQESSFTPKMAENPLTYGAKILPEACSQRSIQECGESERSGVG

SEQ ID NO: 922154 - protein, 216 aa, Homo sapiens
MCYNALIEDQTSLNLPLSQNLTQSKTLTLFNSVKGERGEKAAGEKFEASRCWFMGFKERSCLCNIKGQDEAASADGDAAASYPEDQAKIFDEGGYSKQQIFNAKEAPSSFPLVKIQLEIAIYEIESRLSPDTKSVGTLNLDVPDFRSVFVMENAWGITTVIILLLFCKIHEINILGSLPLEPGWVSQNKTYESVESSYDLVLPGASPSYQLTVALQ

SEQ ID NO: 922155 - protein, 192 aa, Homo sapiens
MYLPTKWLYTAYLRPNKLHSKDVRSGTVVVPEVIMKNEGLGHSTRKTTKNKKKNKNTRLAEVLAEGKGNRERVVEEDDQASGNVPFSQSPVQSKALTLFHSMKAEREDDCHQKVYYSQFLRGENMPHHGGPPGGAPGWVRRQRERGCCRQEPLLCFQWEESGKGDFEDVIKVEDHEMREVSQDYSGEFNMTT

SEQ ID NO: 922156 - protein, 140 aa, Homo sapiens
MTCRCMRYSFHTLGKVRFQNGCKCEHLIISTKTDILTTMDSRTRVPNKVLTHNEIWSQLTDCGIPMVSSDLAISYQVYAINIPIVPLKNHVALAKATFYWRMKKYADFQKDVKYGVLDDLIFGDLKGYYGSPARMGVKIK

SEQ ID NO: 922157 - protein, 128 aa, Homo sapiens
MKLPEEGTGSNLCCSAASDSDTQANRVWSGPPANSSTLAAEGPVRRNTNNQKGIVSTSTKRMSTQRPQPKVTDFKDQRITSIEKNIYDLMELKNTARELREAYTSINSRINQVEERISEIEDQLNEIK

SEQ ID NO: 922158 - protein, 151 aa, Homo sapiens
MGKKQNSKTGNSKKQSASPPPKQLSSSPATEQSWTENDFDELREKGFRRSNYSELQEEIQTKGKEDIIQENFPNLPRQANIQIREIQRTPQRYSSRRTTSRHIIVRFTKVEMKEKMLRAAREKELPYRAPEGSTKPGKEQPVPATAKTCQI

SEQ ID NO: 922159 - protein, 227 aa, Homo sapiens
MKLTLEGENALVNLNINLQIIDISLLLTQSINTEIFNPAAETKEELNINHQDNGENVSRACQRPLCKPLPSQAQRPRRNKRFYGPGPGSPCCVQPRDLVPCVPAAPAVAERGHCRAQAMASEGATLKPCHLPCGIEPVSVQKSRIEVWEPPPTFQKMYGNVWMPRQKFAIGAGSSWRTSATAVQKGNEGWESPHRVPTGALPSGVVRRGPLSSRRQNGRSTDSLHHD

SEQ ID NO: 922160 - protein, 138 aa, Homo sapiens
MEPSDISHFCYLFFPSFMMFRTLSMGYLSPGTLFNHIGFLSVYIDKGLSCGACSSSPPPAKGLWILSAFLVCSCDSSWSKSLRCGSPHAALSVRVEGALTACESLLRLFLPYIDICGRTVIFAHLFRTRTQNWLAITS

SEQ ID NO: 922161 - protein, 135 aa, Homo sapiens
MSISSTRSQIPTPGHDLDLRIEDMEHLVQVYEESTKSPTAIARKLENTFEHSPETREMLPQRDGHGVMGTPNPHPTGHHPHPSNSCASSEYALMLIGRCQSQRGNNRHFDANQSPHLHSLLLRCVGVLWELGKDG

SEQ ID NO: 922162 - protein, 164 aa, Homo sapiens
MAAAVCWRSTPDPVCLVSPADAAEQQRLLPAHSSGSLSQRGTSLMPVGALLYEVDALPSEEESREAVWLQPLCRAVLSSARHFDEISVGKKGEKSVSNNKPECRELQPRTHRECQWYFSILLTTPPSLQLVIKINGGVLMGHLGYIVCTTHIQSDWQQFKPVPC

SEQ ID NO: 922163 - protein, 166 aa, Homo sapiens
MRSRKFCLLFKLGEITACCCIYRNDPEERGKMMQERDGKIPRGMWTLKLLKPSTKRDEQESWWESCKVLEVTVLEGMKFWGKIVAYHESEYQCREKDKITKEKVSERVACPSTPVGIYSRVGRETEKRNKTQRQSIEKQQWAQGTGAQHTKDLHRRHQPLKTQHNL

SEQ ID NO: 922164 - protein, 129 aa, Homo sapiens
MLRLVRGPTPPNCKPLHGNPLLLIINNPQTKAQEPSIFERSGLGADAAGQDPVGIFSLRLVKPLVNSNKGIQTQSLGDTWNPTLSPSIASPTSSSHLQNDPTGCGSRKLKANNSSRDRISRCKCLAGMD

SEQ ID NO: 922165 - protein, 144 aa, Homo sapiens
MVVGSEPQALITTSRGMRLRRGGCECRGSRQPSPGLAWVLTVSTFYRECTEFSSPPAHRTSPKWEQRKPLGFCSGNYNHCCFSLRLYAGHLGESLAVCIFSDQICLVRSHMACLQHWQLPLHGEFFTCLGLSHSADLLKCPFFR

SEQ ID NO: 922166 - protein, 163 aa, Homo sapiens
MRILLKSRAFLLIPPSHLHISQLPEPQVPGALDCPRVSSQYRAGENFGRNTVHICSTAGRLPAWLRLGFSHLEKCEGELALPLPSQGLREIAAATPALSNYLTNESAAINMEDCVEVEFDPGVDSVENIGIPLNMNSSRREMTSWRICLASSQSTTVGEMPEP

SEQ ID NO: 922167 - protein, 425 aa, Homo sapiens
MAAEEINDSPVEIHDYLSAFANSIDAVDEMLKNMMSVSRNELLQKLDPLEQAKDTGVEGRESAMMAAEEINEDYPVEIHDYLSAFANSIDAVDEMLKNMMSVSRNELLQKLDPLEQAKVDLVSAYTLNSMFWVYLATQGVNPKEHPVKQELERIRVYMNRVKEITDKKKAGKLDRGAASRFVRNALWEPKPKNTSKETGVKGRASAIRAAEEINEDYPVEIHDYLSAFANSIDAVDEMLKNMMSVSRNELLQKLDPLEQAKVDLVSAYILNSMFWAYLATQGVNPKEHSVKQELERIRVYMNRVKEIADKKKAGKLDRGAASRFVRNALWEPKPKNASKMHLGPTLSARRSVFGNQRLWLCFATTAQLSEAFCALLRFKLCLCLFSRRLSLEVKMSMGIVGTPVARITGVHGGNVMSEVPSSPPP

SEQ ID NO: 922168 - protein, 134 aa, Homo sapiens
MWGGGRAVKPFRPGSPCMSPNVLSSGAQHPSLRASPSVQPSSPSPHVQFPHCAQLHLQPPTLSQPHWRRTHHRSPFMRFTGHAAPGARSSTQPLRMLPSACGLLLTTFARTIHTCPWAEWIGNDNDSSPVRVGC

SEQ ID NO: 922169 - protein, 132 aa, Homo sapiens
MRGSKQHLEPMPQQLPDVELGQGTGLSAPNEYPGQKEHILDQKGGKKCVGMGRRGREEVTGMPTAEVCGDAGLSLVATLLGLALGEDGLQSTLCCDSSPQDPPQGTEKELRCVVCIHAHMCNELVCMYLCVY

SEQ ID NO: 922170 - protein, 173 aa, Homo sapiens
MLMGILSIITEQVVKVLIVLTPQFLSRDKDQLTKELQKHVKSVTVSCKSPRKMEFVPELPKTVTGKIKQEGPPGGHQRLRKAGAEKALPGDERSTCCPLLSHPWRSALERPLCDCQLPRCTNPETHREINRYRKHRDTEAQNRPSFTWALRSMAHGQAHKHTHQEDTDTHTEP

SEQ ID NO: 922171 - protein, 141 aa, Homo sapiens
MADDLDFETGDAGASATFPMQCSALRKNGFVVLKGWPCKIVEMSASKTGKHGHAKVHLVGIDIFTGKKYEDICPSTHNMDVPNIKRNDFQLIGIQDGYLSLLQDSGEVPEDLRLPEGDLGKEIEQKYDCGEEILITLLPLP

SEQ ID NO: 922172 - protein, 182 aa, Homo sapiens
MQGQTPLRLKQGTHLLLPQDCSLLQPPQPGLACWTWSPGTGIVALVVTLIREAGSRATAGQPWPLPSLSHPSGGQAVSGTLYCQEVRHLAYASPPALGKCPPMLRFAVLSAPGAGRAGEEPECRAPSLAELETDGHWEGEILTQESSECCGVGAAQAGMGSTHVDATYMGSFVIQPSGGTAV

SEQ ID NO: 922173 - protein, 183 aa, Homo sapiens
MFCQKSMKRPSRTEQFNSLLRYKAEKVQTGFRPCLLSQSACKMPILEACWTEPLINCPPSEDGRSLMLAFLNSLGKPQAATIADLLSVIREHTPSAHSNPLTAPQPYWLTYPTLNYYLFTLSLSSFRVTTLFLKGQTVTTLEFASHTFFVATTQLYPFDTKAAIDITWTVGMSWSLKKMFPID

SEQ ID NO: 922174 - protein, 144 aa, Homo sapiens
MLCPQVFSFAEVKVSEMQDCQVGVAWVPKSPLVEGPCTTTARPSSHNDRSQVQLCWVTPLRFGGFSMALSTLSLGPRPHPCLLFFNSQILKEDTDPGDIGFKGACHLLSGLALTSPGLAQPQWPLMGRVKGASRLAVPLVLPEL

SEQ ID NO: 922175 - protein, 149 aa, Homo sapiens
MRQCRPKQQHPGTLRTGLPELFLSWGPSLEDKPLVAQPCYEVDHGQCLQHLKAPGSGQGVPIIDQKEQGPREEPQLAELLPCIRDLPLILDHVHKGSAGAGSHVCQTLKPASSILPLGPRASLLNRAGVTWSSPSIQVQEGQIPATCSE

SEQ ID NO: 922176 - protein, 126 aa, Homo sapiens
MFFVLSLHLSFTCSSLLLNSGWSAGASHAKPGTDSRRHGGQTTSWGMKTSIHDNIKSLAPERETGLLPVGDIAVYPVKRVQRNHRLSVVRALSNFFILFSTFEGNPRKEEEREAQKLAKVTSLEGF

SEQ ID NO: 922177 - protein, 170 aa, Homo sapiens
MRIGARVLHEGQVSLPSHIQPTEVEPAHILMGLEDAGLLKAGNNKPIAKKSPHLLLWRKKLSLLTGSPPQQCPRLTLREQLKQLTANPVPALRHLPKHRGGQHQVGRARLLHEDSNIFLRPSRGHHWPLYSPEPAASGPRAFSTPFQQAGVQGWQHSPQDGLPGSQAQID

SEQ ID NO: 922178 - protein, 187 aa, Homo sapiens
MISRVNGPSPGPPPWEPLPPSRLTSVIFAHMRTELHPQEGTAGRFKSRSCHPRSGSKSAPQNLSLLVAPPNYLITANSTCSIPPVLRKYPGKRDSSVISRNKQQWMWLSLARSSEGTGNSGCAERLPWSFWDKDSCGKGQDGKDWQKIELMQLSQTGGDDCWFCLCVCALMHNNTSVNDGPHTQLFP

SEQ ID NO: 922179 - protein, 152 aa, Homo sapiens
METTVINLGMQGWEMQCGNSSREDNSEIWVDPGSFVWSGFCSSKECLGERDAGNDRLCVPLWTSQILEQIFLICLPGKWYTQQFRQFQSPWWPGSNGVSPVTQMSLYSSLHQGLAMGQIQPPPVFVNKSVLAQTCIFVYVMSRAPFVLQRHC

SEQ ID NO: 922180 - protein, 143 aa, Homo sapiens
MSVQLSLPSEIRRWLWALGSQMIESPIRVNSLYVIYGRHIIFSRQSAFKCLHLALVIPSVMHKLHLVSDYPMLHWGICAVRGPWLLRAPCPIGSSLQPCQVAGLCVTKHMGNTAYCKGNEGQMGQSSRSLCRWGCGNIHTESN

SEQ ID NO: 922181 - protein, 206 aa, Homo sapiens
MCGLFYVELRVCPAMVRQLAFHQQPGHRDHKRGLCIGKLIFLCILEEERMDPVNWQRLVGDIITDTFSWAHLIATDRDLLKHLENTRLSWGSRCRTCTLVGPHRIEPSEELQCCVEQLLSVQRNQRWIPHVALGRTSVKSTNVQGMALVERGPLLLLTDQVVLWSGPGSSSLQKPFITPKQHLHPVIQAQGETTELAGRRGHVSRE

SEQ ID NO: 922182 - protein, 145 aa, Homo sapiens
MEDLKFKVLGKETRSPIASPGFRASLFDPRAFGEWHNSNRGPLLQQARKKFQGGDVRLGSHLGDFSVNGVEISPWRWSLREKAEESCTGGAHQGKHLKKEVGSWPECCKDIKNLDEDLETCSRCVHRVHGDLGESAFNSIEYVTV

SEQ ID NO: 922183 - protein, 138 aa, Homo sapiens
MGHSCIRFVLIPPPTPGSTGFLLPSPTACLRVPWYWIRGAGSLRHEKPLPSGRVCPGKAGAPGKAQSGDVREKRQFPWEQGGQEPKEASACPELGTEERVVDAGLGTLDLELAMHRPSTGYPAMCMDHCYNHGSCRGR

SEQ ID NO: 922184 - protein, 152 aa, Homo sapiens
MWVGSGLGVSARWRLGQAPKLWAADAASTSSGLDLEASSSLFLLPELTQEMKPGENGPELRPQPPTYNDIQGCPFGQTQQKPEGKETHRCSPAGTPKLAGLPATSPKHSLLESMQQMKVCAGAGQHEKGPNVTNFIENTMASDFRGGKESFP

SEQ ID NO: 922185 - protein, 247 aa, Homo sapiens
MRAGQKQRFQASSELWAVSCRLVCHGPCRAGCCVVDRVLQAAVPWAASCRMLCRGPYRAGWCAVGCVMQAAVLWAVLSSTSFGGSLVRVSGGTVFFMLPMLQWVGGKFHGDRCYFDGVCSLSSCCPITGPAWLFGGRADAICLCSLDFFSMLLLSSSRQAGTEPPCWMAAVRLQEPALQHTDVHKGLRRHVLQGQPQLGPPRGVTRTVFRTMRFVHITLLHSLCPLLDQHLILSGPAPAESNLSPQL

SEQ ID NO: 922186 - protein, 158 aa, Homo sapiens
MPEKGEKIFKEVLSQSALGAGPQTLPQGPARPTGAPDVPPAQRPCPHRESQVGGAQCSPGLEGPQTRAQPRCRVLAGKARCGEHSVPLGTAIINPAWRRRPEALEVKLLVGVSVSQLRSVPRPPILSAEGHSVPRVTQCRGSLCLCDAADMPTWYLGM

SEQ ID NO: 922187 - protein, 142 aa, Homo sapiens [sequence omitted]

SEQ ID NO: 922188 - protein, 141 aa, Homo sapiens
MPLFSGTPLGLFLFLHLLALSETFGGLSLHSVLSLTLSAPSCAFIMELPTLVHGPPSVTIGKSHGLLKASFQIPPKASHLQAPFHFHPESKFQLHLPLLTLDFYPWNLRKDSPSQVDVSSILGCSDVHPLPTDPPGCAWGH

SEQ ID NO: 922189 - protein, 134 aa, Homo sapiens
METLHVASSYDLGFLPAWQLQGSWVFTGGPELQDRQILTLNGKLSTLWGARNCTNQICDCGEYDWEKGVFWESILYHHNGPPHSRKDHTPHRLLLARGQQGYEDRPMPRKSQTPQMAQGLPICLDKLSWNWSPL

SEQ ID NO: 922190 - protein, 119 aa, Homo sapiens
MTEISPFEVPPLPRPFTPGLKINDTCSEVTPGEASLLLPGSCAVSQAPRRLHLGEFGVSEDHTVSAGTGPCLAQEPGHTRRRLVAIIPGGKLLVSQLVPADGSEHSVWVATPRLCSMHM

SEQ ID NO: 922191 - protein, 157 aa, Homo sapiens
MLLQGQNGLKFGLCLFHSQLWLLLGESQPSTRNFCILVKPKSGKRQRKGQSHGESRPGQEEEEASDFLSCCDHVYKDIHSLLPEEAASQVTEQSERAALSPTSRQFGGAHSKIPDTRHKKRAQEGPYSRMSLETWTASAVPAQGRQPSHFKAPGDEM

SEQ ID NO: 922192 - protein, 140 aa, Homo sapiens
MSVTPTAGARDLAGTWCCSGLCLGLACGYLRLILHSLRGFAPGRRPHVSSLWINKAENHLCTLAGKPAPTSGPLLGLLALVFSGAPLPPRPGTPGDCSPLWPSLALPGPAWCSLMLPGPPWHSLVLPGHPWPSLVLPGPP

SEQ ID NO: 922193 - protein, 162 aa, Homo sapiens
MVPLPTMLWFLFTVFSPARVLEVSIFQGFAPFPHKCQTWALPPLPQLCPSFQEPMLLMHEQVQGSGGESEPWAKGLPIIINAVVFAVFVQGKTTLWKNITGKGGRDHNRSQDVLPDCVLRNAHIPGSTLLICSPAQEALAYSRGRLYSMKVMAWVQILTATL

SEQ ID NO: 922194 - protein, 211 aa, Homo sapiens
MNRGNGVLSLCLGYTLPGAIQGKSEISFSPDRSSWAREMGELKNVSGITGDVTFVLDLEHGWDLVGIDGDEARLQGVEESWGWSWGRCMRLSGRKLVRKEDSLGSPPEGPIQDASSDERGNFDPALTQPSTGKEKPRRHLEPVKPEPAMGGTESAECRLLWKWKEIVAWGLLNPPEGSILRTIMPSGSALAPEAQRNPGCAVFISEVLEHY

SEQ ID NO: 922195 - protein, 163 aa, Homo sapiens
MGNMTASGPWRLSAFMDPFLLLATYQLPLSIPGSSLHILLCSPSFFSFTNALYKEGHRLLCRTCLRTAWARADEQYISTPCTDLFPLGRRGRAAESVCMADDRDTQIVAVGDSPAQVCLPFCLLSSKMMTSAQESLEKMSVHLTTVTLLTGFCTSSRLDSLFI

SEQ ID NO: 922196 - protein, 199 aa, Homo sapiens
MILPLIVFTCRRVLDFSVVLLLDFRRGRRMSYLGVESPQVNGLASYRTWASARNSPLCSFLTFKAEKRIKHTDLESPSAVYEHNHVSLRAARLVKYEIRAEALVDGKWQEFRTNQIKQKFGLTTVERARPESAFTSPAPQNPESSPDFLPSPSTREATAVATDCSQEHGRLPLNAALPATQNNMPANRPWQFGLRQNKR

SEQ ID NO: 922197 - protein, 155 aa, Homo sapiens
MLKCDPQCWTWSLMGGAAELPVTALLETKAHPRHPAATVLAAGFEQEDQGRGSQATPKTLRQQPLYCSQTIGKAVAPLPLKPAKLSGKLRFPPSAGCNEAEKYNKQNLKLCEWIQEQNGKDREKNHDLVVPATLEAEVGESTEPEKSRLQLAMIM

SEQ ID NO: 922198 - protein, 136 aa, Homo sapiens
MAITQEPNLHLREGPGSHGKDIGVSKGAQESRRGEERSEVPQKGSVSRELTEHTCLFPSWFHFPFMTYSASLRRVCLRENWMIREEVVIELKLVMNSWKVDRGAKAQDRHQRKERGRTIKWSDDSQLNYLLPRAVV

SEQ ID NO: 922199 - protein, 280 aa, Homo sapiens
MQQSIQEVTWVMLKAFSFKRETEHKRLENLQTDNAIEKKNSFSEEKFKPAAEICISKKELNVKHQENGENISRQHFHREAIFNRSEGFHGYPGSRQNKTSSWLCNCSLRQGLPSSPPDALQDKAMTEGDMGVTLEASTEADLKVGNSCLEPVPSRRSKLRKPKPVPLRKKAIEGEFSDAGTAVEGTPLPKASYHFSPEEVDENTSPSLLGSAGFQKSPPDLKETPSTTKALPRKLGKKPGSKLTHKIQKDGISIEKETCQKVEEDVSTMLPEAMVFSFCL

SEQ ID NO: 922200 - protein, 156 aa, Homo sapiens
MAVYSSGTKLPGERSGSSICSSPISAIPQPPLLIPRQTGSGVDLQQTPTDLQLRVLTVRRKTNTQKGYPHQKPICKSTSSKTKAMEQSWMENDFRISNYSKLKEKVRTNGKEVKNFEKILHEWITRITNAEKSLKDLMELKTMAQELRDECTSLSN

SEQ ID NO: 922201 - protein, 186 aa, Homo sapiens
MGYCQATTNVHFKTKRPSVSLWSMLPGLGLTLQGSGLPSGPGQVQKCHPRAKAFGIRDPRSLLGALPTELSWYTRCKTKPIAYYLDITAGSSGPKGSLLRGDESCQDFVLPFKAVGSLLAQEREKERESKRAQVGQKCYLVTPGKRFLEGDCVTPKTKWVLPAQGFLAAWIFEANTHSSKGCKQCR

SEQ ID NO: 922202 - protein, 166 aa, Homo sapiens
MGKKGTPISLIFCHLTKQAGVAILISDKTNFKAAAVKKDKKRHYIMINRLVQKENITILNIYAPNTGAPKFITQFLLDLRNEIDSNTIIVGDFNTPQTALDRSSKHKVNKEAIDLNYTLEQMDLADIYRRFYPATAEYRFSASACGIFFKIDHMIATKQVSANLRK

SEQ ID NO: 922203 - protein, 166 aa, Homo sapiens
MDTQNNLNESQMHCACESIGLQSIYWMILLAWNCLKHKTAVGENRMQGRSVGDGAGTGGGCQQHTRFSCLGDFFLDHRTAVTEIRLPWLPSVTVFGMETLDLGHCPPSGHGPPAATVWTRDALTEWHSDETDGFYYSDVCLLYVDFAEGFNHKVVLDFVKCFFCVY

SEQ ID NO: 922204 - protein, 187 aa, Homo sapiens
MGDHSFCKQSLKLNEGQLHTQGAFTPVSQGHCSAHAPPPHLLPILLWQSLPSSPLQPRPKSSSRLPVLQLQRHPGEGQLLAHPKAEFGSYVASGICIGLRDPSSSTRGTAPSCSVWLTNSIADTQAWAGRGTPKSNEGLALQPVWQHYLGILLAQHRPESGPSHRHPQELTGPCYCHQASPSKHPSS

SEQ ID NO: 922205 - protein, 156 aa, Homo sapiens
MPWIAHPSRPCPSRIMPPIPPNTCPTAASSAARDSAPNQSLPWAVQPRIGPETAPCCGKRCLAWRLEPAALRLASPRYSWWWRQRLQCRGSGRRATHSGSCSCPARRRERGAICGTLEAGACDIAPRLAAVGGGEGDCCAAGVVGEKKIVLGYMEG

SEQ ID NO: 922206 - protein, 134 aa, Homo sapiens
MLAQTEVGPESGSLRKGEKLKYVSTLSGTPTLSGLVCGLAIIPSAPSGQSVVIIQKFDKSPDEITLGLLGDLLPLGTSLGDQDNSTSRITGKAYRARNTISPHTKAVFSLSFYTNRPPWKLTKTGNNNNNYSEN

SEQ ID NO: 922207 - protein, 154 aa, Homo sapiens
MKDRGALSALGIKWIKGAVRLILQFSPYLSVPGHVLWGSNDVQRVLTSTRSSCSIFGEAGGTSALEKIRKDCSPPHHPKQPHSQEFYKLKNTFFYLSICPEIYDQTLSSKVICKGTTPGCGSCALPDTAERQYQDNVVCPLCSQSGRSSNPTGR

SEQ ID NO: 922208 - protein, 941 aa, Homo sapiens
MEWNQMEWIGIKWTRMGRNGMHTNGMKWNGVEWNGMECNGLEWNGMDSNGMEWNGIIEWNGFERNGVEWNGLNWNGVKWTRMEWNGIEWTQMEWNGMEWNAMESNGKECNGKKRTRMERNGMEWTQMEWNGMECNGLERNAIELNGMDTNGMDRNGIEWNGMERIRMEWKGMEWNGPNLNGMEWNGMEWNGMEGNGIESIPMVCNGMEWIRMEWNGMDSNAMERTRMEGNGIMDMNGMKWNGMNCGMEGMECLEWNGLEWNRMEWNGLDSNEMEWNGNEWNGIESNGMDWIGLEWNRVKWTRLECNGMHSSGMEWNAIDSKGMEWNGFECNGMDWNSLEWNKIKWSRMNELEWNGMEWCGMDSNGMEFNGLDSNEIQWNGLECNGMEFNGMDSNGMERNDLNGIEWNGLEWNGMQWIQMESNGIQCTQIEQNVTEWNGLEWNGKTRKEWNGKEWNGMESNGMEWNGIEWNGMDSNGMERNRLEWNGMERNGLEWNAMEWYVLECDGMEWNGVHSNGMEWNDEMEWIRTQWNAKEWTPMEWNGMEWNGMEWNGPERIGMAWNGPEWNRMKCNGIDWNGMEWIGMEWTGMEWNGMESNGLEWNGLEWNGMVWNAMDVNGKEWNEMECIQMEWNGMQPNGMELKVLNSNGMDWTRMEWNGIDWTRMEWNGKERNGLEWNAVERNGLDRNGMERNGMEWNRMEWNGMKWTRMDGMEWTEHEWNSMEWTPMEWNAVEWTRMDWKGMEKNGMEQNVLEWKGMEWTQMEWNGLKFNGMEFNGMDSNGMEDSNGMEWNGTEWTRMQWNAVEWFRQEWNGMEWNGVDSSERESNGMELEWNGMEWTRINGHECNGKEWNGLEVNGMEWTQMEWNGTVWTRKEWHGMDSNGMEWNGIYRMERSRMDWYVMDSNGKPLNGMAWNGMDSNVIGWNGMHSNGMEYKEIGSNGME

SEQ ID NO: 922209 - protein, 332 aa, Homo sapiens
MERSQTIKWNVLERNGMQLNVILWNGMEWTRMDWNGMERTRMDWNGIEWTRKEWNGIRWNGLKWNGMEWNAVKCNGMDSKAVEWKGMDSNGMERNGMKWNGMECIRMEWNGMEWNGTDSNGMQWNGLEWNGMEFTRMELRIEWIGMDSNGMEWNVLIWNGMDSNGKEWNGLESNRMEWNGLEWNEMECRRMEWSGLEWTQKNRMERNGKERNAIDSTGKEWNGLEWNGMPSNGMNGMESTRLEWNTEWNGMDSSGMDWNGMDSNGMEWNGMEWNGPKRNGMELNGLEWKGKEWNGMEWIQKEWNGIEWTRMERKGVEYNGLKWNGMELMDSN

SEQ ID NO: 922210 - protein, 484 aa, Homo sapiens
MEWTRIQWHGTDWIGREWNVMDLNVMEWNGFEWNGMEWNGMDSNNGMDSNGMEWCGMEWTRMELSRMDSNGMEWSGLEWNTVEFNGMDSNGMEWRGLEWNKTDWTRMEWNGMEMTRMEWNGMNSKRKMELNGLDPNGMEWNVFEVNGMEWTGLEWNGKEWIRMEWNGMDSSNGMESKGITWNGMPWNGMDTNRMEWSRTEWNRMEWTRMEWTRMERNSMEWTRMEWNGVEWTLMEWNGIEEIRMAWNRMYSNEMGWNGMDSNGMEWNGLKWYQKEQNGLEWNEMESTRIMEWNRKERSGMEWTRMKWTRMQWNGLEWSGKEWTQMEWNGMDWTGMEWTGMEWNGMDWNGMEWIGMEWNEMEWNVSEWNRMDGMEWTQMYWNGMDMNGIEWNGIKRNGVEWNGLEWNGMEGTQIEWNGIERNVMKRTQLEWNGMECKVLEGNGMEWNAVDLNGKNGKDRKGLDGNGMEWTRMELNGLEWNGMEFN

SEQ ID NO: 922211 - protein, 148 aa, Homo sapiens
MPVGLFTSHLTNLYVLPWPGPCAHPGLGVSGVFPHLPSPGSREPGVMQLFSRCGSRLTARFSHASCQHKPTLVWRILPTIQGQPLPCGEPVCTQTYPRKEKVAEKWFPALLKALLRVSGSQQRDFSRSSKRLTGGFILFFHNYQGKGK

SEQ ID NO: 922212 - protein, 139 aa, Homo sapiens
MQSEDGFHYIERVLLHLKLETREKKPPLTDDKCLVKWTLVQAACKSTFCYETWEKQFGNKMQGTSSDSLVHLLVSMGPCVETYRSSRMQNFQPGEHHMGLCSPKDTANQDSWKGLQTPAPLQSLLQHSDTPYLPLFSEP

SEQ ID NO: 922213 - protein, 149 aa, Homo sapiens
MFGFPFLKNVSSASSISLLFTTDGEGISTGWRKVNGLNMVFALTCCLSLELPAVGMLLTATSWDNYSLCLLHTSVYCQSPCGDVLAVVYVGLNLRREISARDKFGDEEAKKITRDRADGENYTLKNTGKNIVDPVIGNTQNSLLRYVAV

SEQ ID NO: 922214 - protein, 123 aa, Homo sapiens
MRNGRPLREEQESFWERTWSVQDQGGSMQSRIREVFVNMERFSHYNRIGPRDQVLVGWLCRLGISDGPQPAEAEMLKMPWAYCGGGNLKTQRDGPAAMDLLYKTRTTTSRHWEAPEDTLLTRG

SEQ ID NO: 922215 - protein, 166 aa, Homo sapiens
MTHSVSPSVTLASSKVILAVLGNTCPCGSELTKVSLPSSPPLPAPWGFLHSSEQKSPFLFRIGTSRPNSPFYVTHQVFCPLGDHRIYHSNQILLSVKGGAINNYTNIVGVNHDCPKWDLMAIPLFADSDPESEVQGKFLEEWSCWIEFPKSFNSEFPGPPEPPTIH

SEQ ID NO: 922216 - protein, 123 aa, Homo sapiens
MRKLIAGLIFLKICTCTVSTSTDLPQTEGYSRCIHQVTENSGPQPSDQEPVPVHGLLGTGPYSMRSLAALDSHRSTNPIVNCTCKGSRFPAPYENLMPDDLSLSPNTPTWGRLVAGKQAQGSH

SEQ ID NO: 922217 - protein, 163 aa, Homo sapiens
MGGATPMIQLSFTRPLPQHVGIMEATIQDETWQWFVVLLEEVLHVPLSPAEAAEQQKLLAAPSSGSFIPGGTGLMSARALLYEVSVNPSWEVSPNQEAWGVGRQECLSLLKLRLQPPLPPGALSQGDGCFIYKPLTEAAAFLSEMPCPERRNLERQSRFAALC

SEQ ID NO: 922218 - protein, 140 aa, Homo sapiens
MENKRRAWDGKIKREGKKKANGRDDIGTLQASHSRVLSLTVSNSWESSVHQAAAPPEEIGKVIELGLLEKQFFTWTRAREEEPVAIIKGPHAHSLSLGAHLEWHCPLTWSSGYIEHPQTEKTKGSQKNRKMMNGQKRKSK

SEQ ID NO: 922219 - protein, 141 aa, Homo sapiens
MPYEKLAAHIFTCFLILNSHFFKTPWSLLSENGVRNHNLGAGCVCCYWVVIPSRLTQQTAKKYVCILTHATYLTSMFSLIPNGYASGENSTTELSMPPYGCVTKRMTEVTPVMSNKEGETMMEWIKKPKNPGTRYGNISWK

SEQ ID NO: 922220 - protein, 166 aa, Homo sapiens
MNPLLQSRRAATSMQGVFCSRDPPPALPRKSARDLASLGLLRFSELAPVGPHLSDNEVPDRSGGACCDPWERSSPVLGSAGGGARCHGREGALWKLQCLKGSHKAPHFFILAEALDGGQTPARPWTDCEAQRSHLPPPHRQNNDGRHHQVLRLSWPLGTVPAALQT

SEQ ID NO: 922221 - protein, 219 aa, Homo sapiens
MRQQESRSRKKASRKTPTLAGRHVPPKIEKEAVRKSTLSYKSESGLRKKGMATSNKIGQKADYLSTSKTISAETASFHVGGKMQGTRPRTGHSPHICTESFHRHPSPFHPGGSQSSGHSRAVLAVTHEKFSPGTLSQGYAPMNDGTELELKYGSGSMMGCEHSQQKEFNFYKAGGERGQHQHLEAVGSGGCCLSAANAQTKWATGTQKAGEPMGFRDTK

SEQ ID NO: 922222 - protein, 179 aa, Homo sapiens
MNTPDFFSGSPDGRLLLGMVVLLLLSNNFLLPAQKSCKSSSKEPVAVICVLLQGPAQRNRYSELPTYNTLGGVGQLGEGVKKPPWVQTESILTKGIHVKIIPQGTNHPETVALMLTQCLYFIKNDFKGLRLALHGPTPMHTAFHLTEHVLEQTSIPHLLVSEEGASWGIIPGSFFASII

SEQ ID NO: 922223 - protein, 142 aa, Homo sapiens
MGKLWQVDKTKSSLKNPNPLDPHKSPLDYRCSSSHFTNEETDRDFNELTQDWMIAPGFDSAWWERVKGSLEAGLGKEPAVLHGEGETRSGHSAHHRRLACCLSNRTIQLSALTVTRQRLPSRWSPHLCILSVKKTSQKLLCQ

SEQ ID NO: 922224 - protein, 128 aa, Homo sapiens
MRENKKHLSFCDRGSQKQGARVRREWRKIICLKEEDGEAARMNIKGGGGREYRSRISKLPLAQRSGLPLKQYNYKVGGCVAFSILAITFFFMLFSMSFLLSLGKMEMIPRAILETVFEVGRVSGPLNC

SEQ ID NO: 922225 - protein, 236 aa, Homo sapiens
MAGVDRTRERARAAYLQLFVPPGGLMVSLASGVKLQIFLVSVTAHKSSVDPKNSGAQLASPSGSRTGAAGGAACQSSTMRSHSSALGWSMGLGAVEQGVALVGEARAAQEPTEAGEGSGMAGCSPEACPAGRQLRPGEKSTAAPVGRHCWGTQYTLRNRWPGCQVPHCPGPLGPAGCSECGARQAHAHPELQLARKRGAQPRFLLAPLPPHLSCKLREPALALASPERGSHSAALG

SEQ ID NO: 922226 - protein, 141 aa, Homo sapiens
MSLSSRTVGMGILEYLAGEENGTDEFKPGIPRAGQSALKGRQLSKGTQAKQVIADETRRLFSKEPAGSEVCGCFSGTPQIFPSHPVWCQAVPVVKVQETILMRNDSPVPHEKLRPVPQVKTLRSLPLLNFPGKGPWSHSPL

SEQ ID NO: 922227 - protein, 149 aa, Homo sapiens
MKIGVPPTMLPKKAIASPWTYLLLTCDLKLYYFYLCTWLLSSFFHLSISLILKTFPKEVKPEPAITLRTLAGEAKGQWAQKALECDLQPGSLLWDEHQVANGKAPVGIRSPEDSVTGLLSPYAPVAPSLWSVLSSSINLCFCCFILSLL

SEQ ID NO: 922228 - protein, 145 aa, Homo sapiens
MSSLRTITKPSDVCWIHWMQEDSGKINHPGQRKIKKEMFEVQSRKNGVLIAWSTGAIFVVEIAESSGPRATLKRNLVILEDNAHVSQALSANVSTDRAFTKDEVVALDLLSIDVSSESHVAAQNPQQRSELKDTRLTPAKGADAP

SEQ ID NO: 922229 - protein, 304 aa, Homo sapiens
MVSVWVSLLKLWRRSVHCRQKVQEKAQEQGVGGSGNDTDGDSGGVDGDGGGADGNDRGTIGDGGGADGDGAGTDGGEGGAVGDGGGADGDGGEVDGGGGGTEGDGGGTDGDGGDVDGGGGGADGDGGGSDGDGGGTHGDGEGADGDGGDADGGGGGADGDGRGADGDGGGPDMDSGGTDRDGGGGDGDGGDTNHKSQVVLPVLMTNHYKSGIPQPPPLVPVICEIDSQNSGKYLHLLTFIIKRITKDTDEEMHRVRYEDMTAEQAHQNLSVCVLQELELVFWGLEELKIKSNAQVIDYVTCIEH

SEQ ID NO: 922230 - protein, 182 aa, Homo sapiens
MRGHRFHGNLKKYHYTCDTVPEGGCYLACPSSTPNDIFPCWDLLVPGVKECLLQHLQMWDELSRVSADRPKVMIPHQQQESGGSLQKQECIDPRKGSLAWQTPRGEGTHPPESPEATSTEEKTLVLPLSQNPGSGTCSCLDMNECQGLSKTVGIGPHVNFLICTGHKSPEIPANHSDTWAPS

SEQ ID NO: 922231 - protein, 147 aa, Homo sapiens
MVNCPFPELWFPHAGRSSLMSIPSRCLRLTFTVLFHLRKQHHCPWEDLHSPEHREVCSEADSFQYFLGPCPRRSYWGESNTAWWAWKENSLVSSQSRRHLAHEIRKLRHTSNQRQHYWLRNLVDFRSYLHHFPMSKISRNTFRKLKK

SEQ ID NO: 922232 - protein, 127 aa, Homo sapiens
MWICWRMRLAPGSVSITSGQGGSRCSHESTLDKCHMGRQLGHGLGTEVEHRSVGNFHQVCLHEMGSHGVFTRLLYLLSHVGKKQRSAPRDKSKDCPRSYNKLLFTTLCTDSHHMVNHGYRCGNYTNN

SEQ ID NO: 922233 - protein, 171 aa, Homo sapiens
MQDAPLSCLSPTKWSSVSSADSTEKSASGAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALITDDLTDAIICARKIVKETQGMNY

SEQ ID NO: 922234 - protein, 137 aa, Homo sapiens
MKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSEQKINRFNFSLPHPGVLSLLKGDTSQDPQLMPETADNT

SEQ ID NO: 922235 - protein, 121 aa, Homo sapiens
MNLGFILHECFLKASKLITNVYYKPGLCQVINMLLIRLLVLTMAVHGKYCYSHFTGSETERFSVLSVLTPPVTEELGLALAVSQGRPVYSPLCLHSYWLCSITRDRRPGAKGKMTSMKNMC

SEQ ID NO: 922236 - protein, 191 aa, Homo sapiens
MGLLSYERLLPAARHGRVAGGAGPGRQGGRLGPALRHMAPGRDHPLCPAAPGPGPAPAQARCPAAPHSRGDCRGSQDLSQATERTGSSVSCTEEKKQSKSQQLKKIFQEYDTVGVSLYTGISFISLVIFYMVVSSGVDMSAVLLKLGFKESLVQSKMAAGTSTFVVAYAIHKLFAPVRISITLVSVPLIVR

SEQ ID NO: 922237 - protein, 155 aa, Homo sapiens
MIPERQKTNEVSPIIILIFFMETFSKPQNMKDLVQQERPELELDPLGICCGMEAGEPISKNQRGTLFPNTFQHRWDSYLMAAGAETGPPWNLLFTARTDVSRQVSLSTKILVCTIPPGPLEDGFGCRLKAKQGCSQSPCGTGPFLCLNLGAHSMD

SEQ ID NO: 922238 - protein, 127 aa, Homo sapiens
MRLLYYLKTEDPEYDVQSKQWLTHLLDQFTNIKNILALKKIEEGLDLRNLASDDSYITPYFNVEENYFSDYGPRVMVIVTKKVDYWDKDVRQKLENCTKIFEKNVYVDKNLTEFWLDAYVQYLKGWS

SEQ ID NO: 922239 - protein, 176 aa, Homo sapiens
MIMPLCSSLCDRKTLFQKRKRERERERRKRKKERERKGRKEGKREKERKKERKKERKKERKKRKEKKRKRKREGGKEGRRGKRERKREREKEREREKRKRRREGRKERKERKRERDKERKERERKKEREGRKEGRGREGRKGKGREGGEEEEQEEKERRREEGRKEERKEGRKEGP

SEQ ID NO: 922240 - protein, 144 aa, Homo sapiens
MFYQVEMGQGGGRKDNRKDFFTYKSVVCGRVAPRCNQKMLKMQTLQRLQFISSMKNNSKSQSTSLALLNSGRQIGLKRLQFSQVSLPLNFPHGKLHGRELSGKAADASKLQSFQFSWLHANLEHSPLFLSPHTTFHPILAFKRH

SEQ ID NO: 922241 - protein, 151 aa, Homo sapiens
MEEQVRGTWGETVQGGSKGGERNGATSESEEDNELDCDPLRESQGPQHSERMGSHSRAPGCAFTHCIPEATSSKWNYKTSVILFGLCHLAQYLQGSSMRRSLPTQQLTTFDLLSLGKLGRMRWQGVNYMEKDDSGSIFILAYHTLKEKKFS

SEQ ID NO: 922242 - protein, 183 aa, Homo sapiens
MLGSKVSSIRESVRREKPRLLHDCKAGGSGSRARLRRTRRARGSPAAAPLLGVNSSPRGRAGADASSPPARERGYRARRMFAGWDRQSGNMRRPRYSCSRAARAGLARWSPRGEHAAGMGVRLVSRRESQPPCSRPSAPQPQPSPAAELPAAQPRGSAAAPRVPTNRHHEHHRLQQAQRCGAV

SEQ ID NO: 922243 - protein, 136 aa, Homo sapiens
MDDGHSYSHKFDFYICDDDLALLPKLEFSGKVVLFDQACNPSLEQRSGKEFVDIFQNHHNCHQRTVNKECGGLGLPFWLYLEARGSGQQKSAQEVPDYLRHFTGFLHRHPIKYQPCGLDDMDPTMFQSTHDPSKSA

SEQ ID NO: 922244 - protein, 251 aa, Homo sapiens
MNKVAVVPGMEVPGMGSEKEDAWTQQHGLPLTKVELATVAEYPVCLWQRLTLKSPIWQHSQGDQSDGWKVDYNGPFSLWKGQHFVINGIDTCSGCKFAIPVCSASAKLLPMSSQNVYHRDILHRIDSEQGTHFRVKEVQQWALGRGFYWSYYISHHPEAAGLVEQCNGILKTPSQFQMGRNTLQGWGKELRMGAKLTQDKFVMGYFMCQFSSRCNCPIIILKTAITLSPVPWAFCLWGWSSLEHILAGQHV

SEQ ID NO: 922245 - protein, 134 aa, Homo sapiens
MAESKGEARHLLHKVAGRRMNGGGTTEHLIPVNLQAHHLEYLRVNSTLFVWLHIKSSLSLNESLTYNLAGLAACPTMATRSLLPHTTLHKALPFFPLLATVIHQPASSPSHSLIEGLDDWLTVALHLISCCHVM

SEQ ID NO: 922246 - protein, 148 aa, Homo sapiens
MGTTLNSCMCTKASPNHGRHKGSAGPACGSHVYQRTDSKDTRHDIQEQRRPEHAVPQCQPQAGPAQGVVGEAVLQLCDPQGGGGSSTGLHRFGGCPVEFGSQERSGRPSGVGWAAIHLKEKQPGCGEAAVLGGILSKEPRNQRRASSI

SEQ ID NO: 922247 - protein, 139 aa, Homo sapiens
MRSYFSAVKNPDFWVYTHLAESASLGLCSNNLTFNQRKEEFTCHFLGVLLEQALDGQPSLGIALAEENLSQDLPPSRDSLQPVTDQLEDRLAGWKLRQHFQVTVLRQNSFSEKPVFAVKTSTDWMRPTYNTKCNLFQVN

SEQ ID NO: 922248 - protein, 146 aa, Homo sapiens
MSECAKISKDKILAQNSSILRGKETGPNDRFSKRPSAAERWVLTFSASSVALELLGKQKTLETETMKPTEFPEETGPPGTFLKPVITDQITSQENGGKNRRRMTILKAPRTAEKDMARALPLIFCVMHHGSPVAPTLHNQCDWTAT

SEQ ID NO: 922249 - protein, 134 aa, Homo sapiens
MNAWFTGISRSQDMAPCIPAAPSPAVAKSSQGTAQAIASESAGPKPWQLLRGVGPAGAQKARVEVWERPPRFQRIYGNAWMCRQNSIAGAEPSCRSSARAVGEEMGWSPHTESPWATALWSCEKRAALLQIPEW

SEQ ID NO: 922250 - protein, 164 aa, Homo sapiens
MPNDEAEIRTQVTGWPAQCPVPQGDQSPVVLTSNTMETRGGEQGRGRSIRLHSGRWAPNLWLTPSLQQHRECFALFICPEPLGSGCNEVQTHETHPSGASLLPLEEEGGKKEERKGGKTIRKFANFCRAAFKAVLGRLELVDCGLDKHSLGTQLLADVRMVEGP

SEQ ID NO: 922251 - protein, 138 aa, Homo sapiens
MPHPDLFVMQLCLKKSSSVEDAVGLLTAGCLLGFHSPCPSSSQTCDFAMPGSGHSGHLSGQGVYLQFVLEKVPIGTLGMCGKPKNARVCLRAQLSHCSHSGRLVEALSLCPVEDTKGLCEEGGHPAGTNHFIASFLRG

SEQ ID NO: 922252 - protein, 156 aa, Homo sapiens
MSCGPLFLIQREMLKTRPKLDCKDVEAQGPGKEWKLEPVMRPSGTGRGEGGGSLLDRGGHCPIAWRPCSPPQGQMPCEMMCTFPMISLAFPHSFMPVTGIFTQPGLSRKALSLLLEERSYSPECCRACLTDTDRDWVECAWEWIVREVVKTREEEG

SEQ ID NO: 922253 - protein, 155 aa, Homo sapiens
MAANHGIRTMSLVREIQLICTHLLSSTSLGHYCSKGPGQITPKRNTQPKVVFSPLLMKLAAERKASKRRGHKVRRVGAIGNAQSQPDSKQGAQVVSFWDTPLDYCSIKQLTALDCPFPSNSTDCVGKSHRARLHSQMEMEESLKAKYQNGSLVNS

SEQ ID NO: 922254 - protein, 284 aa, Homo sapiens
MSGSSLRPSPDIDASTMLSVQPEELIFSHHIGIEFLYQMVELKIQFPVQGFQAANWRRSTYEEHLLVQMATQVRPCYIHTLGTHPGHSWGSSGAHTCRMSECAKISKDKILAQNSSILRGKETGPNDRFSKRPSAAERWVLTFSASSVALELLGKQKTLETETMKPTEFPEETGPPGTFLKPVITDQITSQENGGKNRRRMTILKAPRTAEKDMARALPLIFCVMHHGSPVAPTLHNQCDWTATVNIVFFAVWRMVVYTQKTLETVSPEWLATPDEIILDPRFH

SEQ ID NO: 922255 - protein, 138 aa, Homo sapiens
MKVYSFPLISLLCHVTNSTDAGSEQLPAGALPHAFASHLCWSFQSLPWSFSKPWTALKHLSCNSSGSPETARNHSPGAVANLITHPWRVLSHDVLATVTAGPRMEFTVQIQQLVGNSGPVLLSANFNLALCYFSKPYF

SEQ ID NO: 922256 - protein, 144 aa, Homo sapiens
MCNIRKQGKKPWGVAGNNLRENLKAPKTETLQLAKGPDVLQDGDSWEQGQNGDIKQPRWPLGLCSCPWEMSHQESSTFFIPKVVSDQQEIGGLTRPRLLAKSIQVQHFFLLFHNAPVTGACHHPGVHGPRLANAGQGVTSIHVD

SEQ ID NO: 922257 - protein, 153 aa, Homo sapiens
MSPLACLLEQAAWWTVRLPASFTSHDLMHHRGSALNKSRNYAKESRSWNDGLNSPKSVGLTTASWDPSVGEGEWWRGGEVKEEQSRGNRRIQEKTLPMLAKKMLAKKIHSGDALKHPPLRYGGLEKGRCYGLSFRPAQFNLKLQDVCVKFLKK

SEQ ID NO: 922258 - protein, 146 aa, Homo sapiens
MHWIKETKRWFTLFSQGLLPMFGTHSPPFMEVHVHACAYIFSNTEQKPLQTSEGLCLFWEKCNTLRMNNTCLEPNVGLYIPPAYQQHHHDHHHHHHHLHHRHHHCPQFLKLFETCIHSFISDYKLSFEKDQSKTKCLWKTKVYSHY

SEQ ID NO: 922259 - protein, 145 aa, Homo sapiens
MTIPLDPHARGLHGEAEVVKEEENGGQPLDFLGFTGPKPNPEQDPTLFNFVKVERDEEAAEEKFEPSRSWFMRFKKTSCLHKIQVQGKAASANVEAAANYPEALAKIIDGDGCTEQQIVHVDETAFYWKKMPGDVFGVPTQECLH

SEQ ID NO: 922260 - protein, 394 aa, Homo sapiens
MGFKMEKDLTTLQKIYAMNLSPILSQGDLPRRFTGVIEQWGKGNDQTFQKLLEIGSELMLIPGDPKHHCGPAVKVGSYGGQIINGVLAQVQLTVGPVGPLTHPMVIAPVPECIIVINILSGWQKPHVGSLTGRKIGEEEIWRRGMWMNHPEWSKTVKIFVSHVSAHQRVTLAEEVFNNQGNGMIHSVDITQPLSPATPVIPQWDHEQSGHGGRDEGYAWAQQHGLPPTKAELATATAECPIFQQQRPTLSPGYSTVPQGDQPATLWQLDYIGPLPSWKEQRFVLTGRDTYSRYGFAYPAHNASAKISIHGLTECLTPHHCIPHSIASDQGTYFVAKEVWQWAHAQGIHWSYHVPCHPEAVGLIERWNGLLKSHLQHQPGDNTLQDWDKVLQKAM

SEQ ID NO: 922261 - protein, 135 aa, Homo sapiens
MPTAVEAQRYLRAALGHAHQSSKVYLTHDSMMALPSSAPSYSSKDRSHTNSTTLNRHPPQVLCTVYFVAFSASSILSTCFISPGNPVCDSPLINQLPLLDLHLPSRPPTAVASLNPIINPLFHSTHYEFPSLIEP

SEQ ID NO: 922262 - protein, 141 aa, Homo sapiens
MVELIYSPTNSVCWSFLEAHSRPCLPEYHQRSLQDSKDCCLFLSLEALSQRGTCQMAAGALLYEVSVDPCWEVSASQEARGALSQGDGRFIYKPLSVAAVFLSEMPFPERRNLERHSGYSGFGELLWAPPSLKFLVALFTL

SEQ ID NO: 922263 - protein, 194 aa, Homo sapiens
MPISVCYTVDQVRASVPGKEDNRKINCFALTYAVLTKGRRPFSPQNFQNIRLLSKIEVNVTLFPQKKETRGVSEPQMFYFRVQSKQKIQPRGDGFEFCLGFQSLACVMVLGCSGKHVLKWLSNLLRVLRRNGLCLVSGSVHTGIALLVSSFQAPCSVALSQLPFTAGTVPPQPWEIQPFITTILLLVHRDALLH

SEQ ID NO: 922264 - protein, 139 aa, Homo sapiens
MQVCMSFQHNVKGVDGVISAGPPLPEMVKFKKSHDIKQKWEGKITFRGALDEDIFSVYEYRRRGVAQGFSGCVDSSHHLHLDELPFTFSFRIFLERTQPLYHSLDPICNSLIAAVLTRVRVMFRKTSRDIVCHSPLRTF

SEQ ID NO: 922265 - protein, 148 aa, Homo sapiens
MEPYFSISHPEEVASYMGYTHKNQGKEKLNSQSELQQVIEVVKSACGPFPNPLEEGISFDIYSTFIEPPTILDTEMKRLDQEQGPEESQPETDTSDMDPLVGFTIEDVKSVLDQVTDDILIGIQTEINEKLQIQEEAFNARIEKLKKA

SEQ ID NO: 922266 - protein, 144 aa, Homo sapiens
MRGNFTRPLDSSLCFYFKLPICKPNGCAGTISEIRRAIVIVCECACVSVSVCVCAVCYRGSRVLLSRVTLEEERQILHVESVTHLEEGLTCDPGFFLSMLSSNGMTKPGKINESEDYTGVCAICALPYFTELGRWYEEIDTKKP

SEQ ID NO: 922267 - protein, 253 aa, Homo sapiens
MESQGYTSQGASEVGSMAQSLRTRETDGCTYYRKYVIDFSKSEIIGIPISKNIEDIPLTNALQNRFVRAAPASLKNRVIALLCILDLTVGTTVTQLQNLNTVGIIGSRGGRGQVAALNCDRQGHLWLFTRVTVHWRMGNDRTFWGLLDTVSELMFIPGNPKHHCGPPVKVGAYGDQCYHQGLERCRGGDSYHICVQLSHLACTEDSNHVVTPIAAAVPEVVSLLEQINASPGTWCAAIYLENAFFSIPVHKAY

SEQ ID NO: 922268 - protein, 146 aa, Homo sapiens
MCNFSALHENWWLRIPQGKQKLFSESAVLCGAEQRCFSGSKTLLCVAGLILTTYGLDSLYERLEEDKVLSSLPQQTSLLTPIPLCFYKFYFFKMPHQGCDILPAGASEVSPVVGGRTAALGQAVLHDDFVATSLALGQMPWASRTC

SEQ ID NO: 922269 - protein, 148 aa, Homo sapiens
MLSASQQCLLVDVTVTWHRPGEEPSVQETNVCTGSPQGRVLARGPEAPDKAQCTRHTADCWCLTRREGDEVRVAPPRFARPRGDSPAWVGVVFGGLSPVKLGLLLPEQQKHGLWEVGSGGGLCCIRRRGSSSQLTIVTAEGGVGFMVH

SEQ ID NO: 922270 - protein, 117 aa, Homo sapiens [sequence omitted]

SEQ ID NO: 922271 - protein, 143 aa, Homo sapiens
MSRVTGTPACFNAAPSTAAKIRNHLSAGQQGMKGMWPEHTQEQYSTTQRREPCHPQQHGAGGHYIKQTSQAQKEMVHVLTHEQELTADVMEAKSRWSAGPTHKQHGERLVRGTNTQPDRSTRSTIDKPAGECQWVTYCVFQNS

SEQ ID NO: 922272 - protein, 470 aa, Homo sapiens
MGHVESWLDLPLDLTLDMLLDLPLDLTLDLPPDLPLDLPLDLPLDLTLDLMLDLSLDLMLDLPLDLTLDLPLDLPLDLMLDLSLDLPLDLPLDLSLDLPLDLPLDLSLDLPLDLPLDLPLDLTLDLPLDLPLDLSLDLSLDLTLDLMLDLSLDLPLDLPLDLSLDLTLDLPLDLSLDLTLDLSLDLPLDLPLDLPLDLMLDLMLDLPLDLPLDLSLDLPLDLMLDLTLDLPLDLPLDLPLDLTLDLPLDLTLDLMLDLSLDLMLDLPLDLTLDLPLDLPLDLMLDLSLDLPLDLPLDLPLDLSLDLPLDLPLDLSLDLPLDLPLDLPLDLTLDLPLDLPLDLSLDLSLDLTLDLTLDLMLDLSLDLPLDLPLDLSLDLTLDLPLDLSLDLTLDLSLDLPLDLPLDLPLDLMLDLMLDLPLDLPLDLSLDLPLDLMLDLTLDLPLDLPLDLPLDLTLDLTLDLPLGLLLDC

SEQ ID NO: 922273 - protein, 253 aa, Homo sapiens
MILLLTSQKDPTASTVTGDHAGTGVNPDSTASTVTGDHAGTGVNSDPTASTVTGDHAGTGVNPDSTASTVTGDHAGTGVNPDSTASTVTGDHAGTGVNSDPTASTVTGDHAGTGVNPDSTASTVTGDHAGTGVNPDSTASTVTGDHAGTGVNPDPTASTVTGDHAGTGVNPDSTASTVTGDHAGTGVNPDSTASTVTGDHAGTGVNPDSTASTVTGDHTGTGVNSDATAPSWAAPATTRTRSAAELEADSGRN

SEQ ID NO: 922274 - protein, 137 aa, Homo sapiens
MIVCQRTRLSVTTEDPVEPLGWKASRSHHLQPERPVPRGNFPPSPGAQDAGSWGSARSWAPPPGLATASCCVIPAASPQLQPTLRGRFCFCWMRRRRPSPRPPWALNAPETRLPGLAPAGPKAVPPPPAQSLRYFQL

SEQ ID NO: 922275 - protein, 287 aa, Homo sapiens [sequence omitted]

SEQ ID NO: 922276 - protein, 160 aa, Homo sapiens
MARRRELPCAGFGCKLAHPGYLIVSALGRFPGLRLGPGAPLPAAPSVFAVSGQGLLCCLHHTDVKCQCPIQTLVQFCCARLLGAITCTAGVLLCRAAGALPAAGPRAPSFFHCLSLSRALCPLTGEGHLAQGHRYLWLWNGVLPSAPPALCISWRFHPAQ

SEQ ID NO: 922277 - protein, 260 aa, Homo sapiens
MLMWMSLPLISHPEQASPHRPRPRPLHPESQGCAGNTSLRTEAAHGPGIPKPFCVHPGKYLPPDRGGPWPWDSQALLCPSRETPPSGQRWPMALGFPSPSVSIQGNTSLRTEVAHGPGIPKPFCVHPGKYLPPDRGGPWPWDSQALLCPSREIPPSGQRWPMALGFPSPSVSIQGNTSLRTEVAHGPGIPKPFCVHPGKYLPPDRGGPWPWDSLALLCPSREIPPSGQRWPMALEFSSPSVSIQGNTSLWTEVAHDPGIL

SEQ ID NO: 922278 - protein, 182 aa, Homo sapiens
MGCLWGKRSSQSTKGTAEHSREEAVRGTVVLGQVAPAQGRGGEVTTVWPPDAATRCEGLTENEIQKMTRAEMFSCPYSTPPEMLVTTVHVAVTPTARQLPALILGLVINITFLFSIATTTDKIGMSTKLGHWKPGECVQVPATNPPCAIGCSKSVQLPGPVTPDEAQGGRLAVLRPTKAMLH

SEQ ID NO: 922279 - protein, 171 aa, Homo sapiens
MLHCNFPELVIKHVSGYDFCSVSGRTRTDAAAGHTCRSSGCSAVHLVLWAVLGRAPIVPVSLRKTLKISKSDTPKPALRLPVRTSDCFAHPPADGKQKTFLMPLCARRPEGGLYSAQGLWKPGPLSKELPPQITLWGLLQARAAARPRQRDHAFWGCSISEGTHASRDPLP

SEQ ID NO: 922280 - protein, 121 aa, Homo sapiens
MAKRLRERKRRLVYSNPLIQARHFREHRRRLVYSNPLIQAKHLRERKRRLVYSNPLIQAKHVREHRRRLVYSSPLIQAKHLRECKRRLVYSNPLIQAKHIREHRRRLHIKNVPFPSGFHGF

SEQ ID NO: 922281 - protein, 175 aa, Homo sapiens
MDNEVQAEVVTDEDEELVGKWSKEGKYGVGAPTQSPYWGTASGAMRRGLPSSRPQNCRFTYSLHCLPGKASDTKHQPIKAARSENIPCKATGAELPKAMGADLLLQRDLDVKHGKSRRTAEHKQRKSQRQPACFYYNPLSRKLTHDSQDVGRAYKYRGVFSPVEKNTMIDFSTQL

SEQ ID NO: 922282 - protein, 157 aa, Homo sapiens
MGWSSVPVALPGFGLSSGPAATTPSIIALVGTTGPPTPQLKQPISTVQKQWVQRLEGVLGFKNIWSTEIPQAGRLKECVSLAEPGVFNVLRMKEVHANLSMGDHKWAWKKHHQICQAVINEVLTLGPQEFRDAGVWTVTGQVQLCCGKSGTPNGGTD

SEQ ID NO: 922283 - protein, 127 aa, Homo sapiens
MLYIKLYQNHISEHLKTGMKSDSDELYYPLGFIILIHSCLSFCKCFLEYILLNRNISFISNKSLCDFSPWECAYSLGDAVTALVRLSLTVSFNDFSGTTDMLCHSEGDVGCGANATEYDIPKYATLA

SEQ ID NO: 922284 - protein, 136 aa, Homo sapiens
MRSQPSNSIWGHFTQAANIVSRKAISVENVDLTNQLFKVIIVCRKDYLLKEVSCLPHRKPITETMSIAREEGYNQVQHPRRTDHTQICLLNQLKLEIYIAKKKCTTCRKTAIREGVTLLSPSGTSQLMAELRGFLD

SEQ ID NO: 922285 - protein, 137 aa, Homo sapiens
MTPWVISSALPTSSVKAAPSTSELLQWRNTTDLDLPVQLPPRCQNYLPKKAKTVMPVSTIKMGHGKCYFYQYTEHSWEYQQRVNISGRFIFHVKNEGIKQSDSKSPQNPENLELYDFVFAMPPTLFNPNLCCTHSKL

SEQ ID NO: 922286 - protein, 150 aa, Homo sapiens
MSLVSKQIVTLHTESVTGGTHKQAMRKRMMQFGARIESESDAVSAGPQPPHGALALTAPARPFPGSLTEHVCMTLKIVQDYRSPGAMGSTAGPLGSNPVPQFSHLQDRTQWHLPRESVVRFNGDDEVLWEIKTCAWRLKWSTFETDISEG

SEQ ID NO: 922287 - protein, 135 aa, Homo sapiens
MIYRYKNKPGTKMKIKKKKEEQERQPTCKTCNSHTVLKSIYAGGSANLNRLSEDPSLCAFGRNAGSDSETWVLTSYGSTSFNTSKAAMLLCMKVVKKKIALGIVHDRVLCLKMASATSIKTKSRKAKFVFEDHAT

SEQ ID NO: 922288 - protein, 139 aa, Homo sapiens
MSWLGLDLPGVSLPEDYVTCSLRQPDATYKERLLQAFANTDKENRRKEKEAQKSMNEEPGTYAAKWPAQGHTDDSAELGLVSRLLLDSLSSAHFSRSGQHPRSGGEAQQTTSENHFLGGEAISLQFRTTSLYPSHLFGV

SEQ ID NO: 922289 - protein, 143 aa, Homo sapiens
MGRHGHSSNQAVFLAYGATPPEAGATGGHPRTGRIKSPPRKADLRGRGLEIPGDIIEYLDPANSELPLKFSVNELISSLLCLSQFKLDFCNIQAVFSPIRREGCMGCRKQRVTCGYFKEKQVMGPEPESHFPPGPNSDTGDYN

SEQ ID NO: 922290 - protein, 172 aa, Homo sapiens
MTMYVLSAVTLRKQVFIQQQSPWLLSGFDKCTWHYFSLDADHCPDGHDFCGPDVVWPEGQQGAFRPLERIPNYFYKTCEGLRGPGSHQLSLPHWRPLHSAPSSGAQNTCLDLADAIPRNSSQRSLPLSQCLHFPEPVSLMFPSDTKDRLGLVDEVRTAVLSEHHQDASQITV

SEQ ID NO: 922291 - protein, 136 aa, Homo sapiens
MIVVGDRGGEVLPCYCQFDAGPNLGLSQQHWAADLGQLGLGPQEVLTSEPGGSARGPLTQMFCPHIMWQHNPIRGDQGSCPHNCMQLTSNPWLSWQSKGIGLLASAASQPFAGGTHISLEHKNRRIFSPGNNCFLE

SEQ ID NO: 922292 - protein, 151 aa, Homo sapiens
MPTIPDKSFAHFMCQYLYSGLCILGCIFGFHTVYLQQLQAFSILCWLKQSQHFEGRNIDPTSQQRVHQGHIVRRPKHSAISKHMAPFWCLTYSTSGLKSPVPRNSLESAAEIVWLGALLAPETQEGALPLTEAPEEREVCVPAGRISRDSP

SEQ ID NO: 922293 - protein, 136 aa, Homo sapiens
MIREERCWSTDYGTTYEKLNDKVGLKTVLSYLYVNPTNKRKKEAEAHRGQLPHPANSTEMCNSPGQTRCTEENDCYIDLGLKFGCMQGPEDNGKEDVGQVETWKPLCKGPFAIRLQMTVVIVTGEHFVDSLAGDLH

SEQ ID NO: 922294 - protein, 138 aa, Homo sapiens
MLLSDPEMESSILISSDEGATYQKYRLTFYIQSLLFHPKQEDWVLAYSLDQKVNKYYFHLLLVIQSHHRQISDPASLPQDTFPECDASGMGEEIGFRPGKCCRWGLHRSPELRPESKEFKDDFPVEEEAQWAVIVAVL

SEQ ID NO: 922295 - protein, 151 aa, Homo sapiens
MRGAQFHIQVKLKGYLLFEVLLDLSSPYTFFLVRTSIALKKWKSRPLLAFSVNQDKKEGAYRLSLKHVGQAVATGSGNEDAHYLTCRIQECAETTRSGPFARSIDISSLVVQDEYIFIQGPSPLGRAQTSTGFSDALNPSIGLPFYSTGAV

SEQ ID NO: 922296 - protein, 147 aa, Homo sapiens
MTHYHRNLCAHPPPAVPPPALGLLSWLWKTDLGLRNTVQGTTSSLDTYMMSDFGQMIKPLWLLEHKHCDPGTANLITKRAAKQLTGSSYSMHMLDKGKNTVIVNTECQLDWIEGCKAWFLGVSVMVLPKEINIWVSGLGKADPPLIW

SEQ ID NO: 922297 - protein, 167 aa, Homo sapiens
MINCTIKNNLQKEEGGGGGRRRRGGGGGGGGEGRGLGGKGGREEEGELLLSEGKLLLVGLTDRNGEKGICQVNGYVPGSTEFISSYKGGNADDSMGQGGDVATTGDAEAVSSGKKGSSEFANSVSPASSAIDTYAMTSNEQFLAQKEGTVESEELERNKVLVDMLNH

SEQ ID NO: 922298 - protein, 134 aa, Homo sapiens
MEVTKEILEEVCNGYLDWVLVLKYRLGSTSRLENECGEIGDEGVKDLQPHPLTVTSLQRLPLLNGAASIKIMPHSWNGPHPVTNLMDLRTSRGQSAMDTKQPKEIFMRVSPQERRKNLKAHQMRLECLRCPSPQ

SEQ ID NO: 922299 - protein, 312 aa, Homo sapiens
MLRFQRLSMTEECTKVSPTKEYRKNGLVMKIKHKSNLLELFTVSNGDLLASLTIPGPKVLPGFHDIHAFLHFAKDYMLAIQPLSRGCADETLETVCVGSNICHGQDARTFMEKNELVQKAKLAEQAEQYDNMAACMKSVTEQGAELSNEERNLLSVAYKNVVGARRSSWRVISSIEQKTEGVEKKQQMAREYREKIEMELRDISNDVLSLLEKFLISNASQAESKVFYLKMKGDYYRYLAEVAAGDGKKGIVDKVCSLAKMAFDEGIAELDTLNEESYKDSTLIMQLPRDNLTLWTLDTQGDKAEAGERGEN

SEQ ID NO: 922300 - protein, 144 aa, Homo sapiens
MNQQGGLQTLLFFLLLELPGGEAKSAGPQRLWSPLPLGAQAQGDLDFVMEPLSGVIGVPAGKPHPLKKDEQLRVPVLAAAPLTRSSKGLDSRQPQPVLVTPHLRSLNRITLGDTEQNERSKGNRVHQIELVLFMTCTLVFLYSL

SEQ ID NO: 922301 - protein, 134 aa, Homo sapiens
MDSLGHCFRGCKPQALVVCMWYWACRYTEVRNSGLRTSTQISEDIWKCPDFQAEVCCRDGALMEDVCYGNVEGKCGVGAPHRVPIVALPSGAMRRGTPSSRPQNGGSDSLQHAPGKDAGTQYQPVKAVRSGAVP

SEQ ID NO: 922302 - protein, 134 aa, Homo sapiens
MPPQTHTPSNCHTASMRRREQLWPFGKPRPRGSPSQGCDSLFGAQQFLVSPSFQEPPHSPPSDMGAHRGSRVWYIWSSHSLAYNQHLCGRLELPTPPQQPAYLAVRGGWTPRLLARTSLTTLRLARPWQLLAIS

SEQ ID NO: 922303 - protein, 125 aa, Homo sapiens
MYCPRSMSTVGQKDNLSLPPAELQLRFRQAAPLLVPLLAGLSTAGSAAIGMSALIQGETGLISLSQQVDADLNNLQSAVNILHTQIDASKNEKITPPVPKYVQPESMANYSNYWGTLASSFATKG

SEQ ID NO: 922304 - protein, 152 aa, Homo sapiens
MDNEVQAEGVSDGDEKLIGKWNKGLSCYALAKRLAASCPCSRDLLNFEFEKGDLGYLAEETSKQQSVHQGVKWSCKKRATNLQTQNVRSTNNLHHVPGKAAGTQCQLVEAPMGSVPWRATKAELSKALEACLLCQHGLYRVSSHEIFLFKSV

SEQ ID NO: 922305 - protein, 173 aa, Homo sapiens
MTFVATCMALETILLSEVRNSLNLIGQNQGYAMWSDLLNGCEQNADSDMDSEVQAELVSDTDEELIGNWSKVQSCCALTKRLAALCPCFRDLWNFELESDYLQYLAEEISKQQSIQGVAWLLPTAYGHMSPPPPPPPPPPFLLIFIISLPLNAGFFCLPTQGTLSNMVDTSYM

SEQ ID NO: 922306 - protein, 139 aa, Homo sapiens
MTQKSNFQLRNSFESERVYPLRDPPSLCFIHNSSSDHRAGALKAHCHQCNLKRKRFIGLTVPHGWRGLTIMVEGERQKVASCILHGWQQAKRACAGTLPFLKPSDLMRLIHYHGNSMEKTHPHNSISSHWVPSTIYGNF

SEQ ID NO: 922307 - protein, 141 aa, Homo sapiens
MEAEMAHLPGLLSWLLSACGFFRQRVQATSGSTILGSGGSGPLLTALLGSAPAETLETEIVIRRDIPGEVMVEYLKFCDQDHFLLLKCDRKGRVWRRLCDVRIFHEHPVHPSMSILYMSILCILRYSISSILNKHLKAIKV

SEQ ID NO: 922308 - protein, 218 aa, Homo sapiens
MTQSAVFCYSSRKWTKTSLQVPCACMQTPVGAEREWLVEYLACRHVKALIILFSKSPPWVVNNSPAEGHLVTAATSVELSFGQHNTHLGSQCKGRHSSFPLKIIINMDSFPLCLFTFAVEIDHGSSHTIQLHSCSGCREKPITTQRHPHTNSPHADTPAPPTHRHPTNRHPTHHHQGLLSVMWFYARVRLECGTLLLSRVCFVSLKISAFTLVLVSCA

SEQ ID NO: 922309 - protein, 184 aa, Homo sapiens
MTPQPGWWPCGLVCIVKENSFCRKDGGASSWLPVTDVASMFLLLSFPFPAQPGLQLTASASTACVLAFLTSHCQGPPPSFRGGHPHLKMRERPGVRHKQRCAASSATVCNSSQVVCSYTHIVSLFLSHPCSRTSILVASWSLHSCHLKDSKGSNPTRHTSLPDCTAEALAGAELDALLGATRPL

SEQ ID NO: 922310 - protein, 242 aa, Homo sapiens
MLLGSLFWRPVFLGSLFSGSVCFWGLCAPGVYGLLIFICFWGVMHSWGHADFADMLGPVFRFLLHFPLLQCSLFIMPALLTHRGRGEYFWQLASPCDDSQGSFEDLSLWPQWLDGSYSAPNSCYSLQQWISNEAELGLNGNCPLNGLNLERLFSINFKKQGDTKLFPIIHFPYMPGCFQTSSKLVGKLRPWLGFRDRCLECRDTFCRFLRAPTAVNSNESEDFHFAYWFARFSCIIASFLKG

SEQ ID NO: 922311 - protein, 150 aa, Homo sapiens
MSCSPDGLTPPLSKRSCLRHESHHVAKDELGKEGVFVSVTGYKEKVWKILLDQLKITQFSRACIPSKLYVYVQVYIRLKTVDKSLLIHVIFTLWPSSFPAFSKGMQCFRITVSLDICSRNYPAHHRSPWYPFAEVCWLFLAIYFSMYDLR

SEQ ID NO: 922312 - protein, 166 aa, Homo sapiens
MSLVSPLSVLEPEPCSSLLTPLLVIPQAISGTGHTATCGSRRAQTCLILAVRTRTQLSSLGEGSTDPQGGNIQDRENHPDRCWMILAEATDLPRFVNENWCSQLLRRRLLSQASCSLCDIKRVKKEKRKQLQNRAAALGRNIPCVSVCIHPYGMARRLLQACPQPS

SEQ ID NO: 922313 - protein, 183 aa, Homo sapiens
MPICLCQTLLVVDDGKFGNKPRTLCTGPAQGSSAALARGNAFDLCLQRGQDQLHWLFQELPHRTSAPLWILSQPRLDPLNRRDLCTQYLYISRCPGWSSRELWSCGFGQKQMDVCRVCIVLARAACLHGGAFHLLAKLQQTLASEQAGQERSCGQTAIAKEGSGARRVPQIPTPGQFVTKKQV

SEQ ID NO: 922314 - protein, 140 aa, Homo sapiens
MSLSGRVTRTVLCTLSPGEICLTGGPGDLADKLQAFQPPAENPVRTGTLVAGPVAALQTYAYGSYIPAPPPPFPIPVSPRELPTGIDNVELWSAFGKREEQEGLAVTRWLLSPPQKPEGKGAIDTVHAEQALNQREELGI

SEQ ID NO: 922315 - protein, 150 aa, Homo sapiens
MGTSLDQEHSRHPAGSGGSKSAAGLLRRQTAVVDGERKLSSSCNKHGPEDHDCHPPTVTFPKRSICSSPSHLSSPQKEVHCMAKKPPWALAHLQLPHPHLCPHPVWPDLQPCSFPNTASGLYVVGPAQPQPRRPLCRAFIHQTVWILYLL

SEQ ID NO: 922316 - protein, 134 aa, Homo sapiens
MRGKGIPCPVNWGEPLFWGRSRTWFQGYSPTAPLPLSSTFACSQAARSVTGETKQDPCPPGLWLALLLDKSSAAEPLWPLLEASWNEQMAVQSGSGRSCLQQGSATLASVPVASPPQPSPPTKAQASGRGILPF

SEQ ID NO: 922317 - protein, 181 aa, Homo sapiens
MVNPTMFFNMAVNGKPWGHQTALRAGGGFTRRNGAGGKSIYREKFDDENCSLKHTGPGMLSKANAGPTLDPYPAPSPVTHRGTALPRGQLAWTKNGEPEQWPVSHPLLRSLQGGSASVQQTSWPQERALGRGSPDSKLTAARPFSLAQATLAMGTCLPHANQGPVWDGELEMGCEDSSLSP

SEQ ID NO: 922318 - protein, 185 aa, Homo sapiens
MYPTQDSGHPWATQSWRVTPGTSSLRVAQQPRGLLESQDFWTRDPEYICQLLWMPVKPRLKWNHLERQGSFVRVSSHSVARRLAQHQLKEKLWVPGRVGEGPLGTMPGWGDSHVGDKPLVVFGILPRGKRCPSWLQAPVAVPEDQGWGCRHEQDEGSTPESRCMHRAQQQGTLIFPICNSVPIKR

SEQ ID NO: 922319 - protein, 133 aa, Homo sapiens
MLVVAWALGGPVAKMDEGERKGFQFSPIQYDTSHGSFVYGFYCVDVCSFNTQFFKGFNHEGVLNFIKCFSASIKIIIRFLPFIPLMYGMKGKNHMIIWIYGDVYLYLYFVGNRLLSLVSENPFSHSISFDWGV

SEQ ID NO: 922320 - protein, 138 aa, Homo sapiens
MLNVSTVDLPCRNGTPGGQDPPALFIWFTQLQSQAQCGGSLPVEMWFQLCRANPGKQKHTSKLAEQPSMGQGPEESAQHNRNPKFPKELRKPKLQNLLTSHGVLSIEDRIHVSTATRNPVVLLKIFLMHSFNLFLYIH

SEQ ID NO: 922321 - protein, 277 aa, Homo sapiens
MALLSHSIHNDLAFPAVVGWKHQAGRNSRGLMEDGMMTTEMTADSLTWGMETKLTGSSFAMFATNWPFSLTTVLGMTSVTFNSKLSMEMHGNKSQTPAKLPFDITFNYDLPDIFQNFVIWKQGDGRVSTFSPAVNSPLVFTILSSLVLEEEKELWSGQKDGHREMTTVTVTLKPECLYQGVSDVTTVSSFFPATVPASQKLIFSTSTSFLCCCGCTPEPARPNPSPKESTLLQFPSPWPEDTVFLIERFIAAKRLSINPSGRAEPVSQRKSVLVIEH

SEQ ID NO: 922322 - protein, 160 aa, Homo sapiens
MALSICGPRSILCPSIPRTPIAEAKEWSGARSRHVLPSNMLGPGEADITLEESSFTPTNEGISASHTTWTINQIQEIHLTLQLSAHISRWTCVYSYLYLHLDSNFTCEMGVGTYSMDVMDFSRQGLSKLGMVLGKGTSYDSGHKKLSGSLRVAHGTGLGT

SEQ ID NO: 922323 - protein, 149 aa, Homo sapiens
MASPAWVPSLACLRSSNFQTFPAGPAAPCYRGLPFSTCQCRNTRPIPPPPPPPQPIQCEDNDDEGLYTYFIVRLQYTIQDKINCLCYWQGFWSIVDRFLESRKLQGILTVWVSAPRASASFKCQLYSILHSKKQQPLGHLELSANTEYI

SEQ ID NO: 922324 - protein, 204 aa, Homo sapiens
MDNVAAYYEAVIKELGEREYCQITLLNQGPNYPPQPRTHSYCFEEALSVLFLIRLPELDIHLLQPCAIPGTRNVQRKTSALAKLTFVCVSDRQQITNKQDTGQAAEAHTLWDFSLKGPIHLFGRIFAGLHGKNIVHLWLGTVLPGPAIYSRTMQNRPRSMRPQNHHPVSHPFHITPDMVWLCPHPNLILNCSSHNPHVSSEGPR

SEQ ID NO: 922325 - protein, 145 aa, Homo sapiens
MLSFRSLWKGLCFQGSFVVIFPPAAFCSGLMAGPSKKADIHSLPSSTLFTTFKEENKASSCVMWAELFGILCFLLHKVKTLKAINSPTRSPTQPLTHQLTHPPINSLTYPPINSPTHLPTYPVTHTLSHPPTHALTHLLTHPSTR

SEQ ID NO: 922326 - protein, 135 aa, Homo sapiens
MTWKGQGQSCREQGLGVVMLLLSNTIRIHQAFSSFLLPAFAGFLKVLASRIPNGRGMHPDVHSVLPRAIQEQGPVVETHPELPASWAPYSMRVAELLVLRSWLSWEGGRCSKQSLSPRGDAARALPQSEQGLPAA

SEQ ID NO: 922327 - protein, 117 aa, Homo sapiens
MNSSDTDLERSRLGAEPTVLLSTELLNTIRCSSLPRHRGIGLGASVQKLRESSGPLLVFQLKKDGKAFFSCPGSNLPEVTNDGLHPWATSRHSEDKLNGEPTKLEFAFGLMTMERQW

SEQ ID NO: 922328 - protein, 137 aa, Homo sapiens
MENPQSPHPPPPCLQGPCHCPAQGQLLSLCALTYPLHLGFGWMCGHQKLSAILLPTLPIEERSLTPRLSEQPQGSSQFGPHIYSFIQSVSQTSKPAIHSNKYRLIIPNMPDTFQARGTWRTLGDNAEGAKANSDSAD

SEQ ID NO: 922329 - protein, 132 aa, Homo sapiens [sequence omitted]

SEQ ID NO: 922330 - protein, 150 aa, Homo sapiens
MFFCVPCRVSSLQQGTVSQASESVESEDRCGAVGSHQVKAPRAARPSPEEPMVRRTGRPARRCDQATLCWEFSGIRLKECALAIRAQSCSHRNHRMEQGSSWECLCGPGLRGFQVQERRGQLNKIMCSLHAFIPTDAKDSDIDSIQFVPY

SEQ ID NO: 922331 - protein, 128 aa, Homo sapiens
MKSINLFVPVGLLGKEIIFHIIFNITLCPPIPKVIEREIVRLFVHSIQPSLLSSALCQVPGRSTFPNSHFMLVDIKMSFESHTQFVTYQSFYEAVHHGRKTSDIEVKEVSVCILALTFVKSYAEDEMP

SEQ ID NO: 922332 - protein, 154 aa, Homo sapiens
MLVCPCDSSSNILLQMAQGFLQFKEENLCPINQTIPQGPFSGKQQDQAGSAHPRNTGLEVYSPWFVLPGERKRHPEWSLQSQDLSGAALMKSPGCYPMPSNVPGVTIYALSQLHTSLTQRPHLTPTSCFSRNRNNPRLLLKDFASSVSEVSSER

SEQ ID NO: 922333 - protein, 138 aa, Homo sapiens
MLCALWGWHPGLSCPLASRGCGPWEELAGALKKEEREIKMWTLLVPFLRGLAKALTGLAPLSVPLPGPGWQQLPAATSSQGFTIPCSLPHSAAGLVNSTSRRPSACICQNLTAGDPSLLSDEPSLQLVTVAIVLSKGH

SEQ ID NO: 922334 - protein, 134 aa, Homo sapiens
MPGGNWGWGEDGRSPAGMLPGSTGSGVPGKDDKVTLSHADSETSQLCVEGTLHTWGLSVTVSLHAAFSLTRREKPVWTQRAPILNDNRYRIHVNTSIKAQAVFSKPKPFLSEIRPIYTARSTGLIFFKLWTQRG

SEQ ID NO: 922335 - protein, 164 aa, Homo sapiens
MQKHALVKRFSRVLPCFSASGNMHHAGGRRPSSAILGPRQPCSGDKQKPGRPENVICSLPRLRDCRRSIFTTSAAGRALPLFGIQKATAKNTHLLNILGPALFPKLHLQPAFCAAGTPPGDLQRPKNMGGVKARGVSSLLTYDLCVVWGLRQQQSRFCPGSLIN

SEQ ID NO: 922336 - protein, 211 aa, Homo sapiens
MDFIFLYSFSRKDKHSKSTWWRLQRAVPMGNLGASRGGVVESWGQEALVKESGGEGKPSSPNCLSPRGSVGYSKWHTNTEGHKGCAQGHPNYSFIDGTPGTILWVGLELPEKVGEAGPCSLGWTCAGLAADICFLKLVLSAKHDPFVQHSQTVHFLGHNVFVIVGPYAEKSEWSWTPVQAIFTEDKNFLNPPLSYKEKPSDVFFTSQSYFL

SEQ ID NO: 922337 - protein, 135 aa, Homo sapiens
MRKSAEAPRCSGHQEGYFQSCFALTETLRGFTCTIVKGKSFVTIHDIVRDTVMLLPFTELVRALHLCLISVLFEPLLVMSTMKEKVMIGGRIEIADNFQRRMVNGCEMVNTCVQVNSVSCAACAVLVIANKSHEI

SEQ ID NO: 922338 - protein, 130 aa, Homo sapiens
MKHPAWQHQRRRLGFHPWVEEQKMSCVVKGDKDWFHSHDASSAWLFCSFIVVMTFQKRTKKNAALKVLTGSELTLRLWHAEETSYLTFFHSFTFILRMCPGQDSSSWGCPPEQGKHHPSLRELLVGILFS

SEQ ID NO: 922339 - protein, 176 aa, Homo sapiens
MPSSVLPCCEDQYCKDKGCLHGHSWALQKPHKHRHKEDERGSTRESALKETRRQPLVCQGKQTSARQAGGNRFTARQDEQRPGRHGSSENTPVTPITHAWRPLNLHVLGHQSQTFSTRMVLVPPATWSCGWDPRRARTRSGSTIMGQRQALCLVWLQRTFQKRLLTLALDFLWRYL

SEQ ID NO: 922340 - protein, 137 aa, Homo sapiens
MQALAWGLYFNPTTYFIFVCLSSDPDNSKASCTSHAIHVTGDLPTGISVIPKLFCARCVMVTLDGHLWGGGKAKGSIADSKHPPYPPAQAPSASPSANDARDDVIARTHGRSPRLSAQTAAEAPLPGTTLEVPMSLH

SEQ ID NO: 922341 - protein, 292 aa, Homo sapiens
MLVHPGTRCPDLVPPPGDWRSETLPQRAFPPVPGARENRTAVPSGQCLGCRLGFLPPLYLQKVGPATASQRHQEAQAGALSCWRCWLVLVVLRWEVRLSRHSSDLHRELPLCRKTHDTRFINEDAACDNHDNDSDSHSLSSSVPLLGISSTSTTVLWCQAFLSLFGDVQAEAQKRMPGEQLRSGVSHIHLTPKPTLVPSVTPLPTSMGGDDPGLPTCQVPHHIPAAKDSSHTRKGEESPLPCREPSKGLAAMAVHGFESSHGPGTLRAQKHCPHLQMRKPGLQGACRFHTLQ

SEQ ID NO: 922342 - protein, 133 aa, Homo sapiens
MFWRTTDHMYCGRSHKIKMELKNSYHLATSWSSEHSTTHWSCVCGNAGVNKPAALPVRFRYTNTYHCVTIAYSVQYSNTLYRVNIPDAFQWTRELMASVIVDGPTNGPWLYTASAACREWNFPGSDDKQTLTA

SEQ ID NO: 922343 - protein, 175 aa, Homo sapiens
MQLALLWCKRNVLIARRWLAARLLLRQESGHRGDSSSSWHPPCGAQPALHLVGPARESNLVPFSILEALLRIKNRSNDGKESERTAALSPPSCQGLNEPPGSFREMRDAFPSRSDAWPRNGKSRRGLVAPWGGPVSAAPTGCQCPCTHDGNLIGQVSDETLRTVTIGTYDNLGCS

SEQ ID NO: 922344 - protein, 138 aa, Homo sapiens
MCGERNCICEAGQELLSKATPSGPGLGCAFTVDCSPGRQQPAEKPKLFTAVRSQILPTTTSMGTGKREAPPIRFYWGLLGHRLGGRLISGSQQPAASAGRNKDSLWLLQPHCPAMLHDGGECLGRNIQANHVSITEPT

SEQ ID NO: 922345 - protein, 136 aa, Homo sapiens
MIIYFVQTRSVLPCSEACRDSTARGGVKVKLHTAAPVTLSSLSILDESLFEKSQQVIRRHPEEGTAVLEDGISMRVIAPEDLPMGQDVEVGDRAMGLLTRCKCVCAYECVHVCVKVCMFLYERMCVHACMSVHVHV

SEQ ID NO: 922346 - protein, 150 aa, Homo sapiens
MPLFHPQNFGDSQRPRCPSELLLSNLGIARGVLTESPVQLDSRALFPEQGRRKQVGHRAALTCQTPPDRSGKGAASCCHGGKGDGSECPVSTAQQDLSSASVKEGGGPTHVSNRGSHNESEQGGYTVLQNAGHTKGYIVILVHGISHMMG

SEQ ID NO: 922347 - protein, 137 aa, Homo sapiens
MLPAARLGAGSAESLMEGMAEGPMQQGPQGVGTARAQQWVTHLGTLWETSLGMYRWGVLHSFVSTKLRYKDPIENPLKSHYAPGTKCSAQCTTTHICVAQNPRDTKERLIGQVGHTALGFQPLSWSPPARRPRLSPV

SEQ ID NO: 922348 - protein, 294 aa, Homo sapiens
MHASHSPIFADCPLLGFAQLALLALSSGRPQQVCSFITAAAQEVAVWGQSRVPPHQGFVEIHASSPSVSGSRGEAAAAASNENERGICSHQYCLEEKRTGPGGVFREFFQTGKVLGNRLSSQPTPKRPGCGSVVYQNCFDHKYLLYIHEWEQHCVHNAHCASARVPNHIQYDFLAAGWRLRIVTAVVVYLSLVYCELEHLPPPLESRNWRKVMYLGNISKCEMSLDPYHNIAEMVALQQWVSTRADFAPICIWWVRPRELPHLTMYRTVPTANITWPKMSAVLRCAYVFYLKYI

SEQ ID NO: 922349 - protein, 255 aa, Homo sapiens
MRAQETSGPQIESKGWQVEWQHGAGSGTASRVSLEHVARSSSAPPGTAMKPQEEEEKEVLMTEPKEEQVLMTEPQEKEKEVLMTEPQEKEEEVLMMEPQEEEEEVLMTEPQEEEEQVLMTEPQEKEEEVLMTEPQEKEEEVLMMEPQEKEEEVLMTEPQGKEEEVPMMEPQEKEEEVLMMEPQEKEEEVLMTEPQEKEKKVLMMEPQEEQVLRTEIWSHPTWNSDEATGRGGAHDGDLVPPHLEQRRSHKRRRCS

SEQ ID NO: 922350 - protein, 205 aa, Homo sapiens
MDSSPGPRPQDLGRGHITKGESAATGSLVLARLRASGRAPQRQGVHLTPFNPQHPALRGGSLQFVIQVLFSGQAQSPTGISCAGSWKSALRHAPEQGGSHERDHLLLLLTMAGAWVPEVTRPAVLLIFDTGSKKPMLLQVSPDCMCKSVIVPVCMSVSLHEVSVCHYAFLFVWQPELRPAPVLEQLVESRPMGPWRKRGRASVLW

SEQ ID NO: 922351 - protein, 139 aa, Homo sapiens
MVSQPETRGRNLRTIVRVDPPATEEGGSLQPWGQLSLGVLMREEESITITQKYLTVTSPHLHPTPSLASLSGVFLKCICLVLSPLRPYRGDPSGDFLDPKETKSTCCFSCKSTKSNPGENEESPGSGVALGEPTYRHLV

SEQ ID NO: 922352 - protein, 159 aa, Homo sapiens
MTYLDKTYSGNSWASVSRNQQGESRVIVCISPFSHCYEELPETGKFKKKRGLIGSWFCRLYRKHGWGGLRKLPLMVEGQKEGGTSYMAGAGGRAQGEVLHTFKQPGLLRITRTARGKSIPMIQSPPIRPFLQHWGLQFDALGHGVRLVKHKNRPEFENQ

SEQ ID NO: 922353 - protein, 152 aa, Homo sapiens
MFCQVTRSQGVCSYLPPAFEEKWLKSPCLRHVLREGQACFQSLGFYFAGLGLEGCSCGLGPSSVTSVTCIAFDMGPPGGPMTSPVKVMTALLSQRCCEDELIASSGPGTWHMLKEQFLLLMIILGSAEMENQAKRTQMWQSSSKQLFWQKPK

SEQ ID NO: 922354 - protein, 138 aa, Homo sapiens
MEEVLKQLQVQSPEKEDAAEVRALQVQAGCLEAWLHSSAKDLEAAVSGDLQVQAGCLEARLQSSEKELEAAVNAGLGLSSQLETPTLIPRRLLVRPRGLLHKEGEDALPAGVPPLENRGPQQVTCSEMWIDLVLARID

SEQ ID NO: 922355 - protein, 157 aa, Homo sapiens
MAPQLVFGCKQTAATARLPGYQYLFFGVMARHLEFIARTVMAQEGNVESAHRTLNRILTMDGLIEDIRHLPYVVSHSTLCPGRLNCVDNTNRSPTGFQLGLDNGEPQWIRKKEEAEMVLRIPGDLAGSKPAASGNTCQGSLVLSYTLKVAAFTSSMK

SEQ ID NO: 922356 - protein, 248 aa, Homo sapiens
MAIFPVLNRWKPRLCGIPGMSAHARLAASPVGSSAAQAETTTGRPARVPTAALTNQARCSVRVPEGLGRNSCCPSRLKASSEVAPIPGGFPTVFSPALYLTPVFPLWATYSPPQYPTHLQIENVLAYIAPFTIAPGSQVEYPIPPPRHMAARVARAKEEHLESLTGLFAARDPDDLRGLHVPAWQQEWLGLQSSDDQTLTQMQAEMSSNMESGQSTVRHREECQSQPESDWKDSAGADADLNGDSKCE

SEQ ID NO: 922357 - protein, 210 aa, Homo sapiens
MGRNQRRKAENPKNQSASSPKDHSSLPAMEQSWMQNDFDELTEVGFRRLVITNFSELKENVLNHHKEAKNLEKRLDEWLTRINSVEKTSNELMELKTMARELHDACTSFNSQFVQVEEKGSVIKDQMNEIKQEDKFREKRVKRNEQSLQEIWHYVKKPNLHLIGVPESDGENGTKLEDTLQDIIQEYFPNLASRPTSKFKKYREHHKDTP

SEQ ID NO: 922358 - protein, 208 aa, Homo sapiens
MFFLSLWIGIFCILHINGITKYVTVCVWLLSFSITFSRFIYIKQEDEVSDVQVLTSNLILLSSSRPDCESTSRTRELFLLHFGSNNRRLHLCRGTVAPSEGCTTFDDQHPSSFSGNDSNTKKTKDLLNGFDQNADSDMDNEIQAKVVSHRVEELVGNWSKGDSCYVLAKRLAAFCTCPRDEQNFELERDYLGYLAEEISKQKSIQEVT

SEQ ID NO: 922359 - protein, 150 aa, Homo sapiens
MEVEVAQLTITPSDPLAKCLLPVPVTFCSAGLEVLVPEGRRLPLGHTTMIPLNWKLRLPPGHFGLLLSLSQQAKKGLTVLAGVIGLDYQDEISLLPHKRSKEDYAWNTGDALGCLLVLPSPVIKVNGKLQQPNSGWTTNGPDPSGMKMLG

SEQ ID NO: 922360 - protein, 156 aa, Homo sapiens
MRKKKREEKGSLFLWSMLRVRSPGDSTALQGPIISLCLPKSDQVVRYIYEESGGAVIQEQRIPRQSSGPPQGNNKYGSQCLSSELQVPLGLVFARVLLLFSCEHQLLPMDTMRGPSFLHSVFHSELKSNPNVKTHCQEQILEAIMQASILRKIYIT

SEQ ID NO: 922361 - protein, 139 aa, Homo sapiens
MGSRNPQLLWESSRPEKFRFSIRRSVSVTGQLKGSFSKHTNLLYSLNGYYQKAKTDDAGKPVSENWYTAGGNVNSYSHYGKQGINLLGTSGNRPVNGFNPTVGYLPKRKEIIILEIYLHSHVYCSTVHNSQDMESTIPL

SEQ ID NO: 922362 - protein, 151 aa, Homo sapiens [sequence omitted]

SEQ ID NO: 922363 - protein, 135 aa, Homo sapiens
MNHHHCQIAAAAPRITVDMHSAGVDIFTPILGSFSSSIDLAGGSTISAPAGTWGQGSLGHAVHSSQPSRVPVVDLEGPIVSKAAPNLAEVVTTEAEPLLQLTAFPLSVAETVQLSLKRSSRPLQWVSHPVPQPLP

SEQ ID NO: 922364 - protein, 263 aa, Homo sapiens
MQWIIPGKRAHIAKLQVPPLQMAGSVPCFCDGPDAVPAASHPLPSLPLFLPGEEEEEEEEEKEEEGEGASTSSPLAASSLWPLSQKQALSRSCLQGSLLLLGSKQSPSADHPKTSGDSTLPFLLTAVTQPLTPVYRRTCKDEPLSVSALEAAAGASAVFLLHTRACDLMTQGILALVTSTGCASANALQSLTDAMHIPHLFVQRNPGGSPRTACHLNPSPDGEAYTLASRPPVRLNDVMLRLVTELRWQKFVMFYDSEYESPM

SEQ ID NO: 922365 - protein, 155 aa, Homo sapiens
MIIKRHDYPDKRSSSHCTQSNVAGLLARFVGMRQRLQSQVPSLPPIFVRCSQSWASFPCQQPILLVIFSGFRPSSRGNIEPHMGSNPCSQISALSAPPTIPSFADLYYPISHSCTNVIPMMNPLFHITPKSSASWIELLTDNQSKQIAEQLPKPS

SEQ ID NO: 922366 - protein, 225 aa, Homo sapiens
MLYLGIPDKGTRYRDNKGNEEKEVSAFQTEYEKRLGRRQGIAKNEKGGGNLTRYSPLLQLDCNLMEDSGPELPSWLCSPQSPQSQKLGDKECRFKLLQFGGTYSWSQKSTQTTSGQLKEYNRVWDTMSLDSFVKPGINTHIWSSHLLHSKFPDLFECPRDTLLEAYSMDAFLNVDGVFLGHHLADGRTAFLLSTLLCSSHCARPKLERSQMSLLNSFSPLADIVL

SEQ ID NO: 922367 - protein, 134 aa, Homo sapiens
MNSILPKGFRHPGPGGGDNPLCSPNAVSRLYDSYCPSKFTSTNFPSAAPLLLASICLDPPPQSLMTFTLGPLSSTVNFGLVTNVTNDFHQYSRSLNMNITVVFAGTWTSKKIISGWTSVIGAGQHEFLSNTLCP

SEQ ID NO: 922368 - protein, 171 aa, Homo sapiens
MPASLGAAEEVFPNNCACRGGLTLKLTTLTSGPLSAEPLPRGIVASLTESHSLEALNDRNPFSHSSGGGKSNIKVLARIVSGLVGVGNSTCLHTGCKGAWKSKSLAQSSRVQTHQVGRSSNAGRSFRYCAVQKNNKCPFRGAICVFLLGYSIFPLQKQVAFRPVAKAIVNI

SEQ ID NO: 922369 - protein, 137 aa, Homo sapiens
MLSKLSLHYIFKIPNLRSFFSPLETLNPGEYRFVCFTFLHERRNSMYFNPPMTSVVIYFETFFFFETEFCFVTQAVVQVNQHHRQFTLLCIAMLRLPNFKRQNLWRSSFPGITALCFNLSCDVDGDDVRAAAKRKNT

SEQ ID NO: 922370 - protein, 174 aa, Homo sapiens
MEGEANTSFFIRQQKKKNMQRKCQTLVKPSDLMKKLRHEELTTCPMDTAGKCKCGNSHACPQLVESSTIADSCQPLLPLLSHEDVFKNTTFCPNRALTKGSPLVAVYLAARRHLAVSPLQELPQLKSHLTHGHAPSPGQTNPMNGQQRSKDTAPWLTGTMLKDYPSIRASHRVD

SEQ ID NO: 922371 - protein, 174 aa, Homo sapiens
MLGAADWSCSCLAIFFFLPKNNYCAPSRFWWAFIRKIPRVQVGYTEELQQCCEAHNLFSFFPTQYPICLKCKKKKIQEAVWQQELSRVFSSHSWMCSRQGYDCNASFVRMEDYRNKDNMTRAIPIRPGSFHASQTSSKKGTLVSFHKCFCLYYKFPNGKGDKIEYRKALLSTHQ

SEQ ID NO: 922372 - protein, 141 aa, Homo sapiens
MSSPERHSFIFLGTMLSVYQAYESESEYLALNLSKLYQSESKCHVSPYSRCSWPWTLHVCCQDRVELHVAVSMSDLDSPLFVKCSSRKKGRDGGLKYQNIQPHPPTFKYQNIQPLPPTLKYQNIQPLPSTSRERVVRGTGD

SEQ ID NO: 922373 - protein, 126 aa, Homo sapiens
MGPGFLSNSQGESDGVTLPFEGSLKSLFPALAVNWGQQGQDSKMKFPDSNFLDFTMALSSGFRRAPTGQFHPGKPFDSHLPEHFLNQTIWFLAHAQSSGGATTDPTLDHRIRNDPFQCRQSSEQTE

SEQ ID NO: 922374 - protein, 185 aa, Homo sapiens
MRMNSGAKYWAPVSQLKATSMAARLKKLKTRVSDFLGKGSLITPNSLELGALVFKNVSVRATKSDFSRSSLWSRRTDQTLAFNLKNVALATAREFGDTWYLSQVNDRMTAGERDKVSPGQQAIPSVDPHWDLDSDHWDWSRKHLLTCVLERLRRIRKEPMNYSMMSTITQEKEESLAFLEWLQEP

SEQ ID NO: 922375 - protein, 327 aa, Homo sapiens
MLLHLAPCAWKSRRCSTTAHESSQDEAVLCKATGSELPKTMGTHLLHQHDLDVRPGVKGDHFGALKFDYPVGFRTCIGPQVLYDESAAVASFQIYIEVAASPQLVQSVHLQNWHHMDGYHQGLFPILFRAAARDTPWLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGQMGNDQRMRDM

SEQ ID NO: 922376 - protein, 169 aa, Homo sapiens
MEAILFVTTGEWDVGAVGISWVEARDAGGICAVIERQLQFLLVLSCPLAFCHGMTQQEGPHQMPAVWSSTFQPSELETILDYPGILSVITSILMKGKRRKFDYSSRRCDDGSKWRDVKEGTMSQQMRTGFGSWKRQLLPYIDYSYMKELLLMCLPNDDFLFHHLFYIIN

SEQ ID NO: 922377 - protein, 259 aa, Homo sapiens
MIVAKQMLPVFLYSLQNQVKRSQVPVAKTMGKIPQRHFRDLHGSPSYHKPRGLRGKNASMGEAHAYSLVQPWDTAPHILVTPAPAKAKRTEATIKRDPVHNKEINLGSLFIPWFRHSSPSLRDVEAAGNSNRGIPPHPYLTERHPAASPGKSLPFFPGDDSFMNVIAPEDIPVFVKDQMVVDVQDTKSMCKNHKHSYTPVADREPNLSTLLAFEKIQTCVSIYMHQYLEKIYKEEDEREEEADDEEEEEEIHEKATENQ

SEQ ID NO: 922378 - protein, 138 aa, Homo sapiens
MDKKLLKLNGGRHVKGILQGFDHFTNLVIDECVEMATSDQQNKIGKGREDTGFCPEIQATKGYIPELGRSLLDPSSPVAVVLYSISNNISYGVDHCNGPRTTISFAQRKVIKEILGHILINIKLISVSQSAHFKPKDL

SEQ ID NO: 922379 - protein, 182 aa, Homo sapiens
MAFLSVDPQLSPEVQEKRKLVPGKPTLPTPKSQGLLQSPFPESLTPVFSAAAVLITFNWPTGARYLAPELCSDVSGVSSFWWVRGFADFRSEAAEPHRMKPQTLTVSVTAHKGSVDPKSEQQQDSLRRAKEQSFHSVEEHPSVLLLLDEAVGCCIISLVYHVELLSLVHANRLIQLYKTIDT

SEQ ID NO: 922380 - protein, 128 aa, Homo sapiens
MKEFHYVYAYQNIMLYTLNIKKKENIFDGNVVSEAKRGQFGKISNLTILSVPDEPLFPAKVELQPVHFISIPKLICIMWQYVLMLIELPLGSGPATLKDTALLLSNAAPSRQLRTKEPVKKSAGFACT

SEQ ID NO: 922381 - protein, 176 aa, Homo sapiens
MRGYSPTAGLMSFSGREASRAPVCAFMTQNYIKLNCLKLLLFYHVKPLSVTNLPLCSVLLTPLLIPAAPATANPGHTVPLPRLLPLPGMLSPFSSTHQTPIHSTKASLKVPFCKPSLTGNTIQSVIPTIGPYVSFLWVLLIHHNLSCLYLSLKQKREFLEDNSYLPLNHLGLPLCS

SEQ ID NO: 922382 - protein, 140 aa, Homo sapiens
MFLWSRVMLQLPGKVGSGTRYGDGHADLVAKVTHPRPHMEEAAARVSTAAFAIEKPDPQPARSGRSREKEWLALTLPIRRINQYYQCACLEVLGCWRNLRAGLGLLLSGSGTAWSSVTVTREVLGQQVWELVRGIQWPLK

SEQ ID NO: 922383 - protein, 147 aa, Homo sapiens
MMTMAVLSKASLVLPPAPAAIVPLHSCYPDQDSAALPGWALVLWSLCCPLFLHLLLLFFQMRSSFVTQAGMRWHDLGSLQPQPSGLKQSSHLSPQPPPQEPGLQRRSLNVCGLCIVLILEKEVSKALWNCVCERGMWIVYVCVVGQC

SEQ ID NO: 922384 - protein, 278 aa, Homo sapiens
MEDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRAR

SEQ ID NO: 922385 - protein, 139 aa, Homo sapiens
MNISKPGQPLNKQQKYIGEKYSRGGSEEKPLRDLPVEDQNLHSPCCEGWILSMDGDSRPRGASERYGAWCFREPEGPSWGVGEDVEKLEPSSTGNVNWYSHCGKQCGGDRKRSKFLLIHKSLEQLYFIAPLFPSVHKMN

SEQ ID NO: 922386 - protein, 135 aa, Homo sapiens
MGLEARCGCGAAALISAKECAIGVSLISEKLESVVEGPRALGQTTGVSPRVQRSKNLESDVQGSIQHRKKMKARRHSKPVYPTFFCLLCSSHAGSRLDGALNIRSILLNFEVHNAVLLTIDTELYNRPLELIHLT

SEQ ID NO: 922387 - protein, 172 aa, Homo sapiens
MSCQWGLEHGNTAPGGGSEGIRVGLYKHGASICSASGEASGSFHSWQKAMGEQTCHMVTEGAREREEEVPGSFKQRIELEDSSGRIDAFPVWTVSLLGCGYAFETEQGWPVLCEPRYWKASGIEIRIVFNSLWSCACQQLVSFIFNESLHSSTIHLCPVDCKTKGPISDVNL

SEQ ID NO: 922388 - protein, 227 aa, Homo sapiens
MLRTVPGHSRAPSAFTCLLTLASLGAEAAPWTPELGVGSAVTPSAPFTMGCKMGLLLGSSTCVSGDSTSPEARTGWGGTSSPSTLAAGRATAETPGAAPLPCGRAPPLLLQVPPKVLGMGTGEVTGLLALPSVAEDPQCPQVQRGRSGGRCGAAPTWHLGEEPLPRFDAPTHSTERPAPALDIGVCGHLVQTRYSKFDKRTGATGLLFTGELCFLDPLLMLGSNDIF

SEQ ID NO: 922389 - protein, 288 aa, Homo sapiens
MGCCGCSGGCGSGCGGCGSGCGGCGSGCGGCGSGCGGCGSGCGGCGSSCCVPICCCKPVCCCVPACSCSSCGSCGGSKGGYGSCGGSKGGCVSCGGSKGGCGSCGGSKGGCGSCGGSKGGCGSCGGSKGGCVSCGGSKGGCGSCGGSKGGCVSCGGSKGGCGSCGGSKGGCGSCGGSKGGCGSCGGSKGGCGSCGCSQCSCCKPCCCSSGCGSSCCQSSCCKPCCSSSGCGSSCCQSSCCKPYCCQSSCCKPCCSSSGCGSSCCQSSCCNPCCSQSSCCVPVCCQCKI

SEQ ID NO: 922390 - protein, 238 aa, Homo sapiens
MGCSGCSGGCGSSCGGCGSSCGGCGSGYGGCGSGCCVPVCCCKPVCCCVPACSCSSCGSCGGSKGVCGSCGGCKGGCGSCGGSKGGCGSSCCVPVCCSSSCGSCGGSKGVCGFRGGSKGGCGSCGCSQCSCYKPCCCSSGCGSSCCQSSCCKPSCSQSSCCKPCCSQSSCCKPCCCSSGCGSSCCQSSCCKPCCSQSSCCKPCCCSSGCGSSCCQSSCCKPCSSQSSCCVPICCQCKI

SEQ ID NO: 922391 - protein, 167 aa, Homo sapiens
MPQPSTPVTAVRQVDPTAPPRFIRTSNDSPAPPATRGLTHLVPSVLTTSEGGGCLCLSAGEAACISHTFGLLDLALQGTAATEPGPLFLLLAPAAGWALALRPLAPLAKWSFVGKAGVLWSQPRGITQPPPLSPPTPAFRAGTQPLAFPKCHCDCRQPPLPSLGPVR

SEQ ID NO: 922392 - protein, 175 aa, Homo sapiens
MEEGTPLTSRLGPWDCPCVHRPCVGEEGLQGTRGAAACKPVPHSLQGAAAPRSQRGYCVQACPQLPARGCCSKESEGLLGASLSPTPCKGLLLFQASPSWTWGGGEGSHRDWSGTLAGPGPVCAYILGGRRVLPEPFTGSAASRWVWCSQEQLRQERGSPCFLEVCGRCQCLSCP

SEQ ID NO: 922393 - protein, 159 aa, Homo sapiens
MSILRPLHTPPELAIRWGPSPIPGPHSTCEKHSTGLGAEDAKQHFCKRPQHLLGKVKQRLLRSKGRQSRHLVHCQHSRCLLWTGPGAADAKQHFCKRPQHLLGKVKQRPPSQRNTWGPGQYEAFTVQSNQHKNINGKEFPQICIQNFKKQNLQSICRPV

SEQ ID NO: 922394 - protein, 154 aa, Homo sapiens
MMSTLLEHPPAFAARSGTAGENGLEAGPGALKPLLLSSFQRTCSIPGGCGQPFPWLRGANYITGNCGGAEVEGVCLYPNAKILPSTDFCPRGPERDVIKARSATTPGSPCREFPGQQETSYPDYTPGPVARQRHLQGSRIGGGENLHGARPSRP

SEQ ID NO: 922395 - protein, 175 aa, Homo sapiens
MDDGATALEKSMAFPQKVSVEKRKHFTELTHLIEFHFLVQAHCTNPLYFSLPGGRKATVFPSPSMSSSASVLVQYRDTAEDSAASNLAIPKVRGALRVTQLADEQAEAEQVRLAESDLLPGQTQDKAAFLPLDLRIQVRDAAGRGSGPRYSTPPPPPGPLAEDSVVICVDSKEKQ

SEQ ID NO: 922396 - protein, 153 aa, Homo sapiens
MAVGVAVGVADLTQGRASGLHGEGPDTGRLCWSPGAGQDLSRLSGLLRRPPRAHPALQGSLRGAVSALHPLVGCPHLYLLPHPARLQSCVVHAHLQGPHGAEGDSRAAQLQGDPGEPRQELQGSIKGNGSRRGGGHFLMETALNATEGTGGAK

SEQ ID NO: 922397 - protein, 188 aa, Homo sapiens
MEHDWFGVLIPDCGVGSWAVPTEAACRRLSGGILVTSYYPCSEATVHIKKRRNNSVACPRPTPADDSPALPVSQATGPGVSLGAGFSHFLHPTHQQFPWSQNLTPHLLPTCCISAVAHSALSCPPALQPVLLFSARDNRILLRYEEQTQEQDLAWTWQVLWQAQARGVTLTGKRCSGRILLNGRVAVT

SEQ ID NO: 922398 - protein, 133 aa, Homo sapiens
MGLGPCRAREGCQGLGLHLPETMKILEDNIGKTLLDTGLGKDFMTKNPKANAIKTKINSWDLINLKSFCMAKGTVSRETDNAQTIPLLGIYQRKISHYSKKILSHTFIAAQFTISKSWNQPKCPSINECIRKL

SEQ ID NO: 922399 - protein, 121 aa, Homo sapiens
MIPSDAGQWREHSSRPTYDCRPNSCYSRTLWRWLILPNCRCTNGCVEVAHGPLTQDPQELWPVVRAGAATAPETQALVHPGISAGCGCEASWSIKALGSGSRTLGVISETSMGHPKHAAPF

SEQ ID NO: 922400 - protein, 135 aa, Homo sapiens
MRAMYAGVGEGAGSRCDRELDRRSPRRIRVAAGLLLCLEGAVLPLPGLSPSVIRNSVCSLDVSPATTPPPGNAKLLLTVVCTSTGSASRGTWEGGLKSSEMSQAQPIHWLITDEPVKISHIQPRVAEVPHRPVDS

SEQ ID NO: 922401 - protein, 198 aa, Homo sapiens
MFCTDGTFIILTMKVATKEASTNSRDDKQDMLSNHNAIMLEVNHRKTALSPVTSGKHNNSRARGKTVMENTKDINQAMIEAAYIDSHGMQKEEPLPWSWPPQAYMGYCQATTNVHFKPKRPSVSLWSMLPGLSSTEFNAGSHNHCTLLPPVHRFSMPQDHYWGVEEGWLQGFKTVFSTFLGASFSDRKLKPGKDYKFL

SEQ ID NO: 922402 - protein, 326 aa, Homo sapiens
MTYAFLHVTRRARVHTALGVLVQHSELSVGEGVTLQGASMGPWRREAPGRHSKSPPEDPQCPAAASSRGVCPPRGSTAPVCREAWLHRTLRHWARRRCSCQELLRKWLEAPGRQSRWTGLDTGCLFRASVFASEIKARILALARCLCRGRGFHHEPSAPSRLEGEGVCVRVNASHSCVNASYACERRCLCTRVCVRVNASGYPRMHTRTCECARVRAQRTALSRLGTSFLSPLRVLGDQPPYPGAVGSPEASAHRCARAPALWGPGLPGPEEFHAVATRWHRRLATAERGGSRLPAASPRAVARAVSLRPRPLLPGKAGTIASHAC

SEQ ID NO: 922403 - protein, 151 aa, Homo sapiens
MYAGVGEGAGSRCDRELDRRSPRRIRVAAGLLLCLEGAVLPLPGLSPSVIRNSVCSLDVSPATTPPPGNAKLLLTVVCTSAGSASRGHPYKHYRYYRLMLIFKAILEHSDYSHTVLQMRELKPKEVNELDQDHTNWGCNRDSTIQLQSLHF

SEQ ID NO: 922404 - protein, 115 aa, Homo sapiens
MQSSGCGHCMFCTDGTFIILTMKVATKEASTNSRDDKQDMLSNHNAIMLEVNHRKTALSPVTSGKHNNSRARGKTVMENTKDINQAMIEAAYIDSHGMQARSRGCWFCEEILNPH

SEQ ID NO: 922405 - protein, 328 aa, Homo sapiens
MTYAFLHVTRRARVHTALGVLVQHSELSVGEGVTLQGASMGPWRREAPGRHSKSPPEDPQCPAAASSRGVCPPRGSTAPVCREAWLHRTLRHWARRRCSCQELLRKWLEAPGRQSRWTGLDTGCLFRASVFASEIKARILALARCLCRGRGFHHEPSAPSRLEGEGVCVRVNASHSCVNASYACERRCLCTRVCVRVNASGYPRMHTRTCECARVRAQRTALSRLGTSFLSPLRVLGDQPPYPGAAGSPEASAHRCARAPALWGPGLPGPHHEEFHAVATRWHRRLATAERGGSRLPAASPRAVARAVSLRPRPLLPGKAGTIASHAC

SEQ ID NO: 922406 - protein, 315 aa, Homo sapiens
MTAGAQTRSRPSCPPCACGNQPTEPLCQTAVFLREQFYDSYFNENAKNIRCYLDLMMQNVECQITTYYYVGFAYLMMCRYQDAIRVFANSLLYIQRTKSMFQRTTYKYEMINKQNEQMHALLAIALTVYPMSIDESIHLQLQKKHRDKMLRMQKGDPQVYEELFSYFCPKFLSPVVPNYDNVHPNYHKEPFLQQLKVFSDEVQQQAQLSTIHSFLKLYTTMPVAKLAGFLDLTEQEFRIQLLVFKHKMKNLVWTSGISILDGEFQSASEVDFYIDKDMIHIADTKVSRRYGDFFIRRIQKLEELNRTLKKMGQRP

SEQ ID NO: 922407 - protein, 134 aa, Homo sapiens
MCDVFQGSELRNRGSGGLQEHAGTHLGSHVLRTSDLGSEDSLGVRVPPRAAGAPGTRPAAGSAGRALWATWSCGRPACSGWASGGLPLEDPALGGLSVDEHLRVGEVSPVWKRPRTCGIILSDAKSSLWDKAYM

SEQ ID NO: 922408 - protein, 291 aa, Homo sapiens
MDFNGIHSNGMEWNGLKCNIVEWTRMECYGMDSNWVEWNGLEGNGLKLNGLKKNGMECNGLDSNGREWNGFEWLGMQCNGLECNGMEWIRMVGNAMQWTRMQWNGVDSNGIEWNGPKWNAMEWNGLEWNGMQWHLQEWNGIGWIGFKRNRMEWTQMTWVGMEWNGMEWTQMEENRMEWTRMERNVMESNGMECNGIKLNRIEWNGLEWNEMEWNRMECNLLEWNGMDSNGIEWNGMEIDSNGIDLSGMEWNGLEWNGNDSSGMEWNGPEWNGIEWTRIEWNGMDTNGMEWT

SEQ ID NO: 922409 - protein, 498 aa, Homo sapiens
MEWNGMEWNGFKWKRIQQTLMEWNAKNGFKCNGIEWTRMEWNGIEWSRKEWNEMQRNGLQRIGMVLTRMELNGMDRNGMDWNGMDSNGMECYGFDLNGMQWNGFQRNVMEGNGTEWTRMEWNGIEWNGMEWNGMAWIRMECNGMEYKGLNGMQRNVLECNGMEWTRMEWNGIEWYRKECNEMQWNGLQRIGINSNGIEWNGPEWNGMDSNGLEYYGLEWNGMEWIRMESNGIEWKAMDSNGMEWNGMERNGMEWNGLDGMKWNGIERTQVEWNGKEWTQMEWKGMEWNGKEWNGMDTNGMDLNGMEWNGMKWNGMDTNGMEWNGLEWNGMDSRMDSIGFERKGVKWKGMELYVLEWKGMDLNVLEWNGMDLDGKEWTRMEWNGLEWNGMEWTRMQLNAKDLSGMEWNAMDLNGKEWNGKEWTRMERNAMEWCRIEWNLMEYNGMEWNGLKWNAMDWKGHEWIGKNDLHWYRIEWTRMEWNLMDSNGMECNGMDSNGME

SEQ ID NO: 922410 - protein, 163 aa, Homo sapiens
MCLLHSTPITDSSQATAPKEPPSAGSLLLPPVNYGENIKPEDLPRSVSIPGALRAESRSYSGLGLKFSFTIRKERAVNPAFAISWELTDYHENCMAETSPVIQLSLPDPTLDKWRLLRFKIQVHCPCRQDSRLFVTSNVLVGSAKVNIAHLETQKTSPEMKSP

SEQ ID NO: 922411 - protein, 132 aa, Homo sapiens
MHINLTKNHNLNGRMGSRSGAVSGHLQATEGTVLHTSEQKSETLGLGICSSNIPLPLAAEDHACPRGCGLSWPQHLISQSRVFSHYVPILEDCLQPSQFASLCCAEGFISLGPYSSTLLLAPIRTSKAYQGC

SEQ ID NO: 922412 - protein, 167 aa, Homo sapiens
MVHAMALMCPSRYGCKFGTDPQGNAGGVCSRVGSFGVKLKLPLWTKAPSGKCRRCCGSVFVVAVVVFVYTVSITITITNDTTVMFAGELGLTQCSVAGCRGSCQPMGVVKVSVSVPYPSQPLVYSGTLCDKEPGARLVAQETGVRLAGASKKKGAEAEAAKEKKSRQ

SEQ ID NO: 922413 - protein, 166 aa, Homo sapiens
MDLSLKFYSHREDPENTPLTTSIRNKFVRGALASLQSSVIALLCRPDLTAETAVTELGNSHKGVIGSWVAGALNPKRQRLPDTGSELTLIPGDPKSHCGPPVRVGAHGGQVIDGVLAQICLKGDPLGPQTHPVLVSPVQEYIIETETPNSWQNSHSMGLEITVGFG

SEQ ID NO: 922414 - protein, 150 aa, Homo sapiens
MQGRADLPYPGHGSLSKGSGYHHLGENRYPRQSSRVALYLRSADCLAHVVLKKAVERKWIGGHLDGRTVRIRRLTVLGIKEKKESGENPHLEPEEHSVPQESLRGSDDRFQNILPPPAELSAHQGSVMSAPKLVYAKTAGQGKMDFTGMY

SEQ ID NO: 922415 - protein, 141 aa, Homo sapiens
MRCCSEAKSIQFGETALQGSVWVCLLWEIPLNGGFDDSSREAAVVRLMLSSVKEVNVTRLGESTGRARGLWPGKTWDASGVAGRIPGTSVRLPGPGLQGPSRWYWGEVEGTQWVGGSRRCQSLGACSSAQVPHHALLKGTS

SEQ ID NO: 922416 - protein, 174 aa, Homo sapiens
MSKTSWRPFGIQSQDNKDERTTAVREAKEEAKQKQGAFLSWSHIHRRQLVFRGFRNHCVLEQFTRQRVEIQIICHQVFGHICLLAPFHPSLPQGSPPTPSYWDVLPGPSGSCWTVIVLAPAMILHVSSGFQEKTLDDAGDMGGDTADEMGSPLRTGTGLIFNHKVQDLDFICGS

SEQ ID NO: 922417 - protein, 160 aa, Homo sapiens
MSGQLKRGFAFVTFDDHDSVDKIVIQKYHTVNDHNCEVRKALSKQEMASASSSQRGRSGSGNFGGGRGGGFSGNDNFGIGGNFSGLGGFGGSRGGGGYGGSGDGCNGFGNDGSNFGGGGSYNDFGNYNNESSNFGPMKGGNFGGRSSGPCGNGGLYFAKP

SEQ ID NO: 922418 - protein, 138 aa, Homo sapiens
MLFSSHLFSRKSPRKKAKWMQFVVERTLKARRSLLFPGEGPRRGWPSVMRSAMPRLPGERKGAQRVLNPSAPDQARSRGCYRRWYWAVGCGEVPSGQPGRLGKDNRQLATFNSLVLALSPLFPFMLLKEQQTFTDLGK

SEQ ID NO: 922419 - protein, 403 aa, Homo sapiens
MAHTKLVKIQRSEGGINTSVPYGGIYVKSIVPGRPAAKEGQILQGERWGWVLIGNSVLHGGDTWHLSFLSHFSRLHGGVPGRVLLEGNLLQPQAPGHDMTSIPFPGDRLLQVDGVILCGLTHKQAVQCLKGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPEMEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGR

SEQ ID NO: 922420 - protein, 183 aa, Homo sapiens
MTHILSDSPSSPGYRDPQCPSPFLLVSPLPPGTVPQDPLLGQPFLPLHISGSEPRMPLGSAGYTLNPSSPEPSGPSHPRQLLWDPLDQPTILSSSIMSPVTKGLWHVLLSPCPPWHPSPTNLCPRPALSLFPLLSGISSLQVGTGAAGRHGCELLSHPEGPSLPDYPVKLDPMVSPRRTKRGY

SEQ ID NO: 922421 - protein, 142 aa, Homo sapiens
MRRHSKEEASMRKQAFTRHQDCQHLDLALLSLQDCEKQSSVIYKLPGLMHFLVAACTDSDSGLMWMMTVSPFRTNGREGGRKEPQRHVAIEEGPMGCKVANGESGEEPNAKKCRQTPECGKGEKKDPLEPLEMKVAFPPPRF

SEQ ID NO: 922422 - protein, 163 aa, Homo sapiens
MEEERGKEVGAQGLPCLYGDHGVEVLEDNFQEKTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRLNGSHLVAILDDCQR

SEQ ID NO: 922423 - protein, 252 aa, Homo sapiens
MGIWAGGYSLNTFMCSNDAKAKTSLSPPASVWIVPFPSTSYFQQVESKPYFHVEDYIPASLIERMTALRVQVEVSEMHRLSSALWGEDAELKFLRHQRSINIDLYDDKDIDDDDDDNDDDDDDDRVSPKNGIPDFSNTTLLRGLQMPGARGPCCGSQRHINLLMGTGVFLVKMKVTQQLPEYGVLVHQVFSEKRRPEEEMALGICAKGVIVYEVKNNSRIAMLRFQWRETGKISTYGYTFLLGKVFLIWRLH

SEQ ID NO: 922424 - protein, 134 aa, Homo sapiens
MCETPSHRVLRSALAPGVHRLPLGARSVREAEPKGELEFPHGKDVSQTGLPAFLAPAEPGRRLRFEDLCVVLLNGQHLEVKCDVESTVGAVFNAVTSFANLEELTYFGLAYMKNTEGSKKNSGSNSVYSYPHFY

SEQ ID NO: 922425 - protein, 150 aa, Homo sapiens
MVWLCPHPNIILNHSSHNSRVSCEGPSERLKFYIPERKLDLHKEMKIPEMVKMKINVHLFNAGYIITHVTGSSTVWPVSNNSLQDTWKVILASFNHWHLDSCYRLNVSLPSSYVEIYSPLCDDIRRWDIGRRLGHKRGALMSGISALIRR

SEQ ID NO: 922426 - protein, 147 aa, Homo sapiens
MAWECTILASEETDLARGSVHTNHEIHRNGKPNSFPAPEVDADILNQSPDAIPLMMMINLSRGSEEKETRCPAVGPSHKRKLMLRMKSGAMEIIWGPETKMGEGETMWPQMTKQVRNRACLDAQVPDVCFKWFFVSLSITKDLMKAD

SEQ ID NO: 922427 - protein, 167 aa, Homo sapiens
MWPIQPTQFNIVEVGKAPEVYQSSYILHCKGPDGQPATIQPIITSVPINLCGRDLLQQWGAQVLIAEQLYSPQSRHMMHEMGHVPGQNQESIWIPSRLLKPYHKPDAKEEALGVSQGSPSCSHVEIDNPNCHEQHPSNTATHLGTDQEAVTDGGRKPEESRTTTHYE

SEQ ID NO: 922428 - protein, 150 aa, Homo sapiens
MVPQSPNQAWENAYNFVWCPSLSVSPSFSPSWRQGFGGTKCSPLAWLHGSPVERRPHYKAVCDQHYGNDPAKSYRSSLKKEIPGSCGKYGMRKFLGGEIGFTVSKKKIGVVTQSSGKVQLHPASHVLDSTQEDEKAIHVDFYQLRYLQAQ

SEQ ID NO: 922429 - protein, 398 aa, Homo sapiens
MNLPRAERLRSTPQRSLRDSDGEDGKIDVLGEEEDEDEVEDEEEEASQQFLEQSLQPGLQVARWGGVALPREHIEGGGGPSDPSEFGTEFRAPPRSAAASEDARQPAKPPYSYIALITMAILQSPHKRLTLSGICAFISGRFPYYRRKFPAWQNSIRHNLSLNDCFVKIPREPGRPGKGNYWSLDPASQDMFDNGSFLRRRKRFQRHQLTPGAHLPHPFPLPAAHAALHNPRPGPLLGAPAPPQPVPGAYPNTAPGRRPYALLHPHPPRYLLLSAPAYAGAPKKAEGADLATPAPFPIESIMQGVRGAGTGAAQSLSRPAWSYCHMLQRPSSLSTILQQQQRHQEEVCANGCAPTKGAVLGGHLSAASALLRYQSVAKGSGLTSLPPLWPERGPHQFF

SEQ ID NO: 922430 - protein, 137 aa, Homo sapiens
MPRHIPALGLVLLLFPLPRSCSPCPSLPECSRVREKGRTSPYSYRDIAYGPPSGVCCDRNHLSCITADTGLDITASEDGGEICKILLQFLSGVHLIMNENATLSHNHDTCCQRGRATCEHRPCSCQAVWEQAGDSGE

SEQ ID NO: 922431 - protein, 535 aa, Homo sapiens
MAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKDQPPKAS

SEQ ID NO: 922432 - protein, 126 aa, Homo sapiens
MAQVEPRLMETYYGQVLKRSADLQTNGCVTTARPVPKHIREALQNVHEEVALRYYGCGLVIPEHLENCWILDLGSGSGRDCYVLSQLVGEKGHVTGIDMTKGQVNLELTSFIITLFAVSNYTQQIT

SEQ ID NO: 922433 - protein, 181 aa, Homo sapiens
MSDFDYFSEMMNHMGGEEDVDLADGADDHSQDSDDEKMPDLEKEFQGKLVVVASKQQRTEQKSWRPRVRNRSLTEMMATGTPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 922434 - protein, 502 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKISECQAGPWGWGWIPQELLEGEEGWAGEISTLCDMLATHNGQSIDISFPVFVAVTNVISLICFNTSYKNGDPELNVIQNYNEGIIDNLSKDSLVDLVPWLKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 922435 - protein, 156 aa, Homo sapiens
MANLSQGGLADKEQKQKGSSQLKEDFLVRELVSSEAGLEGCLGFADAGMQEKREWLWPTGTGEFTEILTSRELPSGNWQNSGGLVPVVFLNTAGSPSHGCKKVLQDLRSKLLPVCHSTLPQLRSLSSWSRRYAELKSSRAWFGYGRGGKVKETKNV

SEQ ID NO: 922436 - protein, 193 aa, Homo sapiens
MIRTTWGKRVCQDLFLVESNQKLEETRGETGGCRPQKHASWTQSRVERVKNKCTKYNHKFTHLCVSFPAVFWGDIALDEDDLKLFHIDKARDWTKQTVGATGHSTAREEMILLQLDEYPEGQELAANTRQLQGVCGLEEQASESSPDTTAMDTGTKEAGKEALKSVDVSGAGVLLAKGMEGRHLVVRNSIALR

SEQ ID NO: 922437 - protein, 227 aa, Homo sapiens
MVWTLCQRETVSFVGFSRRFITTKSSRTIFGGNFCIGSLGGKCLTWFSKGLTQCCVTGQEYNFLKMEAGEVSSLGETYDFDSIMHYARNTFSRGVFLDTILPRQDDNGVRPTIGQRVRLSQGDIAQARKLYKCPGPTCAFVSQKTSICLLHFSPTCSEGFGWQRACGETLQDTTGNFSAPGFPNGYPSYSHCVWRISVTPGEKGGMFSTLLQGTYCYIHYLDKEFEA

SEQ ID NO: 922438 - protein, 239 aa, Homo sapiens
MNEDNKSSLNGSVFFWLANYSENPPKLHTCLSKSQVPCGNDVTYLFLADLAIQGVTHFPVLRGGHCNGFHQPAGLEMSHRNDGHGDGWSSGTHVLHPTPAGDIGCITGSRSVFVCLLSFCRGKCNLEFLGVHRTFGRFMTATRCCEAPALVRPQLPSEDQKVPKYPRTRSELCGKAPVKGCGKDSLRYSVDSLSTGRIGLLQPLSTPPYNPSSSYKVTVHNCLGTTELVFSLPLFQDDL

SEQ ID NO: 922439 - protein, 157 aa, Homo sapiens
MPFYKITKERLARPSQGCEGGFCIVPQTVGLKPKSRMDLASVEMAKQFTSWVLQSLPPVDLSLCHWHKRKQPFPIHRPLSDSPDTLGNCAGTAAPRTGGLTLTFTETDSVSGNGQKGTKAGAQGSPERVCDLGIVILPPWPPFCRQWNGIDNCESAF

SEQ ID NO: 922440 - protein, 136 aa, Homo sapiens
MTWMSMSRYSCSQAMGTEFHCSLEVVFRTCFTFVRGTGPGCGKNIIKTFDLIHQRARGCKEWGQVGYLTQMKTRSAEIPGIEPGPNANEAKQNKTKTMIEKGQRYRSIGQNIGCRNRPAHTWLIDFFDKGAKAIPW

SEQ ID NO: 922441 - protein, 152 aa, Homo sapiens
MWLPPSHHTKCSSLGGNRSFLDPWKNQLSKLPSLWCSQRLFSKEVWDSCRYLGKDSSGYSKSKVQSSDPQANQGAWSTVVKGRWQKMRAGTCGTRPRTEGPSGYHEERRGQEWKQREQRGGECNHPGPWSSESGKVEDVEGALRMADCEFRG

SEQ ID NO: 922442 - protein, 155 aa, Homo sapiens
MGTAAPCPEVSTATQLIAFDGGRRGKFQELRTPKLLLGTSNPTHPKASAPPAISRLVPDTGVLSLRSDPMHRHLVATNACLQDDSAANRGADPDPSPHRLRANKTCWVEAGEGQQPSGTMPFSGMPLPQLLLMHPLCDDVGSWPLSPAGLCVLQA

SEQ ID NO: 922443 - protein, 380 aa, Homo sapiens; identical to SEQ ID NO: 915729

SEQ ID NO: 922444 - protein, 132 aa, Homo sapiens
MNIHIQVFEFLFSILVDGVPGASGHQVSRNNSSQKMLFLWCITEARGAKPIHANTFKTLAAITAISLAKTSHPFKDHESISGINYSPRGTFSEMDSRLEKSPAGDVFLQCLGLCSPSEWLELSIKNSDFREE

SEQ ID NO: 922445 - protein, 138 aa, Homo sapiens
MAASGTNRSERGLFLLYPPQSNPGLSFLLPTCYHSAVVPAWLQGASSYIIDLPKGWELVGEVHSGAHSNLRWLGGGRSRPSSSGSPRDWLSMFSDTYQSGPANLCSSGISASLVAVNVPWESHRTPLLLSVMGVIDPT

SEQ ID NO: 922446 - protein, 132 aa, Homo sapiens
MLEEFGGQSDWKGKEGNLENMTRRREHHVYVEAEIEVKLPQAKEVRLLAPTARRVTWNSNVIIPRAWPEFRGISDAVAHASELASHSPRVTSTPRQLSGAPCFVGQTPTGHPDLASCLLGCGSGITLGPRER

SEQ ID NO: 922447 - protein, 136 aa, Homo sapiens
MLRQLALSPGTFNPERDRKRNLLQNLGELINPQFAVYDGKNFEVLPNPKGVYGFKEVAGISNISTRGCHVDITSPASPARLTVALWGTVLRRILKPKLINKVSQWETVGRAPTNFQGVGKIYVDMVSFCVPTRISY

SEQ ID NO: 922448 - protein, 153 aa, Homo sapiens
MQEGAEGEAELQCSPNKCLSHPPSDLELGWPSELSEGWVVIHPHPHFLERQRDLTTKASTTGFCRCESQICHWLAGKPWSHLQTLPNVPWRTKSPPVENHFSRVIAPKCMSSPISPLAGPISALAGTWQFNSCTRSRKQQYDAVGCGWRAGGA

SEQ ID NO: 922449 - protein, 183 aa, Homo sapiens
MVEWPSQKGWQTSDGQISDKQILMGNPQLGWQTGRPPWVAFRWADLTEQLSDGQTSMGRAQMGRFQPPGWPFSRSGILRAMDIKRRSSAGSTGQVPVNTFVEDTEFRSKLQPSFPLHSSSCSSIHTVIQVSHLDIFFSSPPPSAPEPSGIKSCLPIRLSVTSPLPSPHCPGLGSQHLSPGLGR

SEQ ID NO: 922450 - protein, 143 aa, Homo sapiens
MSVLWFRSCCWRTTDIKHEGVFVTLSSLYGFSSESLCCFGASEHKKGQNLVAMKKAISWIPLISALSGIKSCSRPGGVQEERKGENSKNYEMDIDEARNHDPQPTNTGTENQTLHVLTHKWELNNENTWTEGGEHHTLGPVEG

SEQ ID NO: 922451 - protein, 204 aa, Homo sapiens [sequence omitted]

SEQ ID NO: 922452 - protein, 158 aa, Homo sapiens
MSRKVKSAGSLLKFLLAYVSVDVSFLMNISFIFLRSGGNEEVKKEGMGRGGREEGREEGEMERERRIKRGRKEERRERKRKKEKKRKERKRKKRKKERKKERKKERERKKERKKERKKERKKERKKKREREREGRKERRRQGGREEGRKKGERMKEKE

SEQ ID NO: 922453 - protein, 353 aa, Homo sapiens
MRETKWSLLQEQKMAQSNMYMLESYINNLRRQLETLGQEKLKLEAELGNMQGLVEDFKNKYEDEINKGTELENEFVLIKKDVDEAYINKVELESRLEGLTEINFLRQLYEEEIRDLQSQISDTSVALSMDNSHSLDMESIIAEVKMQYEEIANHSRAEAENMDQIKYKELQTLPGKHEDHLRSTKTEISEMNRNISRSQAEIEGLKGQKASLEAAIANAEQRGELAVKEANTKVSELEAALQRVKQDMARQRREYQELMNERQAGPGHRDRHLQEAAGGRGEPVGVWDAEGDLSSACGGLTSPGLSYAMGCSFGSGAGSNSFSRTSSPRAVVVRKIETRDGKLVSESSDVLPK

SEQ ID NO: 922454 - protein, 183 aa, Homo sapiens
MSTHIRKYRGTEALLMERQLLPLLPPLASPSCCWEPEATAIRIPGEGLSNQPTADGPGGQCRPGDTMGDGMARSCSQGPWNRPGGKTGGSRPKTALGLVCSRSQRNDHPCFWATRKKRGSEDTGSSALHQRRQTGRRWLGFGEGSSEHSRAQAGSSGQDTAVGKRLGGSGGSETVLAGTQQEG

SEQ ID NO: 922455 - protein, 321 aa, Homo sapiens
MNQTLNSSGTVESALNYSRGSTVHTAYLVLSSLAMFTCLCGMAGNSMVIWLLGFRMHRNPFCIYILNLAAADLLFLFSMASTLSLETQPLVNTTDKVHELMKRLMYFAYTVGLSLLTAISTQRCLSVLFPIWFKCHRPRHLSAWVCGLLWTLCLLMNGLTSSFCSKFLKFNEDRCFRVDMVQAALIMGVLTPVMTLSSLTLFVWVRRSSQQWRRQPTRLFVVVLASVLVFLICSLPLSIYWFVLYWLSLPPEMQVLCFSLSRLSSSVSSSANPVIYFLVGSRRSHRLPTRSLGTVLQQALREEPELEGGETPTVGTNEMGA

SEQ ID NO: 922456 - protein, 142 aa, Homo sapiens
MDPMAPECPSAINLPHLLTGAICAAQMAEHRLPALDASPTLLFSGYTYRKALQTIRIGTMSVPVITSPSLSSLNPPSRGPRCPSLFPRTPVTSLSVTQELKGGHLAQQGPSSCPRPWVSVPAAQSLCLAGDEMYLFPIRLPP

SEQ ID NO: 922457 - protein, 141 aa, Homo sapiens
MLTLRPEGEGGGGCSRNPQESVPGSRTAAGAVTPSVLVGSGVDGSEPTLHPVVPQHVIVCHEKVIPVSKNCSLLRMMGNLARQRIQWVQANGSIAFVKTKLLDQKQCVGNTLMICKVPYAHGWWFWQKHCRQGRQIHIQNK

SEQ ID NO: 922458 - protein, 303 aa, Homo sapiens
MWYLGLAVYSATNVELVTRTRTEHLSDQDKSRSKGKPSSHPFSVAGKTPFQSFLGMAQQHSSHTGAPVQQAASPTNPTAISPEEYFDPNFSLESRNIGRPIEMSSKVQRPDELVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQATVYEEQLQLERTPPAPGPPSFEEQLRLALELSSREQEERERRGQQEEEDLQRILQLSLTEH

SEQ ID NO: 922459 - protein, 193 aa, Homo sapiens
MTVIQLGLLPVIQDDTTEEEEEERRRRRRRRRRQKKKRKKKRKKKKTKKKKEEEEEEEKEEEEEEEEEEEGEGGEGEGEGEEEEEEEEEEEEEEEEEEEGEEEGEEEEEEKKKKKKRRRRRRRRRRRRRRRRRKRKKERKKERKKERKKERKKERERKKKKCQEQQSSKIADITRHRHQVWKNLGSDYSSTTH

SEQ ID NO: 922460 - protein, 135 aa, Homo sapiens
MTNNGSVTSCETVHSLKEGTVSYVISYLKKQAPCLVLDRDRNQDVLHEFSDPDYRSMGVLSGGICDGQDLWPNHNSRNGVDEPGPADGGPSGLQEPSRNHCFWMTLCTELGKELAPMPGMVSPKTSCLNCEEKTP

SEQ ID NO: 922461 - protein, 135 aa, Homo sapiens
MKIRSQGTAQSEFSTGIFQHNLEVRAVLGSQRLGEANSGQGREGGGHEGDTASQKHSNKQRTGKSEQQQVRRNPRVGGLLLDASLICGTVCSEVHRDELPWLECSGVISAHCNHCLLGSSHSLVSASGVAETTGM

SEQ ID NO: 922462 - protein, 175 aa, Homo sapiens
MAHVYIGEVIPSLCGKHPKYTRGTARKASASFLCIRVHGSHSGSSQLVGIGAVASERREVIVPTSAADLGVLGPKPASCCSAPAEPRKGVSDLLPVGAVPCDLESVLILSSRAFVPCDLESVLILSSRAFVPCDLESVLILSARAFDRWQCPVPMDLLFSASPTSNKVSRAGKCF

SEQ ID NO: 922463 - protein, 138 aa, Homo sapiens
MRFDSPSSYTSRKCSKEKHSKVCKAAYTKKSSSKSCLFMQSDRRMSVINHVEVLYEYLLQRRNIRRLRVCLLQTASTVYDNNVDHLIKGHPEGHYSCSVARISFKLSDCLLTAICNKLLTFALPPEQLPARVECMENR

SEQ ID NO: 922464 - protein, 146 aa, Homo sapiens
MLLICSSPPAILSPLTTADESYIVNSQFPTMAPSRAGLWAACWIKLFLNAVASPKLELQSPLKTLEITAPGMEFQRQQRSETNSYVVTSFPSVTETINSKFAVLVVQGLPDNSLALGFLVWTLATGEPTDNAEELTGKLLLLYSQA

SEQ ID NO: 922465 - protein, 153 aa, Homo sapiens
MSSLKSNAITNECVAKQTVCELPQRARCGQVAMGVSEMGRCFGGQKSSMIMPLHHISIPDTSFSNQGACTILINFLSWTKKLVLKGGSENIARCSLEDRAKAEGVCFTSLSDSDCQGPTVAPCCGGGSICYRAHFTRKGPSPPPRSQPTIHLI

SEQ ID NO: 922466 - protein, 154 aa, Homo sapiens
MLRPHEGTEGIGNVLFRDQRGLVQRSHCSGVTLKPFPCETETFHPKATTLLVSPVLFSSCVSLFTVKLMATFKMTGAAESLIFRLAWCYAAVADLQGEIYRTFSSCKTENLYPLNNHSPSPSSPELLEATIPFCVYDFNYSRNLSWKHIVFVLL

SEQ ID NO: 922467 - protein, 141 aa, Homo sapiens
MQNRPRFDQFCYWFLKSSKTMHLLFAHICRVFPCLPLCAMLSLPKRLYSLYAHSHLIPSEVLPVPCMGQGGSQEQEASMQLRSLEQLLCSHPLSRGHHILIVGPRIRRSMMQATCSGFTAQNRGPVNPQPLINVRNKCLLL

SEQ ID NO: 922468 - protein, 152 aa, Homo sapiens
MSSSPLSPLVSSIKRPLSFPQCADASLPALTIRHLGVWKESTEFPWKPGLTDGPSLGRVPGIEDEASALRSSECAVSTEVSPDIQVKADLGPINLRQFTEKMFSLDLMFPDVNCRAADSNQRKFLVRLLGGLCRSRGVRCTCWSSAWIRPEF

SEQ ID NO: 922469 - protein, 157 aa, Homo sapiens
MTPLTWCPHGFTALTLLFFLFYRSPGTSFALVVQYSVSPPVKLICTLKGPTVPDAGTQACARTLPAPGSQMPQASVCGAQVEVWRLRQGTVKDDDQHTTQNTQTELDSLLPTLKEMALLAAIASLKRVRGRRVTSSADTVCRHSTVIGSQEHSCRSA

SEQ ID NO: 922470 - protein, 162 aa, Homo sapiens
MALQRTDSLWLQRVFARRCASLRDTQINTLIWSLRNSEPSGGSREENYVSPCVIPMQQEVSVCQAESACSYWSLSAALPNTSSNKPMAIGLKSFVFKLQLFGVCHVLPWEMKVCVQGSLTGNTICSVCPTIFTVPFCVSLKIHCKPLRNLPSFSISPLNFLS

SEQ ID NO: 922471 - protein, 134 aa, Homo sapiens
MVGLPIRLSRISFQNLDEAGLCSARLSPTGIGFLGPQILCSTNGHTYLQQTRFQVQLSPLFSTVPIFRSSSFEKAKGYSSTYPVAPSETLTTVFQAQFNRTGIWAADPGIANVILEPATSVFLGWCRRKCGFCH

SEQ ID NO: 922472 - protein, 215 aa, Homo sapiens
MSLGFKVSWALGHHSCEPHFISFLRASLQDELQWLSLVLGLTTHSLSGAFTSPHPVFALVQMLLHTQNNTRATRMQHACTPPRGSSTCVHSTQGQLNTRALHPGAAQHACTPPRGSSTRVHSTQGKLNTRALHPGAAQHACTPPRGSSTRVHSTQGQLNTRALHPGAAQHVCTPPRGSSTCVHSTQGKLNMRALHPGAAQHACSPPRDSSCETRV

SEQ ID NO: 922473 - protein, 141 aa, Homo sapiens
MRGPEKGLIPPQTQKNALGKSAETIALFPLQFAVINFMEESTSHRGQDTVGTARLSSTDIPEKEISALNIRRKKKKKKKKKKKKKKKKKKKKKKKPEKKKEKEKKKENRMVKETQELTRKLQNLIGHLKKKYTALGKVLRA

SEQ ID NO: 922474 - protein, 156 aa, Homo sapiens
MEKKHPMQKQKKEKDKKKRKKKKKKKKKKKKKKKKKKKKRKKKKKKKKKKTEHAGALCRQTPGRTRLRAELLRYCLQQSSMSLPVRRIGISKEGHEGDLSPHFPISPSSSLGIREHILDGEAPPGTAWLGGTAIPARSRVVIVTCSLPPPPPGSGR

SEQ ID NO: 922475 - protein, 138 aa, Homo sapiens
MRTRTLQAAASQKSCVPPGFSGPLNIPELHPCQGGASTGLQAESPDSSGNSHCAEPGARVKRAPTEALGPTRFHLLDISEKKELYLSCKGNTGYSYHKCREGFQTGLKLHETSPRLCADSWPTLEPRLLLPGLLVNPP

SEQ ID NO: 922476 - protein, 178 aa, Homo sapiens
MQAQSKRPARCKGKATKAIASIPFTLHGEENILHEHHSMDKEGEYLYFIHCELLYPKQSLNKICVENYRSIVVITAPLYASDDFDICVLSVLLFEESLCHVNEDLPVFFIMPKILGLAQNCLVFKFQVPTSLPRVVVSKITLFAKPLRHCSEISGVCATSVRTGKWAIAQFSSQALCR

SEQ ID NO: 922477 - protein, 209 aa, Homo sapiens
MDAPPEYTFRCECVHHGRSPRIHIQVSKVEREKNQELRQVREHEQHKTAVLLTELKTKLHEEKMKELQAVRETLLRQHEAELLRVIKIKDNENQRLQALLSALRDGGPEKVKTVLLSEAKEEAKKGFEVEKVKMQQEISELKGAKRQVEEALTLVIQADKIKAAEIRSVYHLHQEEITRIKKECEREIRRLPHIDVTLATQGPGPNQHS

SEQ ID NO: 922478 - protein, 187 aa, Homo sapiens
MIKIVNHGQVWWLMPGIPALWEAQDPGSMGCVLGAAAPDGHSGPPFQVARHSSCSSALSKHFLDTSPGPGIVDLPGVARCSWVCVSPVPVDILLLTQGPHPPLRVGGVRSCVSPPSRPAPRRLAVYGAVRPHRATSFQCTELSVPHPTPRPLRAECPLMELCVPPPRHELSVHRTVCSPPPAPPPAS

SEQ ID NO: 922479 - protein, 239 aa, Homo sapiens
MTVSAGRWPWWEQAGQPTWHSLPAPRPLWVPLVAQDPTPALSNPHSSGAQTCSFLTCCMWPASKVASSRGHLGGTQPHPGPKARVRSGGCRNAKGRCWWSKDVPRRVDQEERVRGSLRRSIWVASCERRRGSPAARRFLSVAPWAAAFLNIWNMLTPFFLDLFLRRWSLSFLFRDSLALWTLGFRSLARRRPLLSTVGRPESRKSVPVTGGYLLPDSGKMAVRWKVPGILWDPCPTPQQ

SEQ ID NO: 922480 - protein, 140 aa, Homo sapiens
MKVSPAASPACAVPQHQTWALGKQGWFLFVPAPCGKFQNSPSERPKPFYFKGALPSSLSHSEEITEVQNKEEIDKEGIVTKHCPHKKVCQSQQCFTLNVLCLKCRILGYLEPEKTSWPGDADSIKTSLGSSNHYFKVSSW

SEQ ID NO: 922481 - protein, 146 aa, Homo sapiens
MKIFPWHVRGLHGSPSHHSPRGLEGKDGFMGQAQGPHAVCTASQPLQLWLRGANRGQCRAWVVASVGASPKPWQLPCGVEPPVKAAKREAVPCKATGVKLTKTMGIHLLHQHDLYVRHGVKDHFGALRFDCPTGFWTCIGPVAPLF

SEQ ID NO: 922482 - protein, 136 aa, Homo sapiens
MSFSGGEIAKPKILIDLITAISKLRPWVRTFLSGAVCSGKQEEQVHSKVERKVQRFPIYPRLHTHTASPMANIPHQTGTFVTIDDPTLTHHKTQSLSFTLGFTLSGVRSVGLDKRMMTCIHHYCTIQNSFTALNTL

SEQ ID NO: 922483 - protein, 151 aa, Homo sapiens
MNDQEHHLVLKVQPPHVKMHSPGPRSHVGALKFAQRKGAGRVVHICNLPEGSCTENDVINLGLPFGKVTNYILMKSTNQAFLEMAYTEAAQAMVQYYQEKSAVINGEKLLIRMSKRYKELQLKGPFCLRPTGLNPPSRLKLEDKGLVDVSG

SEQ ID NO: 922484 - protein, 141 aa, Homo sapiens
MEACGFCSPSLSQIISAQSQEGLHILGKRNSPGGLLLVGIPLNGLNSLALMLQTEKQPCRPPLAQDAGTLLLNLWGVSPGAAQEAVSQAQDMVTWFVSWPVGVSAEGVPMGLFLRFGISVQGYQASHGRVMPISGILRKRG

SEQ ID NO: 922485 - protein, 237 aa, Homo sapiens
MHTNPMYVVYAPCKAWKSRKWSFFPVGADILLLNGSPYPHLAPTVWEMLERNKRKCPLKIELPGMREASGLEEFWKVTKIEERGCEEAAWQRVMGLAVVLEMSDQVTSASAISGAPALAFSTRGMQTAAALPPFLWLFLPSAVCAQLASTHQAEDDVCIKVLPAVANESAIVYPPLTGYTWVFEGWAGIWFHGQLHVKLLPVPDTGLSCLDRTWTTPLLFFSSLLISSCKAFSSRCG

SEQ ID NO: 922486 - protein, 161 aa, Homo sapiens [sequence omitted]

SEQ ID NO: 922487 - protein, 288 aa, Homo sapiens
MADFSTFPLTLPGRVLLCAAGGTFEVDQTVPIEVHVLEDLVHLPLAEALPQQGLEGRPELAHADAAVPIAPHSRQTRSLPAFSPSAALFRKASRSSRTPIMSAVSASSLGPISSTKSSKSTFPPPGGPRRQGRLAQFPMGPEPCQAWNPGGGPGGPRRMLLPEDSCQPPAAPDESLGDPSWALGSSPRGSPNCLHLAPPAWTGAPPLDEEQKGTAYVLWAVTGLGCLHLGLELPEKLSSPGGCWGSRGLAGSWSASEGLGSRWEAALCWALGLGHGDEGLLNLELGTW

SEQ ID NO: 922488 - protein, 134 aa, Homo sapiens
MVPLGVAQALRALEFYLVFVVLHLGDKLYLQNLSVLVRGPHPRLLQTQPGDRSAATLTSEAAAWSSDSAGWQHQTTVLGASLRQRSQRKEQAAIFVVLQPPLVTPPGVGGTQMHRIWSGPPANCSHPMEEGPEW

SEQ ID NO: 922489 - protein, 151 aa, Homo sapiens
MLLASLFPQLADAYWETSPCNPLPCHEDTQAALWRGPHGKALGLLPTAGEQLPCEEVILEMDPATQWSLQMTMQCGLLNLISQREGGFECDSKPVQYSKSYQRVQSWERGGEEQGHPEGSVTKDWAAAEACSVGRGSRKEPKSPKVKMMYR

SEQ ID NO: 922490 - protein, 148 aa, Homo sapiens
MFRPTERGQRAWMDLNIWIVLAAAVGSGKPAGRCGRRGWSDCGMMSGKWKLCLPTPSEEQESQSESQNLKSREADSAAFSLWPKAREPLANHWCGDKWNQALDDIRNIMEQKATDLPPWIDAPNKHLPTDPFPRKVRDQLRDTYPPDK

SEQ ID NO: 922491 - protein, 144 aa, Homo sapiens
MELSWLSQVIPESSPEYFEFLVLSHTIGHTPHVFKITLSSKEFPKITLYNPSTELMVLKTVFCEELPKSPGCTAGNLEVFATSSALCWMDRRLLTKWPTNSRKTKLCQIIVSSAVQEEKLIYKTMRLHSGCQNLQLHCTEGLHE

SEQ ID NO: 922492 - protein, 157 aa, Homo sapiens
MPPKFDPNKIKVVYLRCTGGEVGATSALAPKIGPLGLSPKKVGDDIAKATGDWKGLRITVKLTIQNRQAQIEVVPSASALTIKALKEPPRDGKKQRNIKHSGNITFDEIIKVARQMRHRSLARELSGTIKEILGTAQSVGCNVDGRHSHDIIDDINR

SEQ ID NO: 922493 - protein, 134 aa, Homo sapiens
MRSLATWLHVVSEDHEEQFASSWLGQQFTITLSPQNFINLLILCHNLICRNLGCLSIHQAMTPIECFDDTKLIGSDEQELVSTVSISATTCYQGLSYTSHSSWNEPLFAIRTIWKAQKRESVYSAHGFPFSESH

SEQ ID NO: 922494 - protein, 150 aa, Homo sapiens
MPKAHTLLRPEVDPEPGRIQWGALHGQQVKPLGDAQGSKGDIIDGKAAPLGLWGTLVGSLEALKDSYNCGSCERAAVVDPHTGQKVYSESLLCRMSAAARCNRNDGWEPTDVPPTWHQQPGPLKATVHLGPHPANINTPHHISVDVWRKC

SEQ ID NO: 922495 - protein, 137 aa, Homo sapiens
MKVAKGSFGLFLSLYLSENTFFSERYNSKGKFDSHCQCLQQSVCVPGYLRLGSGDDSQRACCLQASVQQSTSCTALNPSNPEWTQHMFQRAQGWGMKLAGGKCHAGMCSLTGDSWLERRKSETSLTSLLWKLPPECL

SEQ ID NO: 922496 - protein, 757 aa, Homo sapiens
MLTIINQLQGVIYPETLKLEGKGPELVGPSKSKPRGPSPLPVGQMPVTLQPQTQVRENKTQLPVAYQYWPPAKLQYRPPPESQYGYPGTLPAPQGRAPYPQPPTSRLNHTAPPSRQGSELHEIIDKSRKEGDTEAWQFPVTLEPIPPGEGAQEGEPLTVEARYKSFSIKMLKDMKEGVKHYGPNSPYMRTLLDSIAHGHHRLIPYDWEILAKSSLSPSQFLQFKTWWIDGAQEQQVRAICLRAWEKIQDPGTACPSFHTVRQGLKEPYPDFVARFQDVAQKSIADEKARKVIVELMAYENANPECQSAIKPLKGKVSTGSDVISEKRAKGPASGPTTNWGIPNSALCSSGFSGTTTPTVPSTSGNKPVTTIQQLSPATSGSAAVDLCTIQAVSLLPGEPPQKIPTGLYGLLPEGTVGLILGRSSINLKGVQIHTCVVDSDYKGKIQLVISSSIPWSATPGDRIFPFLLLPYIKVGNSEIKRTGGFGSTVPTGKAAYWASQISENRPVCKAIIQGKQFEGLVDTGADVSIIALNQWPKNWPKQKAVTGLVGVGTASEVYQSTEILHCLGPDNQESTVQPMITSTPLNLWGQDLLQQWGVEITMPAPLYSPTSQKIMTKMGYIPGKGLGKNEDGIKVPVEAKINQEREGIRVSLLGAATVEPPKPIPLTWKTEKPVWVNQWPLPKQKLEALHSLANEQFKKGHIEPSFSPWNSPVFVIQKKSSKWCMLTDLRAVNAVNQPMGPLQPGLPSLAMIPKTGL

SEQ ID NO: 922497 - protein, 260 aa, Homo sapiens
MNKMMMSEEQMKLPSTNKAEPLTWAQLNKLTQLATKCLENTKMTQTPESMLLAALMIVSTVVSLPMPAGAAAANYTYWAYVPFPPLIWAVTWMDNPIEVYVNESVCVPGPTDDRCPAKPEEEVMMINISTGYRYPPICLGRAPGCLMPAVQNWLVEGPTVSPISRIISYMVSGMSLRPRVNYLQDFSYQRSLKFRPKGKPCPKEIPKGSKNTEVLVWEECVANSAVILQNNEFGTIIDWAPWVNSTMIAQGKLSRVPVHK

SEQ ID NO: 922498 - protein, 151 aa, Homo sapiens
MTAGDLFNVHQYSSVLPKLCFFWSINTLHFPAFVATSTAIFKNPVEIHLEDFKNWERFSSGWDGLSVMLLEFGANGHKIFPGPFFELPELYTLIPVILTWEWFGFPTPPRRHLAISEVSYNVQDSPYNKELSVPKCQQAKFEKYCLMLTSF

SEQ ID NO: 922499 - protein, 136 aa, Homo sapiens
MLCICQRRGRCAREVVGRDSGKADAIRGYGLEQKGNKADPSKCGVLSEKSPKQPVHPRQRENIVKSGYAEKISSNTIKVIVIIMLIVIIITSVKINQTPEISQKPQKKIRCIDMYHTEHSITPACKKTAKRKGMLV

SEQ ID NO: 922500 - protein, 134 aa, Homo sapiens
MGDTWYFPTAKRRTQASAQIGQEQTTPLPSAKLLAYPESIAALSRGDLRVHPRKGGNFNAQKKYYYSCEKEARDMGLCFPVILATDDDYCPGMENVICRRNKSQTYDVSTNDFHFDFENTTKSLEWKVKISKKF

SEQ ID NO: 922501 - protein, 151 aa, Homo sapiens
MSTKQVPVFYDDICGPKLGTQHSTSVPEIAKYLAEKLIRPTNLHGSKCLSYNLASAFSNQLLLVLPADFWANPKRGKKQNRILILAANRFKPALTSASNEFGCLLGLSNIGKFPRRVEEFQDVFSTASPINLDFIMNHNQEDRPVNLLPCD

SEQ ID NO: 922502 - protein, 174 aa, Homo sapiens
MDLWAADRERPSIESQRCCEEERRGEERRGEEKRGEERRGEERTGEERTGEERRQKRREKASKQGFESLQNLLIEMQGELGYPSAISTEAKESELITLKRSVDVAFIKYSDIQEQADKTTQLQTGATFHEKGKMIPRMESQAPGGDPRAWENYSAILKSNQETSICSDAFWNCL

SEQ ID NO: 922503 - protein, 162 aa, Homo sapiens
MLSLLFLCTLHPSLSSLSFGLTLTPIKLSKLPRLYCCKGSQTAPITSIKPKFLPHLPNRHTPAKAGFAIVQATSPPLRTSHFFSIVEIYPQGNNFSVFHLLFYYSSGIIQASSLPHTSSSRNCPTQDWQISFTPHALSQKTNISLGLGRHFHWIGTSLSYRV

SEQ ID NO: 922504 - protein, 165 aa, Homo sapiens
MPPWGTVILSVVPFSAIPREQGQNSKPCSNALNRSTALSGNLNVVPNNTRLTLDYRKWLPYAGKEKQDRITLPALSTSGAPQLLKSLLVPFVMPTGLVYPFWPKKDMMTRDTDPPGMRADHPTRREVSSKLEGLFLGVHGEVYPSSAEMDEREHRGAQPGPQRRT

SEQ ID NO: 922505 - protein, 155 aa, Homo sapiens
MRHQIQTSPQLTFCDHKCIELSSLKFEKYQGFPHMLPQGPGCWTCFLTFSSPKDVDKFNLQWLSWGLSAMTCLSAHSKGAPSFGVPSLKLSVSHSGGCDQQGLAGFPEFGSAAKWVPVVGNAYLEIFYVPMQYLGLAGPELAELSWWCTLRTPLR

SEQ ID NO: 922506 - protein, 171 aa, Homo sapiens
MCEMSKFTSPSTRVGSGLWGSDGTGFRWQSHERAGPGGGSLGMKSQQEPCREMMTPWTTGECGDYSLSIADAVWTGISDRLNVSRGRDDGVQQTHEDEHCQEENSPSIVTREKEGKMGTNMEILVNVENSENGHFLRDKKDKLNRIEGPLKVSEQLFTVTPICRNCIYSVA

SEQ ID NO: 922507 - protein, 149 aa, Homo sapiens
MQCERNLCHWLMPPHPHLFPDFPYIHDILCTLHHNAFSFTSVLLHMVSPCLQNLPLSHSSIQSFYFSSKKECRHHLLQESSLIFPIILIPGWIRCWYVEFSKALPKLPNVTWVRGGEIAPGENRCHAHLEVRSARLEVPESLDFQLVMF

SEQ ID NO: 922508 - protein, 164 aa, Homo sapiens
MGLVKGPATLHSLTALEHRFPHPSCFSSSQGSKKPRAVPRGNVELEPLHRVPNGVLPTGSVERELPLSRTQNGRATISLQPQCGKATGVELPKALGTHPLHLCALDSLYPKRTLLHCYYSEAQSSQGRCFQFGFAVNCQPCRPKLEGKAPGLIQAGQSKNGMWW

SEQ ID NO: 922509 - protein, 158 aa, Homo sapiens
MNSNSRPFYKLIDQYTLKSVKIMQVKESLKTVTEVKLPTFTLSVTALNAVHLELFVPPGGFVVSLASGVKLQTFAASVTAHKGNVDPKIVQQQNLLPRAKEQTFPSVEKDPSGLPLLTPAACFYSLIWPHPHPADWSILQRADWSVLQRADWSILTGC

SEQ ID NO: 922510 - protein, 324 aa, Homo sapiens
MNNLISQESSERKVAMQQVASFPLLCFLDFWIISERLWLLGMLTSKADPKHCQEQDTQKLRGGAKQNYQRLGTDSGAQPELGTPGSLNIGESREKDKKVNSESGTRKDWDESGKRLKAKREKQGLAPSPKLECSGVITVHCSLYLPSTMVVDKNKRLTKGGKKGAKKKVVDPFSKKDWYDVNAPAMFNIRNIGKTLVTRTQGTKIASDGRVFEVSLADLQNDEVAFRKFKLITEDVQGKNCLTNFHGVDLTSDKMCSMVKKWQTMIEAHVDVKTTDGYLLRLFCVGFTKKRNNQIRKTSYAQHQQVLRNPEDLLCSVPAKSGRR

SEQ ID NO: 922511 - protein, 211 aa, Homo sapiens
MEEQWQAFSLIGSGNGCLTGSGAQRTPCQIRRGGSQRRVCEGGKQQWWMCIMAPAFASMSLPNKGVGLSGIIRKACENSKVPQSQLSGWEKYLVTACPRTPRIVTDLEDSCPGQERKTEKAAPVSRRQLTSWPLMVKHTRGLCEGDGMGWHLPPAPSVLLLDHLISYAHRRSSPASFFPHFLTTKKGVWAAGFEWSFTSVPNIAFVLRDES

SEQ ID NO: 922512 - protein, 420 aa, Homo sapiens
MHLLRGEFWQVRSAGQMLEGYGEWVFFGDDVELTVVSKSVFLNWPAYQKCRQPDCGAEILSSLVVALHDNPWVCDCRLRGLVQFVKSITLPVILVNSYLICQGPLSKAGQLFHETELSACMKPQISTPSANITIRAGQNVTLRCLAQASPSPSIAWTYPLSMWREFDVLTSSTGEDTALSELAIPAAHLVDSGNYTCMASNSIGKSNLVISLHVQPAQALHAPDSLSIPSEGNAYIDLRVVKQTVHGILLEWLAVADTSKEEWFTLYIASDEAFRKEVVHIGPGINTYAVDDLLPGTKYEACLSLEGQPPHQGQCVAFVTGRDAGGLEAREHLLHVTVVLCVVLLAVPVGAYAWAAQGPCSCSKWVLRGCLHRRKAPSCTPAAPQSKDGSFREHPAVCDDGEGHIDTEGDKEKGGTEDNS

SEQ ID NO: 922513 - protein, 166 aa, Homo sapiens
MTCLSILLNAFFGFLLSGMFPYFSVAMAAMPPLSSGQRDDKFSFRSHSKSCHAHSFPVDQSHKEEGLTWRQSLLPNFSSLANSVHSSEASGEPCSRLGKIISSSFFKTHSFFPVIFNNLGFWNIKARSHMSYFCFPLLNVSLGAVSSELVKGLFKGETRRSGKDKR

SEQ ID NO: 922514 - protein, 371 aa, Homo sapiens
MSDLLILSHSWTNDLEPGSLIDLTVGTPVTQPQTLNTMGIIGSRGGRGQVAALNRQRQGTTDTGPELTLIPEDPKHYCGPPVKVGAYGGQAHQKQFAFSWQGQQCTFTFLPQGYINSLALCHNLIRRDLDRFLLPQDITLVHYIDHIMRLDSPALTASWGVLYDQLIEEENTRDWFTGGSAPYAGTTPKWTAVALQPRSRTSLKDSSEGKSSQWAELRAVHLVAHFVWKEKWSDVRLYTDSWAVANGLAGWSGSWKKHDWKIGDKEIWGRGMWMDLSEWSKTGKIFVSHVSAHQRVTSAEEDFNNQVDKMTCAVDTTQLLSPATPAIVQWAHEQSGHGGRDGGYTWAQQQGLPLTKADLAMATAECPICQQ

SEQ ID NO: 922515 - protein, 168 aa, Homo sapiens
MLGRGGQLQGMASKQGGEETIWKHSGGCGEEDTYSCLTGRVSKIFMPELAIQRLRRPNVTLDLALLHVVKNRTKALSPPASFTAASFSGDSFGWRELPCSSLCLLSADSLQPGLVDEGVQRPEGPPSMFSRCALQRIHGNMGGKGTTGAGQCIAHFPVRLSCGAVSGN

SEQ ID NO: 922516 - protein, 140 aa, Homo sapiens
MLGAFHTQNKMLSSPQEQLVDSPLGSLMMTGGEQLRCGREQLRWVGEQPRRVESTITAKSEHRQHEKFKVANGAVQRTCLGYLKRGGSEKSSDNETMLHLTAESDSRPITSSKLIIIIIIIIIIIIIITIIFFEPMRCQD

SEQ ID NO: 922517 - protein, 135 aa, Homo sapiens
MYLVTVLRNLLSILAVCSDSPLHTPRYFFLSNLCWADIGFTSATVPKMIVDMQSHSRVTSHAGCLTQMSFLVLFACIEGMLLTVMAYDCFVAICRPLHYPVIVNPHLCVFVLVSFFLSLLDSQLHSWIVLQFTIV

SEQ ID NO: 922518 - protein, 315 aa, Homo sapiens
MGEQLELWRQQLSLGLAWGVDLGTPQKAPMWRLTERRRKAHRMLKLYNGLSEGEAVGLPAGPDPLDPTDLNGAHFDPEVYLDKLPRESPLAQLMDSETDMVQQIRALDSDMQTLVYENYDKFIPATEMTNSIKLYEELQETRNFSNKLVKEEQKVKLQTFSSPTDSGAQLASPSGFCTGAAGGAACQFLSVHPHSSALGWSMGLGAVEQGAVLVGEARAAQEPMEGGGSGMAGCRSQALPHMEAAKAQREAEHSSCWPTEGASSDLGQPRKGLPPCSHGLKGSSSATKVGAQAEEALRVSEGCEGCQHTVTSHKE

SEQ ID NO: 922519 - protein, 136 aa, Homo sapiens
MFRAEPPGESGPIRQSCHRRSPECSAKSSFFLVELSEYVLCAMEAAALSGAGQVTARPSPCLSLQVVVGCSMGLQHGTAAWDRRGSLAPAIAAPCFLCLAIAYSVPCCEDGRKCLEWCQPEGLQTGGTCWECAIRH

SEQ ID NO: 922520 - protein, 192 aa, Homo sapiens
MRGRCWKTCSHPDTLEPMAGSLGWGKWKDSVCADFLFTNRAIRLDGKLGESVITGAPGMTQANPRPRASLQCLGPVSPLVAPSDCGGHYTDEYGRIFNYAGPKTECVWIIELNPGEIVTVAIPDLKGFACGKEYVEVLDGPPGSESLDRICKAFSTFYYSSSNIITIKYSREPSHPPTFFEIYYFVDAWSTH

SEQ ID NO: 922521 - protein, 335 aa, Homo sapiens
MIREWKNDCQRIEKQRASDTMVQERKNEKPVRIFNTNSSFQDQAPTCCQEDLSSASPLRIWSKFYRSDPRIALGKYSPLEKEILRLGGIHTIAARRLLAYKQEEECRMLKELQLLSPDYKQAMEYKKKHSSPCAICVPLEKIWTAKVIAPLEAFKMPQREQVNVSKHIERMRLARALGNHQPLPYIERFTRSSFLSGVGLGPMAKNKARRKEDNYDTHNCDDANQDKKEEAEGKNTKRREIKMNVVFKSKEPKKCLTYHGNDRKSFLPAKKPERSIAGLTNRNLFCISEFPGDLMLMNQDFISRRDHFSDLVKTYSLEEESIWKERMRKATPYHY

SEQ ID NO: 922522 - protein, 311 aa, Homo sapiens
MGGSGRCLGRVEILHQGAWGTVCDDLWDLNEAKVVCRQLGCGQAVSGPGEAHFGPGSGDIFLDNLQCTRVEHYLGQCTHLGWSEHNCGHHEDASVICSDAEDLPPPTPPDSSTASQDHIKAMTLQAVMTLQAVIPKPGPICTLQAHCLPSVRLLMLRGPYRNPRNSFRPPESQIVSPWMWFGVCLYRKDGPELRLVGGSGQCSGHGEVLHKGSWGTVCDDLWDLNEAEVVCQQLGCGKAIAAPGKAHFGPGSGDILLDNIQCSGSENHLGQWPSSGWSDHNRGHHEDANVVCSGGLSFHDRFLLIFHPKTS

SEQ ID NO: 922523 - protein, 143 aa, Homo sapiens
MAHGGLCATTSGASTLPTWCASSWVVGRVLATPGNGHLVAGVGGGGVGHILLDDGQCQGMETTLGQRGYLGLSIHNCGHHEDAGLICTDTDFQLSPEAARAMTLSGGPGNQCEEVWVSLASSKQMPKVHSQHELLGQRIHNDI

SEQ ID NO: 922524 - protein, 136 aa, Homo sapiens
MTLAHESTTTKKAVVKLMARKSLILGKELPLSPQIQHVDSKPRAAVTYFLLHGYLGTFKAFAGWLVSINQCKHRRILSLDFAVLVDKEDEAQIPVCALQSPEGLALLPSSLSFAAPPHWELQTWENVAFSQPSPLC

SEQ ID NO: 922525 - protein, 141 aa, Homo sapiens
MPPKWEPRQGRCREQARALRTASTLSPLSNSTAPSLLYIVDIILTPHNNSPRSIPKRIYQNLELAYENITSREQFIKPPITPWTPFGSVLALDDRNTCQDPRWMPEITDSTESYIYTTFFLYIHTHDSLIYKLGKVRNWQQ

SEQ ID NO: 922526 - protein, 137 aa, Homo sapiens
MAKPCTFHSGLLLPLPAAFSQQWADLWNVKWPELPAQPQMQGEGNKAEWSWTAKPTTWILQCDMNLIVTNGHDGSIYTTGIGVSGPDGTNDLKEITLPDIRKSDQNTFLEKLSVYGKIEQKIKCSHMLLPPQHLPYY

SEQ ID NO: 922527 - protein, 146 aa, Homo sapiens
MAFHRRLPMVKLCFLSASTLLHYQGFSSSNNGQALHFSLRPPAASPSCLQPVSAEAPLQWADLWNVKWPELPAQPQMQGEGNKAEWSWTAKPTTWILQCDMNLIVTNGHDGSIYTTGIGVSGPDGTNDLKEITLPDIRKSDQNVSK

SEQ ID NO: 922528 - protein, 135 aa, Homo sapiens
MGSTLPRSLGLRDVRTQKTNGDASSFSPSHTLSIHWEEKVTRDTFFPSFEMGNQSSSVCTSLKCLLNHCDSFGKKKCLLSAFSSSVLSLGMGNCVPVPNIGHSPWMCPPNWEELISPTLKMLGLKLSLGEGNSEA

SEQ ID NO: 922529 - protein, 164 aa, Homo sapiens
MANTTPALFPMSHTAKEISTSCILPLSALVCPAVPTDPWTHQQEHIPSQDKQGCGANTAMTPLREQLHYAAQAAESLSVLPPNLDVSVGPDFIAIYKALTPAIVKLEESIQQQHAAGEGYISYNIPSGPQPSSGCHGMWQRAFCQQHRQPGYTLAVTSMQGFGN

SEQ ID NO: 922530 - protein, 135 aa, Homo sapiens
MSDESSKASAAPCLRLPEATLKCAPSITRASEFSRDASNLAFKYSQFLDKKQIQAIFLFEFKMGCKAAETTWNNNNAFGSGTANERTVQWWFKKFCQGDKSLEDEEHSSLPLEVDNDQLRAIIEADHPYNYTRSC

SEQ ID NO: 922531 - protein, 136 aa, Homo sapiens
MNPPACSNFQCSSSSFSGEKQNTEPVDDDAMAGHPPGAEEQSVETNLGNERPAGLKAESPGLELLKPPGFCRPGQDQMPENPHPNSATPGQFTSRNQKVFVMRVLSGGEEAGEMGWMFMEHLWSVNLKSQKLSLSS

SEQ ID NO: 922532 - protein, 153 aa, Homo sapiens
MGISHLLPELPALWTQQCNFTAGLVMGWSTAEESINFIGIYQNIYQNPEAFTPSHYASEHAFGWTETDMHPILGNLTLHSQHLPENSLYSHEKEGYPLSRLLRRYSLTRKTFSLYLPPPDLFFKQQQQMLEMGSETAGDQLSYKRVPSALAAD

SEQ ID NO: 922533 - protein, 232 aa, Homo sapiens
MTSDANIYDDDDDGVDDDNDDDGSDDGNYDFQRAKNEVLKGEATTWMVNVCPQHWPPAPGQGQRQNQSRRWMMTPRLYGYCPCNLNFQRGDRGPGREKHTEVTAASCSVATPPHLPQAISKVGQVPQSCSGVSCGKQAAFDIWVGERERQAERGVQEGKLSSEETQSGKLLRQGLGEERKAPAGICRNLGVDASWLLDAGWGWEPVSVALMGRREPEGWKISRHLVAVTWVT

SEQ ID NO: 922534 - protein, 143 aa, Homo sapiens
MTQAQASSSHDPRAPGSPSRLRLLCPFIRNLSSEEIDLQPNPAAAMGKKQQGFSQKQISGATTAWGLFRKGHLGWAWEGSPSGSADWKNKCDALKPRQIQLPNLVSLPFTFSLCLSPFPPLPSRARCSSPLPCCQLQDAATNK

SEQ ID NO: 922535 - protein, 139 aa, Homo sapiens
MIFAVTLAAPKKAFVEASHWKGGSQAEADMRKPPWAMTLGHLQAPCFKHSRNLFGKRVTEDFKYKNNWVRLEFFSQAIPGHRGDGWVEKELKKTAREGHQLQNGRQVEEQFGEVHIAPGKLDSASLIITWRTEEESPSN

SEQ ID NO: 922536 - protein, 189 aa, Homo sapiens
MEHSHHLNCNLTNLTRTLAELDSFPLSSLTHLTNLVNKSPLQQDNGGNADTAKPAPDGEKCSGCRLGWGVCSVGRVGTDKWKTFFPALYQVVAEMGTVLHLWGAMATQVGSHHRLGSKKVPRSFPLLEEHEGGQKRGDGTVNWGLEDDKDMSLTGWTGMMTGPPRIIYENQISSLKVECGPKYPEAPAL

SEQ ID NO: 922537 - protein, 424 aa, Homo sapiens
MRMQEGTGLQEGTQMQEGTGLQEGTQMQEGTGLQEGTGLQEGTQMKEGAGLREGMQIKEGAGLREETWMWEGTRMQEGMRTQEGTELQEGSRMQEGTGLQEGAGLQERAGLQEGTALQKEMQMQEGTQMQEGTQVQEGTQMQEGTGLQEEMQEGVQVQEGLGLQEGTQMQEGAQMQEATGLQKEMQMQEGMQMQEEMQMQEGMQVQEGTGLQEGAGLEGTGLQEEMQMQEGVHVQDWSGLQEGTQMQEASGLQEGRQIQEGTRVQEGTRVQEGAQGQEGTRVQEGTQEGSGLQEGTQMQEGTQMQEGTQMQKGAQMQEATGLQKEMQMQEGMQMPGGMQVQEGTGLQDGMGLQEGAGLQEGMGLQEEMQMQEGVHVQDWSGLQEGTQMQEASGLQEGTQIQEGTRGQEGTRGQEGMRGQEGMGV

SEQ ID NO: 922538 - protein, 247 aa, Homo sapiens
MAQSLLILIALTSEAYNSISSSSLGAQNEEPKSQENCLFFCLGSMKNGQSCRNVIGQKAPADDKSTKEFIDKFVKVITDEHLMEEQGYNADETSPFWHYCPRKKAEEDRKMWKNLELPRNMLNGFDQNANSDITKEVQAEVVSDVDDELHNQNWSNGHSCYALAKVLVGFCPCPRDLWNFELERDDLGYLAEEISKQQSIQEEAEHKRLENLQPDDAIEKKKPIFWGEIQACCRNSIKDYASENKME

SEQ ID NO: 922539 - protein, 148 aa, Homo sapiens
MFLFPLAFPLKHLQPCLLHSLWKCASIKPLFFINSLRTRDKRILKEKRAIAKDTLERKGCKGISIYRRESDLVREEEKKICKEKVKAMEDFTDDENRVSEMCSIRVQESVRGSPVSSAADPQGVNGLVPKICLTGNFPCETERGQVLY

SEQ ID NO: 922540 - protein, 143 aa, Homo sapiens
MCTQSLAISRGAIWEPETKVKNLNTLPADPPLTSIPLDPAGSLLCSRSSKVTIAAADRAKGLPLAITLTTWPKIPFFGIREAKNPRSENMRLATILEVARCHFRSGPPLSWELWAQGPLGEVVLCTTKMFYIDSLTKFRKIIT

SEQ ID NO: 922541 - protein, 192 aa, Homo sapiens
MWVGPDKRIKAGCPSQQWQPAWVPFHTVCSFNPEANETTNPPGGMSNSRRAALRAVTLTGKVCSFTPQPARPRTHQREETPNTSEYQNEQTPDTPPLRTVTHTTRVHSFILEVSETKNPPILHTLPYNRALCPEVVANIWADKENGTYTVNSVTLRPILCGASPSDLSQIEAEPYSIQFSPKSSVPQITAQI

SEQ ID NO: 922542 - protein, 162 aa, Homo sapiens
MLWAKRRRGKLQPFGRPDLGAPQAKAVSPSLGPCSSWHFQASGHHCIPRCQPRKLLTVCLLQLQPHREPAPMPAPGAACHAAAAGMSDCVVTRPHAFPHLTCSLPWRHGIQAGGVPKAGCQKRAEFWKFYVAKNRKSSVKTRKSLLKWEGSLRNRHTDFHNG

SEQ ID NO: 922543 - protein, 148 aa, Homo sapiens
MMLAVGLSYMAFIILRTQREKDGTRIYVRDYKQWQAQTSKRKKERVTEKAIEEEYEAIRFQFCRVLGSFKLSYIFLSSEPSKSPGSSKLSHIFLSFSETSKLFQPLPVIQFQSHFHILRYLYSSNPPQVLEREPGLTQNGYNEYLWGD

SEQ ID NO: 922544 - protein, 152 aa, Homo sapiens
MAPGPRQNSKFQALDQPLQAQAPCLPQYRPFPGSRSISVAPDARGARVQACPSRHYRQIGPCRPSLQDFPHRSRFQDSPCRCRYQVYTCGLRIQACPSGPKWIQAYTHRPNQQAHPSGSNFQAQLPAKPGIKSANWTIPAEISPKDHARQAT

SEQ ID NO: 922545 - protein, 160 aa, Homo sapiens
MRERGYLGKYSRGCLLLIGKGLSTQEEDPGLGEPELKGQSSSCLKSVVNAHQMRVLKKKDGSMTPAPTLQQFAKKHVRPQRLSDRLPLHLSDVALFLTWKGPASQNGRIPKCHLLVSSWNWGCKCLTPQKNYLTETVHPYSHLSFTVMFTDANLRHKPVK

SEQ ID NO: 922546 - protein, 142 aa, Homo sapiens
MEKCESLNFPLLLQSAKTKNPNPSLYQIISLQIPDIRSLNQLHYLLGFPRQLTHVLSYEATYDKGRIMRPLMPVDKWVCHQFTAGETTNFSYVKFCDKDLELFEEAFPGTNFSILSQNNWVSNLAKYNLDESKHCPSSSIRV

SEQ ID NO: 922547 - protein, 151 aa, Homo sapiens
MKLRTLAVSVTVLKLVYLELFIPPGGFVVSLASGLTLQTFALDIKVLQVPTSQETSWLHPVDPALGPQVELPASPGLCAHTPQPLGPGRNRAQCQWASTAGGPSTPSAAAGPGAKPLIAPAGRAGLPLGVQGRQAHAHPELQLACKCHGSH

SEQ ID NO: 922548 - protein, 178 aa, Homo sapiens
MVQCVRACVCVCVRVCDACARACVMRVHVSVRVWVCVCISLNSGRCEQLRDGCWDWLGLGYVFQEQVASCGHIQDGVGSLQSAEVVSLAPVPPENTCSDTGNPAPVYGSSDTCSDPDPDPTQAPVQGSSARLTELPGIERISICDSTEEASDGRGLSSECAWPHRTWREQCGEWPSLF

SEQ ID NO: 922549 - protein, 187 aa, Homo sapiens
MPDYFKLAKLINLTQSLAILIICRVKGGLIEVDLVEVGLVEVVLVEVGLVKIGLVEVGLVELDLVEIGLVEVDQVDVDLVEVDLVEVDLGEVDLVRVDLVEVDLAEVYLVGVCLMEVDLVEVAYPNPTHLAPTKGMYSLETSTCGLRCPPPFPVLLGMALTFDLQGAETSHVLPVEFGGPDPVQLQG

SEQ ID NO: 922550 - protein, 179 aa, Homo sapiens
MHAFPLGYSRYHTLRYARIHSGVLTLSHTEIRTHSCWGQAETQETHGQWAPLYHITTCRYNRKPKRPMNNGLPTLYHITTCRYNRKPKRPMNNGLPTLYHIVTYSYNKKPKRPMNNGLTTPYHITTCRYNKKPKRPRTMVSQHRSTSQLVVQRKTPNNNLNKHNNNSKRTKREPEIPSA

SEQ ID NO: 922551 - protein, 293 aa, Homo sapiens
MFRCISAPAIDTPLAKAQIPVPKPERTVLFLKDCGSSVKHIISSTLNTRTCILQGSSVLLPPPACPSGPHSVHYESVSVISMSTRNVPQQTFSVPQPLPRADTPGLSALLYGPRPSRNGSQQQNACINISNVTEAKPSTQSSEARTATGSPRTSLARSREHAVGEEGAGETRRQEELPGVPAGPARPRPLSTVMQRRRLLLHWKKQVCSQSVGFYSRLCWSLMAESLRWAPPALVQDSLGHPRVVGRLESAGLMAAPPAVARRGRRLSDRVLIFHTPPLSREPIFPPFPCIPL

SEQ ID NO: 922552 - protein, 150 aa, Homo sapiens
MVLDSIYGKMPHKVHIMGHIPVPKRQSRVCQHNAYRNLNPNLNSRFNFICLSQHSLTLFSEKPVQPKPLNQPSLGGAPHLSHQLHVNWGTTTSSQSPFYVHPSPGLQRIKLQFGEPMYAREEKDAQCRFPGSTLLLKWHLRNNSAILETG

SEQ ID NO: 922553 - protein, 151 aa, Homo sapiens
MSQCQDFEQRTPSTRGQAFPRGNVGAKVEAERLRRALSLGSLCQTSLYYFWVCFRNVCSNPSCVLGGKEQGYIVLTYLWDLKIKTIEFMELKNRRRLPEAGKGSGVVGEGGGEEGAIYNQKVGSCLAPSSWTSRLQDHEKELFVDKPSSLW

SEQ ID NO: 922554 - protein, 153 aa, Homo sapiens
MILKRGGERGHPCLVPDVSTKALSFLPLNMISGKRFFSVYSKNLVKLLEVKLTKGWRPLCLGPLELLMFRLVHTESPGIYQLQLGGTLTGFCSDWVIYKEEKLSSRSSGGWKFKIKAQASSVSDEGSVLASTALSYCSILRRKGTLRLPMQKK

SEQ ID NO: 922555 - protein, 155 aa, Homo sapiens
MGPMRNVSEDSSIRNSQHNTGNGSLFWTPSEGSRAEWNRLLDGKAPGKDHFPTPSLLQAPHPSTDSHLHHLIKPPYSSFKSVTQFFQDAEQELEIQQAVTLALCPCRRAESPMSWLTLKPSVDGRAKRAHCAIWLSLLCLVVPGAWGASAEVLAL

SEQ ID NO: 922556 - protein, 122 aa, Homo sapiens
MINVTHFTEETTKVQSRALTHSIKEIAQLTRVQQTQGFQDAASFQYPANKSQAVLQLRTSVFVRTLNPTPTPRVSKSLQEMHWLGRLPGGGLAMYEQHLEKQYEVEKGTCLTNAVGPRSVPT

SEQ ID NO: 922557 - protein, 222 aa, Homo sapiens
MKVELPAQVHRANDPLARGRRSVQHAHRAWRRILSHCAEPPPCLDSGRPPRSNSPHCEGCQRPQPMKGKAETGITLRDSEADVIKCQDDDKTVKFAQQAVEEMEEKVPRNEKMFLYQGRIGICCGEGPGQGRRDILVGEERRLSFKVRVTTAEQLTGRKHFTPSLGKGGDDATKVTLPVRQEPGFFRSKTSEKLKGTWQELKELQTWLLPAPSTRFSAEETL

SEQ ID NO: 922558 - protein, 144 aa, Homo sapiens
MGTTPSPGPVRMPGKNHFVHFVCNCSLLNDAGVYTVIESPLSHLVLWAARRDRKSGICRQRQQRLLCRKNSAETHGRTEPLPNVTIADVEYWQWSSHKFISSAPQRHRPASSRKLKLGPDQRPPSGEMNLEYTKDAMDRDDKQG

SEQ ID NO: 922559 - protein, 140 aa, Homo sapiens
MSHCDEPEYQFQTVLLQSAHHRLSWLQLYAVGVHGLHLEALAKTIIAVIFDSTSRIKLLFGVAQNFSPAFLLLTKRQQLKQPSITRPEDLAHCLLVLRIKKARYGRDKHHEQASIACDYKMKGTITFKSYSVFHMGNTCM

SEQ ID NO: 922560 - protein, 236 aa, Homo sapiens
MGSENAPAGRRSGWSLCPAMKTWAFSGTPLTLRGSFTTHGIETCRKERAGLAREGPRGGGRGVANPPRAHWLRCAAAAEVGPRAGDGPAPGSQGTSVRSSCCQAEGGPGQAQVWSYLQPTGPSSGGPPLGTSYGKRVTDLVLLCVSAASVGPLRETAGGSSSSLSAEPAFSSLLLKSGPGRVRAYRPCLRSPGLQELRAAPARWRGRGRFSGRLAWTRTGLWKLPALTGLPVTTAK

SEQ ID NO: 922561 - protein, 151 aa, Homo sapiens
MDLSGSSYPLFSCLLIPFAMKVHNKSNLCSTLSETPSIWTSLPASLLAFWSESFNQSLGSSKLSHLPFFFQALSTLPMSICSLIPKLLPHFQKEKDYWEFGNNPEMECAFARRHSKNPINLQVMCKIQELRDPCVQRQAVYMKCHNFDKGC

SEQ ID NO: 922562 - protein, 257 aa, Homo sapiens
MAKTLFTGLGLFKTIKQIVRACEVCQRNNPLPYRQAPSGEQRTGHYPGEDWQLDFTHMPKSQGFQYLLVWVDTFTGWAEAFPCRTEKSQEVIKALIREIIPRFVLPRGLQSDNGPAFKAAVTQGVSQKLGIQYHLYCTWRPQSSGKVEKINQTLKQHLKMLTQETHLAQPALLPIALLRIQNYPHKAGLSPYKMLYGWPFLTNDLVLDRETANLVADITSLAKYQQVLKTFTALEPVPVWIGPPLTDYYNKSHSKIQ

SEQ ID NO: 922563 - protein, 758 aa, Homo sapiens
MVTLQCPRASGSLQELHGRCVRHCSCLSVIMPEKPIDFGLSEATTRSRIARTLGLRRPVHSSCIPSVLKPVEPSLGLLRADIGAASLSLFGDPYELDPFDRRRLPAAVPEPDLEEEPVPDLLGSILSGQSLLMLGSSDVIIHRDGSLSAKRAGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPPQTLAPVPAALTPASEPASQATAASNSEEKTPAPRLAAEKTKKEEYMKKLHMQERAVEEVKLAIKPFYQKREVTKEEYKDILRKAVQKVGCVRACVWGSGSRAVGERPPEVSSCLVTSQPMLPPPTDTVGPSVAL

SEQ ID NO: 922564 - protein, 261 aa, Homo sapiens
MSGPKRAAIWSLLIIYVVTILEDLAVVGTIRASHHLHISTHLFLAQLSVLETLYTSVTVPKLWLCLHLAISAQLSSFPASFVSTALNSSLRLRSPDVLNHFCDIPPPLGLSCSSTTTIEMRTQAAQVILAASLQATTTLVTTQGSHSPLPPGQSASPALAHITQSCQEHRVATGKHLLEQWRGRDARPGPQHCQDSSLPQQLGASSPGEAGPGAHKKPPLTASPLTLSDEQLLWRPATLPSPAGPEGWSPCHEVPAPQSRA

SEQ ID NO: 922565 - protein, 190 aa, Homo sapiens
MRTTGNNCTGPMRTAVNTWAVHNEDSYEKPRTPGVGSTKAIVSVWACHNEDGYKHLAGPKMNGCQHLNSPRQRRFRTAVNTWSCPRNDSNEQLSSANGNGLRLDVNIWPTAANTCSGTNEDAYEYPGWALGEQLGLTVLGPKHMATNTWADPSVDSYKDLGWAQEDSCAILAASNEDSCGYLHLAPLKQL

SEQ ID NO: 922566 - protein, 146 aa, Homo sapiens
MTMAAPGIPNEQVAQFAQGRQEEPTPSIELKQQPMLNKIKSGTNGDIKMNLKAYSVIFSRIPSKNYKGESGCRKSPQDARRNLLYTPRALGSEMKLTRKDLTTQYKAWLGQVSLGTLPIAVSEPSGQDWTYPPAAQPQAETPAPLK

SEQ ID NO: 922567 - protein, 357 aa, Homo sapiens
MFQLLVLVPVQTGGRSSELTNGICWAQKGPSALVCGLSPAHLLRSREAASVCPLSLPVDRKPQMAQQFDTLQCFQSSQKKRQLLGKGEKRVIRAIQRRMGLDKEVGGKKLEKTKEAQKLNQAERKGPECGALCPPAAWLGPADVLAAESKSTKTGQVVVTVAIVDSYPGWERGPLQVTVCPGTADQLGHGAYHWLNVDSGENQLFTGVNETGNISAFRYMSFGRERFDDLMMSPRALGDGSPDICQPVWCSAEAVIPMRRQLYLVCRLNIAREQCLAHLGHWKRLPGRQLTDDKEEASVFQEERLPRQCHGVEQELRLTGDGREALRLRTQQQQPWVPLWGTPKTVDVGMLFFRILG

SEQ ID NO: 922568 - protein, 164 aa, Homo sapiens
MGDGVSQHCSFSVHALVHLLIHDRWSLVCVNVNVDECERQDEAINTHIYHFYNGTAKWRLIKTTEVYTRYHPGRGGAGLLPAAKELPKAPPQGADVFDLSCLPKMYEAKLHPNHLGHMFSSRPEGCVMGHVEQTLHQRRYTDGKQAHEKTCNIIHHCDISRKSE

SEQ ID NO: 922569 - protein, 155 aa, Homo sapiens
MLSPCIATFLLPDTYPNATGRADKIHKKGHQETILLTANQRESTLHSALNPKHGFWKIKIYDLDRGSDESLGDTCFLAQLVKTSAQLSSNYRASAPVASENKWADNYSLRRSWSLHFPALRQPVRLMGSHYEVWALFQDFSTPSVFFQDDFTSHH

SEQ ID NO: 922570 - protein, 191 aa, Homo sapiens
MFSPQRNNSDIPGNRTSSQNHNSKFCQTILQSLNSNGRFVRGVWAQYSPARSKGTFARREKFKPPSLRATWEHFGAADSGADAISRTASVASAGGTFGERSRTPPSSVPGPLHRSLSAARGPVRELPALPWGRKSLFLQRATFPLQAAGTPSRSFGQKIPESYTSCAPRPRGRRAAPPARPDPRRKEDLVD

SEQ ID NO: 922571 - protein, 139 aa, Homo sapiens
MLDFDLDCFMKLNTKSGYKVICLLLGMVQSAERNPALESLRSHPVGSGGKASGPWASKLLATWQDVRLWSLHSPGLLRTVWYCQCWVNRPRREKGERAVLGREAGCASKLRWKEAFYFSECTWEQTKVEKRKKERYIDC

SEQ ID NO: 922572 - protein, 127 aa, Homo sapiens
MLPEEAPTCCQHWESLWPPGSEDSCANHLASGGHGEAQHLQVCSTGTQGPSVWDGCSCRIHLGNPLRVALCLKTKGQIEKQIRSTPKRDSAKMNFIIIIRPKQLGHTEPFSLSSTNHGTKASVAALP

SEQ ID NO: 922573 - protein, 148 aa, Homo sapiens
MAGYSSETKLPEEPSSSSICGSPKIWDYVKRPNLHLIGVPESDGENGTKLENTLQDIIQENFPNLARKANIQIQEIQRRPQRYSLRRATPRHIIVRFTKVEMNEKMLRAARKKSRVIHKGKSIRLIADLSAETLQARREGGQYSTFLK

SEQ ID NO: 922574 - protein, 145 aa, Homo sapiens
MGKKQSRKTGNSKNQSASPPPKERSSSPAMEQSWRENNFDQLREEGFRRSNYSKLKEEVRTNGEENYVTKKGAQASVTDAINGKKGISYPAKLSFISEGEIKYFTDKQMLRDFVTTRPALKELLKEALNMEWKNRYQPLEKHAKL

SEQ ID NO: 922575 - protein, 140 aa, Homo sapiens
MSLVKAGTGHLDVTRPGTILHPHLYPLYWMFSSSVTFPETWLFHGKRFLLIFFKWGMLILLYSLGLASFELPIPPSDHYFSDAMCNSLVFLRFMPFTFTTLYHSLLSIIYQPLSHSLSIKAFSMRFIIFPLIPEFMSLPT

SEQ ID NO: 922576 - protein, 196 aa, Homo sapiens
MGKSRVSQGGPGWPGDEDRELRSLGSTTVVGKNKHLTKGSKKGAKKKVMDPFSKKDWYNVKASAMFNIRNIGKTLVARTQGTKIASDGLEGRVFEIRKTSYAQHQQIRQIQKMMEIMTQEVQTNDLKEVVNKLILDSIGKDIEKACQSIYLLHDVFVRKVKMLKKLKFELGKLMELHGEGSSSGKATGDKTGAKVE

SEQ ID NO: 922577 - protein, 151 aa, Homo sapiens
MLAVGAGGRGQGNGHIDDGFCLPKDAVQACFIPPTLLQASGITSSVRLVDDSGSAQPLMSPFLCLPVALHCWPTSSQVMRSWIQGLSLQCCWLAVPQQVCTVLRSFISVFFPKRLGLVGTLGHDCEWRRPVLWGRSSPGTLQGWRILCSSC

SEQ ID NO: 922578 - protein, 609 aa, Homo sapiens
MTADGCSLMNKWSVMDGCSVIDGWCVINGCFVVNGWSVVDGWCVMDGWFAVNEWSMMDGWSMMDGWSVVDGWCVIDGWFLVEGCSVIDGYSVVNGWTVVDGWPVMDGWPVMDGGSVVGEWPVMDGCSVVNGWPVMDGWPVVDGCSVVNGGSVVNGGSVVNGWPVMDGGSVANGWPVLNGWPVMDGWPVMDGCSVVNGWPVMDGWPVMDGCSVVNDWPVMAGQPVVDGCSVVNGWPVMDGCSVVNEWPVMDGWPVVDGCSVVNGGSVVNGWPVMNDWPMMDGGSVVNGWPMMDGGSVANGWPVLNGWPVMDGWPMMDGCSVVNGWPVMAGWPVMDGCSVVNDWPMMDGGTVVDGCSVVNGWPVMNGWPVVDGCSVVNGWPVMNGWPVVDGCSVVNGWPVMNGWPVMDGCSVVNDWPVMAGRPVVDGCSVVNDWPVMNGWPVVDGCSVVNGWPMMNGWPVVDGCSVVNGRPVMDGGTVMDGCSVGNGWPVMNGWPVVDGCSVVNGWPVMDGWPVTDGCSVVNGWPVVNGWACDGWVLCGDWVACDGRVFCGGWLLCGEWGLYGEKVTYGEWVACGEWLACGGWVACDGWVACDEWVACSGQEKGINTHYTW

SEQ ID NO: 922579 - protein, 145 aa, Homo sapiens
MKKVLGFLRPPQTCGTVTRHRSVTHTQQPFHRGSPDLLLSLAPWAVLGLQELAIWVGPDSHGGPPTHEAVQERVPGFRVGELSRASHGCFDTSRSPSGPCACPELQSRPEQPPLPASLTAALPSNISFLTHEAAHSLKTSPKPPP

SEQ ID NO: 922580 - protein, 154 aa, Homo sapiens
MSAGLSDFLVYFNTIFWLPRQQQQQNSSNSNNSSVNSSSDSSNNSSSDSSNNSSNSSNNSSNSSDNSNSSSNNNSSSNSSNNSSNNNSNSSNSSSNNNSNNSSGNNSSKTATAAAAATATINDLSEGSFCTGHKGVTVQSWRLHLRSKCAPPAG

SEQ ID NO: 922581 - protein, 155 aa, Homo sapiens
MANQAQAKLPSPSTLFLLTAPGSQVHRALPCGEASSAQDVALEMCSDHAQSHTDPSAARTTHTGLPLPSDGSFWPKDHPLLIETLTRGCSGERGGFFRGRPTGNSAPTARPPAACESSDNPLRKRGPSGRPGTCVFLPLAAHPTRGASSRQRDLP

SEQ ID NO: 922582 - protein, 156 aa, Homo sapiens
MGLRRPSCAAVQLQDPPKCSSIFCSSGPSEDDLLVAQMLQPSRDFASVHSSWGPVQTKQPNLRDGTGSLSQGMRRGEQPGTREDDDPEGILWKNGIVLLPGTEKHIDFKPNTPAGLMRPQGGWFASCVLCHLNVELFIEQDRVKSKSIPSDGLISN

SEQ ID NO: 922583 - protein, 152 aa, Homo sapiens
MGTKKRTCSFRVPRQEPWDMCTGPASSPAFSGLQTFQRPPSPPAALLRLPSPPPTSEALPRLPGSRSSELPAADSSACDPDPARDSQTPALGTPGECLLPQSSTQHQPARSPSFSSFAAVLTGQSLEHPCCQVTNPVTQRCTSFSQGDTMWS

SEQ ID NO: 922584 - protein, 236 aa, Homo sapiens
MALQTLAERAGARRQDPDSCGSSDAFICPNGLTMAVPQGQECVPVQCGASGCLCCTLLELQDGSFPLDPLDTDIFVSLVFGIWPQALPQEDRLWLLAWFVDPNDEVSMMQLVLLPTLHTLCPTLVNFPADYGVPNWGKGANHPPTWILSELEIPSVSCCVEFKNDVQMSSVSIAWLCSQGLRTKQDSVVTGNRPCSLPCSTSGPTYGFGGFGAHSVPVLLCQLQVSLTVPEPILRV

SEQ ID NO: 922585 - protein, 136 aa, Homo sapiens
MFQYQMALDTVLIHAIIIVILLLLLLLIIITLTVILITITIILIITIIILTIITIIITLIILTIITITNITITIITIILIIILTIIIFIMLLLIISIIIIIIIIIIIIIIGIQEESRRNSGDLQQTDPVKKATQRL

SEQ ID NO: 922586 - protein, 148 aa, Homo sapiens
MQHLLNLQLPHYLDTQPPNVVSLCLSSPTCPRHPGCVLGLCALATLTVTVQLSLGIDVVPGPRLGTGVHRSDQKVPAMQESQGVGVGSGGAEKLLQACEPAASCIGKGQFHWSKGEEKLEVRLPWASVRPSNCTPKAEAIINSSPPHP

SEQ ID NO: 922587 - protein, 195 aa, Homo sapiens
MSLLNWRGLSSAGMAQGADCEEETVLWRLYQAKCISGRILSQLLNSEGPTHSLASSMVENSSPRLFLQKTLNTSATCTFWLQEGSRALGLSLIQLCPQNFFCFPLGFLKTIEMVYVKAHLGQAQVPDDEEEHDKDDDGEDDDEDNGDNGDGDIGNSDDGEDDEGDDDSNDGEDNDSDDEDDGDGDKDHGESDDDK

SEQ ID NO: 922588 - protein, 137 aa, Homo sapiens
MIAWGKWTHTVRLLIFEVLQKWGSGLSLPDPTPHHGGYERAFHSSPCPPPQSPLSWKPPPSGLNLHYQLHVLLMGYSCLWRSLHRHTKQGLALPRVCWLPGSEETCQALRWQALGVALTPVQHGDARQRECIMQAQF

SEQ ID NO: 922589 - protein, 148 aa, Homo sapiens
MVELVYSPTNSIKVSEKFDSLKPSSLNSSKSFSVQLHFIAVKTLTCRSVGVCWRSTLTLFAWLSAAEAAEERILLNSKCCCLIVPLEASSQRGTQLCEVSVCPYWGVPPSKATRWSGTLLRRHPVCSQISNSVLGEPLLFSKVSDSDI

SEQ ID NO: 922590 - protein, 157 aa, Homo sapiens
MAYFFHKYLLNANSITMIQEVYLLTFGLKHTGGVGKKCSKCVINGSICCKSFFFSLVSLVLDLIKHFSISQQNSPPKTLSGFFTLSLAPLPRMLHGFLTWCLCSAAAASTTPSSSKPPLGTKLSSHPLLVLCPPHSVELAPFTSLQQINVGGGITWD

SEQ ID NO: 922591 - protein, 179 aa, Homo sapiens
MNKAAINIHVHVPVDTDFQFLWANTKECDRLLNHMLRVYLVCKKLPKSLPKWLYHSAMNESSCHSPSLPAFGVASVLDFSHSNRNNWCPFIPCHFPAVPSKMKHEALVMGSTSREMPPIRQLVLCLPLDLRYAAFLTARCNGVHSVLVKEEGFLVKSPPGHWPEVHNDHNCHCRKKTTS

SEQ ID NO: 922592 - protein, 156 aa, Homo sapiens
MVLFISKMLSTTLSDVIECNAQWTHQTEKGKICCQKSKCASQVAAAQTSLFWLTENCEMNFCYLEATQFTIFCYSNTTGKHSGTVALPGRTLARGADPHPSIPKSREPVPPLGNPPRLTQHPLSNTQITFSPTREPASRGVKPLFQLLFGARKLKN

SEQ ID NO: 922593 - protein, 162 aa, Homo sapiens
MYILDKQRSSQGPKALNFLDKRKAKFPLHPLQSPREKTAMSSLVNGPTPAVNYLRQALLHGGLSFQHMNISGHIQTIAGSKARASFPTDSCTVLAIKSLPGVSGDKQNLVPRNNFLCDPKPTSAPFEATTSQWCEVPEPQIQEHGMGLGVTPAEVSPGSFTY

SEQ ID NO: 922594 - protein, 138 aa, Homo sapiens
MYAIHKCMIYHLDTHLPLIPHWAHHAHITGTHTAYTNSTLYFQIPQKTASKSHKHTNLYLEIYPNIFNRNWINNLPNAEQTKEENITDQPTERKEDKIRNTGNVINVKDKIRLLLNVLVIRIHPKISGLNFPIQRLST

SEQ ID NO: 922595 - protein, 189 aa, Homo sapiens
MLPSVGAVVQHGCLLDILVCTYLAEKGLSGSCGLTEALVAFGEGSSLGRKNCRDPWGSLRQEPHWSDPRISSCLVAMLKQEGNFFLLGVKEWCDYQQDHYSYLHFSGPLTWSLDPASRNHGPYKVENVKVRDLEYNCAHLAAESKMDLCIFYPMHLHQHDPFSDMHSTLRVANFHIHFSYLIFTYLVRK

SEQ ID NO: 922596 - protein, 164 aa, Homo sapiens
MVLAVKGPLQFHGVEAENNGSTFLDIPPLERKIHEGSEEELPFWSLIECCRECRGGWEAPCRNQHQKERHPGVLLGSGPSPALPESSMPWRKASVREGKALNLDIGCVASEWRRCSVVLPGSLTDETAITLPWTPCLRVSVLLLGVTTLESNKEASVGARTTRY

SEQ ID NO: 922597 - protein, 146 aa, Homo sapiens
MTPAAMHWLLRAQAKCQPTLPHCVALRVLDPLRVQVMSPSTRGQLTAQQKSKKCLMPFWLKGEMDEEPQTRRPGLVEPLRLPFSDLHCDWPYSLSLKPGHSDREEGSVLHFPGTTGKYWDSMVTLFLQDFERDLNSILETTDCPGQ

SEQ ID NO: 922598 - protein, 130 aa, Homo sapiens
MLTVSAANFSSAGRQFCKQGSELEAQRVSEASCPQGLCLLHVGAPTSRDAKHRGPLEATPGSAHSMDRGMKVRRALGELCTESTAEGLTYSTPSFQGSLIRSPGQNHTCGKLHNHQGRQSSESCINGEFQ

SEQ ID NO: 922599 - protein, 164 aa, Homo sapiens
MPTLQLFTVAAVHGTCGTARHSVSGRTVDTGIPEQTVKGTGCWKRECGAWLAFAAGFGNTGATWTSGTIMRECLFAGFVYLALSHECLLVSGLSAISPEHPVVEHPLSYTYCALYWMQYGHHDDCRWRLTWHLTVSWGRLVGELCLALGTCLGLYVLAERLVLL

SEQ ID NO: 922600 - protein, 146 aa, Homo sapiens
MGFQYRKRICGKGRVLVEDEVGDPRCQRTGGRADPPNLLRGTTHSALLSPAARARWQRLCFLPLFWVAMVAGLWAAADAPAYGHSEHPGPSQLPPRGLLDGGGCTFSPAPAKQPNSHAPYPETKTMCSTVWTSMSVQHERRGGPMT

SEQ ID NO: 922601 - protein, 216 aa, Homo sapiens
MGNDFDELTEVGFRRSVITNFSELKEDVRTHCKEAKNLEKRLGEWLTRINNVEKTLNDLTELKSMEQELRDARTGFNSQFDQVEERVSVTEDQINEIKFTKFEMKEKVLRAAKEKGEVTHKGKPIRLKADLSAETLQARREWGPIFNILKEKNFQHRISYPAKLSLVSEGEIKSFTENQMLRDFVTTRPALQELLKEALNMERNNQYQPLQKQAKL

SEQ ID NO: 922602 - protein, 185 aa, Homo sapiens
MPSLSLCTEAAWVCLPSAPTGNPHSPHAGHQEWAAYSNSPSAVNQVLKYIWAPTGKDLNHPFIQHLHVVDAPCWWSLTLSAPGTQPQTCSRCKDPGSSEADNSPSNNLSEGQWQANAASQCLHHVPQLPLHRTTAQEKGQLHSTLESKVELNSDFSLRPWIFTVLIHGRIERGKFGLVGPHNLEY

SEQ ID NO: 922603 - protein, 136 aa, Homo sapiens
MQVAQAHQLPLVMESQGEWFQLSLIQCEVGSVFVIDGCYYFEEHPNFPRLSNKGPEASPFDLFCLARWEIGCPQQMDRSVTFVTSLQLLVGCFLQPIRLIAGHHFIYMRLLLHGPQTQENRLLFGFFLSINIGIYK

SEQ ID NO: 922604 - protein, 155 aa, Homo sapiens
MAEPCVHILKCCLQRQCQNSILEPRENSKLVLWQKLKYIYRFKMAFSTQILSVLCSLKENRINNSNKRWMGKNYVCVSRGTSEHRGCEENRGKVLRGMENIERMPSEKKVIDGVTMILVILTTCTRDCAGGRLPNAMMRIDTSIHSISLRKVKCL

SEQ ID NO: 922605 - protein, 190 aa, Homo sapiens
MCSFDLGANAFLCGITGRTITGKSIQRYLLKHGKADCTQDPRNRYPDNGILQWRKEIDLNSQYSTSRWGLTAKEQGEDVTWWMVEDEEPDQILSGRFWLNGLSSVLADTEFCKEMHRWVQEKDVPVCSALSIAFLCVKGKGANASLCGITVALLCGILAEPGFSQDKRSPSISRKQGSCCECGIDKQIPL

SEQ ID NO: 922606 - protein, 139 aa, Homo sapiens
MPAPLRNSQTASLESNNININKKDPHTKAPSKGHQPQRSKVDKSMKMRKNQRKNAENSKSRNASSPPNDCNSSPARTQNWMENKIDKLTEVGFRRWLKEHVLTQCKEAKNLDKGLQKVLTRITSLERNINDLMGLKNTA

SEQ ID NO: 922607 - protein, 150 aa, Homo sapiens
MAEQGALRKDLPVRGHTGKETDKFLDIIKKIIEEKGYLPKQNLNTSESAPFLGKKCHKKNPFIGGIDKSCQWNCCGIKERPGRAPRLMPRATNMMELTFQEMLRLWRNKCGEKGKLSFGRAGFEVLVTYPGKDVKKMAGQRGLEAGAEVW

SEQ ID NO: 922608 - protein, 196 aa, Homo sapiens
MSRGRSQGQRQQSFWKELTMALKDKGKRVGVCQVEKQNSISRRINRPVKAQKYEVTNVLGTDPLDNGETSQDFKRLHVQTCLWKGLSAAVQEMNEKARCPLHKTKEEASAIIGWNRVKEYMCWGYWECHRASMAAEIPVHGSLAVPQRQYSMAQQNQPSSHSASYYLGQINSCSWTSFLIYEVVIIILLHDTVKIK

SEQ ID NO: 922609 - protein, 177 aa, Homo sapiens
MALECTESSRLQKATPVPRGHLDQGSGCLRTSFKVLSLIVSSATRADRHKHKRVRKGLHEEREMKDLTCAQAHKKAEGKEWVTLQRYNWPPESCTGGACKVLYEVSALKPGWGPDLFWGIGGVRALTWGKLTSPERRAVETQWKTFLGLVSQGKKNNNNSIVIIVVLIVGNKCLLCA

SEQ ID NO: 922610 - protein, 139 aa, Homo sapiens
MTQWLPNSALGLEVFSQKALGPWGGWEGLKPWALWSREKPFPQYSKFFTHEICGNACLPDAHLLLRSPAPNRLVLVRGLGAGDPNCSGQLNLSPPSDRSTGLSDSITICDMVTELKSDPLTYLGMNIIRRQRKWVFLFV

SEQ ID NO: 922611 - protein, 134 aa, Homo sapiens
MCNGPTKLLTHSHLQMEELREHCNTLSGALGSQAPPPGCGRGPCMELVSTGAWSSWLDLALTRFTCFLLQVVKCGGLSKWGTLVTLYENGTRNIMDAYLRVEGGRRVRIEKLPIGNCAHYQHDQIICTPNPRDT

SEQ ID NO: 922612 - protein, 158 aa, Homo sapiens
MKSHHSPLGIAGPVKGSRCQRSSKPGSQALAGARAWTERLDPECAGSRELDLKLDKREFIGTKKQPPNFLGLTVIISSCFLNAREVALAVHCLAQVSHPSSPQARAFKIALPLCAPLSAPHLPPDGILVANQPVSDPASKSLFKVSFLGPLTVPTILR

SEQ ID NO: 922613 - protein, 167 aa, Homo sapiens
MLFGVSQKLCFNPYDSGRGLYSATAVSVVGELLQGHKEDQVLSEELRPREDSLSARASCERMAHKLLVDQRRRGRVTRRLSSRHGDTDLRAPITERQVECRECVQMKQWLGREGPDPPCPGPYLQDSVTALGGRGVGTTRGQDSNLEGKEHCLGIEDETICISPTSS

SEQ ID NO: 922614 - protein, 252 aa, Homo sapiens
MAQSGTRHVLETARGECCLGESRFTGAAVSICEGAYFVAQLLAICFQCQPGSLADRVREKAHWLGCFQKFLAYLLLSVACFLHPVLVWHVTIPGSMLIITGLAYFLLSKRKKRKAAPEVLASPEQYTDPSSSAVSTTGSGDTEQTYTFHGALKEGPSSLFIHMKSILKGTKKPSALQPPNTLMELSLEPADSLAKKKQVHFEDNLVRIVPSLAEGLDDGDSEPEETTSDTTPIIPPPQAPLFLSSLTATGLF

SEQ ID NO: 922615 - protein, 211 aa, Homo sapiens
MAALHRCSAQVSLATESPRGKYPPHYCWHFLLYSTNYFTGTYSRPLPAAWRLLSLEMSSQQRSEWEPGDESDWSHNPQEPEAKLDTGNTINKYLLVIGGQLLSNGRTIPVQRSSPLGSSQDNTEAILDPELSVDGPLLQLHCNPFFFCPVLLSSLPHVYGTQDYAPVKLSAHNLSGSISQQTQPKMVVAAVAGGALERHHFFNKHWAHCHS

SEQ ID NO: 922616 - protein, 235 aa, Homo sapiens
MTQEDMLQSTLLGGETGIKRHLPGKDWGVELLGRVESCVPQWRRDKPCSRVAAPLDLLSSMLLGAAPAETVVDTEAQRERGPCCGSRPLSPLDLPGWQQQSCTLQRCRNGHSVFRFLLLFLCLHLGSLLLSLCLPLGSLLLSLCLRLGSLLLSLCLRLGSLLLSLCLRLGSLLLFLCLHLLFRPGYPVREMGKETSPTRAGIPGGKNVLKLCKALVFDVEEVDSWKLLEPFEDLD

SEQ ID NO: 922617 - protein, 126 aa, Homo sapiens
MRWQVWRFGFCKPSLRRLSGPGARRRVHDARITEVPAPRGEGSKERAWARPARLEQQFSGSPALPRVGPLRGLGASRGGGLEPLVLAEVLMTGERDAFAVFEATLSSDWQREAVGCGRKHIIIVGG

SEQ ID NO: 922618 - protein, 153 aa, Homo sapiens
MERNRLEWNRMGFNGMDSKRMEWNGFEWTGMERNVLEWNGMEWTRMEWNGTDLNGIEWDLMEWTLKEWNGMEWNGFEWTGMERNVLEWNGMEWTRMEWIRIYANGMEWKGMNSNGMVWNGLDTNGMERNGMIECNRMEWIRMEWKAMEWTRMD

SEQ ID NO: 922619 - protein, 139 aa, Homo sapiens
MRSGTKCHQLEKVNSEPSGTHQNFLRRDGLTGLAGPGQGVGVGEGRAGGKAASPRPRPGPTKPGDPPRHRLHGDDKQASSFALPAPPRTQSLVETREMEPWGEEQALGWKVGGRRAWQGTGGLGPAQQALGGQGGSPRA

SEQ ID NO: 922620 - protein, 143 aa, Homo sapiens
MSKPLTVSPLDLASSSWLSKNLLPTSCQAAGRQSDRGRHQKQVYLEDQSVLEAHGAWSRGPCLGAPSVAPECLGATESSSVWSPYAHSAFLVTGEASWTFWVQQGLRDRPPQPVPPRDEHWEGSRTDPRKEGEKGNTWSVSNQ

SEQ ID NO: 922621 - protein, 239 aa, Homo sapiens
MAFIVSAIVILATARVALASITESVQTAAFVDNLAKNVSNEVLQQGIDQKILARLQAHKAALEYVGERQDALAFRQQLNCDWEHKHIYLLMWGRGYACVFAGDEQTMWVPSRCVQPWKGRLEGPMDSNYRPGSPSMSNEPVESECENRTRTNQSHADTNPRQPGFTPAVDPKAPAPREAHDKAVWPCVSEAIRYELRQLLRATQVKGWGLGLHLSMEVYPGHTVERAYVTTFGNAIKSS

SEQ ID NO: 922622 - protein, 187 aa, Homo sapiens
MLQVELGVRFSIHSPLVWSPPPNQPQSMGERLSCPTALKEGWRGTLDRAMGEARLSVMPFTDQPDPSCCREEGPSVLVFVTQEFSPEHRPQVLSSVLTNSARLCGRQPRTLRQREVPTFAESWIRLQSCRILSLNDSRCLTLPGCPQPQKRVLRALCGLVPCRAAAGAHSALQRRKLSRVERHQSCP

SEQ ID NO: 922623 - protein, 150 aa, Homo sapiens
MPPQTAVRILTIAVLGNLAGLSPSLHPEIGMPASWPVPVRACACACVHVHGPGGIAVLPASSYLSSVEVGNGLGLAQWGRLQVRAVPAVEETLGLGGPGSSQPAEQQCRTEDGGGEHWPEFAMSSDNYILQLPVPVGSISMEIYCGQVCR

SEQ ID NO: 922624 - protein, 116 aa, Homo sapiens
MSFQNVAQSCKAGGKKRCQGSALFLGGNEVKSRAVVKYSSAPPRTAFARLEEKTDLKLPPANWLRESAKLGPAGTTILGNSKKSKPFSRFKNPACWVTYTLTLTPELMVFKVERVA

SEQ ID NO: 922625 - protein, 220 aa, Homo sapiens
MYNFEYTVIIRFARKVLRVNEEACGPGPKGAGSFREPLGLGKNSASSDFSEKESSLVPLSAGGQLSAGEQGSSEKFVITDRLKPSSLNLSKSFSIQLCSIAAEELRPSAAGLLEFAGGSLRMLFAWVSPAEAAEQQILQNGKCCCLILPLEASSQRGTQLYEMLVGPYWSFVLHQVHFLFFSQGVLTKSSLVEPSASSLLSLPKHQQSLTGVTHNSTYGK

SEQ ID NO: 922626 - protein, 141 aa, Homo sapiens
MKVEVAPLTITSSDPLAEFLLPVTVTLCSASLEVLAPEGGMLSPGDATMIPLNWKLTLPPGHSGLLLPLSQQVKKRVPVLVGVIDLDYQDEIDYYSSMKYYHALGLRSMALRPYHTESIPSRLILEAKANGKLQPNPGRNK

SEQ ID NO: 922627 - protein, 135 aa, Homo sapiens
MVEIFTPQKYADSINQSLCFPEKFPSEDSSQREFFKQVRTGILTHRWPEDIWDTLVAWGHLWVLETLSGDGHLEMQRGLQTPSVSTEKTDQACVSHADSHWDWNPVAQSGDNSGTRERLVDPMLGSDPKMKFPSR

SEQ ID NO: 922628 - protein, 180 aa, Homo sapiens
MVEGKEEQVPSYVDGSRQRQNEEDAKAETPDKTFKSHETYSLHENSMGETAPVIQLSLTRSLPQYIGIMGVQLKIWVGTQPNPHNYGIMVVSVVVAVVVAVLLVVGVIYDQPNDLGLVYGSKTGQHDILVLAKIGLLLHFSSSIAPKDGDEGKCPNSIELPATHSPVPVPLTEKWKWVEI

SEQ ID NO: 922629 - protein, 124 aa, Homo sapiens
MPAFLEGFAEGEVEIGQTTPVFVAPSMTLLCKIITLLNKFCLLGLSWKNSLFPSESEVLSMPLILPSLVTCSSLNQSVWLWIEWDHPDWLRKTMTPFWSWRVVVESRPHPEPRGCYKIWARKAA

SEQ ID NO: 922630 - protein, 138 aa, Homo sapiens
MLNSIHSNTGRAGEHEAKQKVFLSAGCCAFARGHKPMKLGLMIGDVLKVQRSQRGFADLVGVNVGSVVWSQTNQTKGVGICGHSDFMQPGYCWLWMVDTQCDVSLHLYQDNGATIPPKSSIIHNRIFHHQFGESLWYT

SEQ ID NO: 922631 - protein, 136 aa, Homo sapiens
MSAISDRNSESKSGDSEWQVQAQSCSADLGNKQPVGQEQAKFPQGKSLTIEGRGWNRWETSSLDILEDMHLCCCCCVVETGSFAGRCGHGTEFCSKWAEVMCTTSSPQPGPGGQGNLSSPNSKSLLGLGKDVDAEL

SEQ ID NO: 922632 - protein, 152 aa, Homo sapiens
MIGKESFPILHDCSVEADICILHFHKPIKSFQPLMKTTSWAAFLAAGRVAPSQMQVSWLWKGLALHHLLSHDAQRFLLGVSHRPFNRSVPWRVGRGQDSLVPVGKLSLRAMRDWVRGSLEWQGWHLGECWCCQEPVMEQGPALAFDLGLRSS

SEQ ID NO: 922633 - protein, 145 aa, Homo sapiens [sequence omitted]

SEQ ID NO: 922634 - protein, 304 aa, Homo sapiens
MTSTTLRYGLLLLLKHPELTGRTTDDEQSEFQNNAEKMVPVFSILFLLEKLHSLNFCVISCNLSKFDDMIKKDIFAQWRRMTEMNQSQTAELAASKAPWALDLLHQAREGISRSASCEDHGKSAVFGQECTIPPGLVEFAGCLLQTLFAWVSPVKLAEQQRLLPVPSSGSFLPEELPLDASQMELSCVICLLTPARRCLPVRRHRDQGPTGGGSLFFQGALLREEESREAVWLQQLCQAVVGSAQFKLPGGFVYTKDNLEHMFHHANFRVTLIERMLEKHHKQGQQPLQGPPCCDDVIPLFLSR

SEQ ID NO: 922635 - protein, 222 aa, Homo sapiens
MNYSFHLFQVLSHDRKNYPVFWERKKRFGYQQGWPEARQPPERSVGFECQGWTFIQLDTFTPQERGKILVHCVMGRSRSATLVLAYLMIHKDMTLVDAIQQVAKNRCVLPNRGFLKQLRELDKQLVQQRRRSQRQDVIAESICKLLSAVEWDDGAASQARWLRDFHSEGENGSRHEAGSDSFQGQESQTRQKPKRVAAVGDAGRQGPGMEMAWRNQNVIKAF

SEQ ID NO: 922636 - protein, 258 aa, Homo sapiens; identical to SEQ ID NO: 776973

SEQ ID NO: 922637 - protein, 265 aa, Homo sapiens
MQIYKKVERVVQSTQPRSLACTVHNSSHSYENLSLRCSDRRWSSGGNAHSLATHLLLCGPVPNRPSSTRRLGIPAQYDILPLRLLASPEPSLYLIREEPAEALMHVEGYEFGTGRKAFWLSRNNGLTETKGLKYLVEDVQGLWPDDETAMLRPRKGVSFPWRSQGTFCSTRFLWKAEYYPGLPAVIRRPKPLPVVLCFNAHAPGPLSCSSCTPGSSLKFVVDGGRRNSESLKVFDLSYKCIEENADVCCLLSLLQLHKRESTPVL

SEQ ID NO: 922638 - protein, 136 aa, Homo sapiens
MLGHSEKAAVCKRERGSRFFWYFQSWTMWNHHSLPTPASLQIRSEEISVPRGRKLLQLALQEVWTKEEADENLTACLNESYHQGMSHCPGPFSSCSVPTFFFFPPLPPPPLLLPSHPSPFPPPPLLLLLFFFLQMV

SEQ ID NO: 922639 - protein, 306 aa, Homo sapiens
MASTTNSKVSAWMEGHNKIRFVIHTRDRITFELLINEDVHILNVRMLYPGVVLCVISVIGSVKVEAHHLMTLLCQFMASKTGTELKITDMIRLTCDAMYRDKGMNEFSFVADDMALEAARFYFRDQEVSDDDLESAAAGWVDQNQGEVEKRFKSAFITPIITRHFCKYGKVAKVKVGRNDAAITMITVIVTDEEVPVKKRRSRKKVSLADCLDSFVVDVGKLADSELMTRDVNEIVRQMKAHIEKCEAFQLNPETFGFNGDYRTTFEFVRYVKKEFGFEVIHAGLVSGIQTFIFKPNEIRCFTLMK

SEQ ID NO: 922640 - protein, 144 aa, Homo sapiens
MRGCLPGAPGGGPRAWLSWKRTEHSRFHPKLYLLAEWVVPTSQVSRAANDPMLEIVGNVTNSSQPRLSNSQLSTVMAAEAAEESIKLQKQTHREETHKEKQERPREYQHTGVKQPQAKERLEPPEAGRGRGRFSLRAFGGSTPY

SEQ ID NO: 922641 - protein, 171 aa, Homo sapiens
MPTPLSKSTFLCLWDSFLLQDRLLHMAGDTAGNKIHASQISLCHPDRIARCHCGVNISHITFQSHSHDSGPVFHPSGFWSNLQCILNSCPKCCFDAVLLTALEDITSPVPLSHGCCFSLSLPLQTPVGLKLYSWSSIAACKPLRFYLKSPSLWNQAIRPCPPPSLSLLFTH

SEQ ID NO: 922642 - protein, 142 aa, Homo sapiens
MRDPLSHCDPKVSFPCMWKVFHALTCHQQVPSSKGFLTIQTGKNLVDMLLRLEKVDDLESQNLISRPNPATYQMYDFSHIYWRFLLPDTHYNDSKGENKRNHHITSKSTGEGGSADKDFQENPRSMEKDEQDTRKPLLRRVL

SEQ ID NO: 922643 - protein, 150 aa, Homo sapiens
MLSLPPYTAQLIDFSFCYRQQIDRFLFPQSFSRDYLRCSPGHLNLHATSWIALLSLWDSQVSDTRVKDMAGVSLGVCSALITCLHMGGAGHNGREETKGIGIYEGEKAGACVGVWKAPSEPTLASRGQLCVNAAHCYRGLSIACSSDEER

SEQ ID NO: 922644 - protein, 181 aa, Homo sapiens
MTLISKLPLSYFANFSPEASQWSSTQMPAFPRHALSIQSASWTPTCLPVLALESSPLWSLSCFLSPGRTDLGPLLMCTPVPCTPLYKKGVWTQMHKEMRMSCEDTDSEGRQSVKTEADIRTVLPQAKEGLGLSHARRGKEGPSPRGFRGAWPCQHLGLDFYPSELCEAIQLMVLCDSSPRK

SEQ ID NO: 922645 - protein, 148 aa, Homo sapiens
MMMELNRQPKSFQLQLNCCFRNIFYHPESSYKPSGPLWLHDRSQRIAESEQRPQLITSTWSVKDNLIVSKSQRPYNPSHCSHKTSSQLSLLRGGKRDTPGNVLTHIPCRKWRSHKRSVCSSPSMGKENCLVALCSRSTTETLRYLHNA

SEQ ID NO: 922646 - protein, 150 aa, Homo sapiens
MHSISYSANTPFLQGNSSGALLGPALVYLKLDYVQLHSMSSKLALIFKWKRRQMGGGRDLSLCSCFSISRSCGRQTGQYSAFHVMVCRFSLERRKGKSPSSFKHESLAHGLCIRLYFCSSKVRMLSVSDAEEWLSDLEHRFLDPGYSTSQ

SEQ ID NO: 922647 - protein, 143 aa, Homo sapiens
MSEYLLSNKSEGSLDPAKRRVVRILYPHLPIQTQAWYLPTCRSCSFLSVWLLESPFSNDLIHLPESTVVCPDWGVQTHLEGAEQRATLLLYCHKSDSMSQHSLGAHKMVISKDSWQSPIAHLPLGHRRAAVSLCTLAHVFDKN

SEQ ID NO: 922648 - protein, 148 aa, Homo sapiens
MKLENMLGFRMCSVESETLEMPPSRDQQHWPCPPGFDSSCFSHILWLARQAHAPSILPSPPPTLDLCGVVEADGLAARQRFFPLKLLSIPKSWELTESLWNLLLNGQPMVEASEHGRTSASLGQRLGRSLESFPEPNVRSKAKRGWGN

SEQ ID NO: 922649 - protein, 140 aa, Homo sapiens
MYYLYGDRALHSVLPDISLTPPAKGHQVDSSYQDGKSLWLSLVFVSLPYPDPASIKYSKRNQAPKEGLRSVSHGELPPTKPGLVNRNQPPAWVPPARPAGRKAAKAADLTKEFSITFTCAWCKKGKEGGKNPSGIQKESH

SEQ ID NO: 922650 - protein, 139 aa, Homo sapiens
MHQSHSQSSVLQGHVAGIIPSFIEKVCGCPLAVPWSRETPLCPPKPQQGNLILANDHQMADDHKGAWPFERPFRVEAITLQECQAKQDVACPTLTAKDCARRRSPQDKSRGREKKTAKRSGKTEKEIHLNLENMGQDVF

SEQ ID NO: 922651 - protein, 188 aa, Homo sapiens
MAAQPDGDSSTGQICAAFISLIKPSLLIPPCSLCSCGNFHQLALQRSVCVSRSMEAAGVLADPVLPMQDWRGLGSPAHVPPVHCLCRSLSLRTGSTVNPLCLPDENWVSQEKAASTYSLHLFVPGNVPMFTHARIGLGDLESEMSQQALAKVMVTSMKLLLFQVRSWFDPREASLKSLSWAAWPTMCT

SEQ ID NO: 922652 - protein, 206 aa, Homo sapiens
MASIALQHRTTRMASIALQHRTTRMASIALQHRTTRMASIALQHRTTRMASIALQHRTTRMASIALQHRTTRIPTGRQALLFKTRPQVWQALLFNTGPQEWQALLFNTGPQEWQALLFNTWTTRMASIALQHLDHKNGKHCSSTPDHKNGKHCSSTPDHKNGKHALQHRTTRMASMLFNTGPQEWQALLFNTGPQECSRPLLLLPP

SEQ ID NO: 922653 - protein, 181 aa, Homo sapiens
MQSQKRAARDKRYEASAVPQKCAGWTLVIGGRVRKNRNRDADWEDVAGAQVMVEVTVARLVTALILDEKTEVQRISETYSYSQSFQTSFPPDNNSHNIFPTALKGAFVWTRIQLCLSQHLCMWPYSSGGLATEQAQAFSFGGSVERGRQRLTGRSSCDSGSWQLSCPVRVPNIGTGGTCSG

SEQ ID NO: 922654 - protein, 158 aa, Homo sapiens
MVELGSPPLGRDVGSVPQREQVTFIAPADFPNHQMREGILEHMASFEPPAGHSDQPSHSRQTAQNCPGTLPAFMKNKKCLLFKATGWGQFVRQQKLTDTQVKINLPRGAYHFGVCEEKGIPAKRLTLLNTGGFPGSSPSKILTEIQNIASASNTLLNE

SEQ ID NO: 922655 - protein, 302 aa, Homo sapiens
MRIKYDDRYKGMLYTYQLHSFVRKMEITASSMCRHGEDLKQDNEAGTSSLLHLRRSGCSQLWSSVAPELGSQASLGLPRAHSQALAPRWLEALPVSFGVGMAVGSVDPCEPGAGGSGLSCCGPHGLVGVGCSLAANQDVQMVQEPDPASQARVADCARTRYQLPVSPAGLCAMCHFKENRPSSSTHTAAASCACVPGSQPILPGTRRVTGSFIASLHPAQNLLELLPAEYCWGHALLFTVAVPAQVHRDVIPQELWVKASCPSPGYGQHLSNSSVLGRQLKVEGCGKKIRMENDAELHEDRR

SEQ ID NO: 922656 - protein, 250 aa, Homo sapiens
MGSRPVVQAEHSLPGQVGPAGQLKDVGVEAVCKLHISSITDLRAVKWYLELCRHKMKWLQCLELILVLCFRVLKMESKWIRKGLSISTVQHSSAELHWKLQNAPQRRSENQGRKSAVKGAKWEAKHQLSVTSNELEKRKEGKAIFNEPPALPESSITSLLPPLENACRILAHHSRPSQSLPLSDSKFALPLAKLIQQPNSPCSHPPLISEEGSFLSSISHTSADEGKDHTRRNPKPGPFKPFVPACCLKK

SEQ ID NO: 922657 - protein, 152 aa, Homo sapiens
MQTVASFSALKPPVFNAFWLKRRLPFQAMSISSEKGLVAAAGTGRGGRTRPQGEVPGITASKRGYLPVSQTNMQTTVMSSSFPSGDPIAMSKNGIFILPIFYQGKALGSTAGVLQGLSDSARSHQESCLFPPVILDSAHLSQAPGDLGRHII

SEQ ID NO: 922658 - protein, 157 aa, Homo sapiens
MSAGRSSSEHTGQEQGSGVLNTNACRKTEHQRTRPPAEGRVIPHTCQGRGENVLVEPSFKGGVEEETAWRERTAERKNTNVTEPPAPWEADETSPFFPRQWAAAHALGISMKAGELKCGECFTGKEGAKAEPCYHRGMRAICISRGEHPCSNLSTTL

SEQ ID NO: 922659 - protein, 174 aa, Homo sapiens
MAENSKNQNASSPAKDHNSLPAREQNWMENEFDELTEVGFRRWVLTNSSKLKEHVVTKCKEAKNLEKRLEELLSRITSLEKNVNDLIELKNTAEELHIEGQLNEIKHEDKIRKKRMKKNQQILQEIWDYVKRPSLRLIGIPESDGEKGTKLENTLHYIIQENLPSPERQANIQI

SEQ ID NO: 922660 - protein, 185 aa, Homo sapiens
MRRLALLFLRELNVLPRQLPCKTLLTLLRTVPPPFFASRPLARFKSQQASKGAMQGDPKCHCGPSVRVQAYGDQVINEVLAKWGLEQEKALRQVQTDMKAALQVRPSDPSDPMVVGESMSDKDVIWSVWLAYHNVDSGLYIKEGKWPVVQLYTNSWAVANGEARWSGAWLDHDWKVGDKEVWEEA

SEQ ID NO: 922661 - protein, 155 aa, Homo sapiens
MEAVAAVWIRHDRSLDYSGSHSNEEFGRCLEVQVCSLWQAKDGGDVVMCHSPVLQLCKWPPYMEVEVKTKVTGDEDDGQSCLLHQVMNGSVPFISESWSSCQSTERHRYNVMCQPLMFLFYEINIYNSAVSPLTDCKTCLIGSRHINHKAPLVEG

SEQ ID NO: 922662 - protein, 153 aa, Homo sapiens
MGALPHLIHLHAPWRAWFQMYHHADVYRHISGSFQTEEWEGDDVQARRMCFSPTLKSHSTRDYEVSTVQVREAVQGGRRGMGIQPVGFGIFAPAHSGLNMYVLLKGEKGGLQLPLYKNTVCLSPILNLPKAHFLHCENLLGATHRDTSGTHLS

SEQ ID NO: 922663 - protein, 170 aa, Homo sapiens
MIWVEVAVPRNRRLAHVGEDSGCHPSPGGFTAVLGGLGARPAQKVSQAQISHSLGSTHGKVSWLKKAPQVGMRNREKQEKERQETPQTELTPFNTLPRASSDFDLQMLPTFSGSSSQLVVIKSPPLGVHAEKMRILRDSVSPMFVALFAIVKTWRQPKSLPTNEWKKFGL

SEQ ID NO: 922664 - protein, 147 aa, Homo sapiens
MPEPPTHSMGSCVARASPTSTTPCSTVPSPIDHPRAEECECTAQDWQAAPPAAPLKVCDAPIDTLYLAALLKVCKHTNQHPVFSSRFVNAPIDTLDCKRTNQHPDKTGHSALPISRMWVGPDKKIKAGCQSQHWQPARVPFHTVEAL

SEQ ID NO: 922665 - protein, 137 aa, Homo sapiens
MLYFEGKKITLKLKSKRISSLQFERKLETELYKKCISCKPRRNPSEVQTIPRMVKATKITGNPHFSGETFAAGGWGSRKETNNIGITWKCNRNAISLAPAQTNSSEALGVGLVCFMMPSSECEVVPHCGCDLHLSGD

SEQ ID NO: 922666 - protein, 150 aa, Homo sapiens
MSLGEGFHGKMWPNLGTKWLLLATPLHTLQKEGELHGCLRCGFISCTSVVVEEHGGREDCLGQRPKTVDTEGNVLHTSGCDLFVCSVTDTVTVLLGSVAGDAEEPDSQAPALASGMDQPTHPWPCFSAGKHDSVPKLLIDTYSPLAFCVL

SEQ ID NO: 922667 - protein, 164 aa, Homo sapiens
MAASLQSLHCSLCLHITISCSCVAHRLLQANDFPEDTTSKTLKATRNGIQTGQCLRMGRGDMQEEVARSDEKDLLCFTSDTTSKTLKATRNGIQTGQCLRMGRGDMQEEVARGRRNRPHLLMRSGRFGRICGNEKYCSGHFWSGATDTQTLYVQVCASIAPVQK

SEQ ID NO: 922668 - protein, 142 aa, Homo sapiens
MILSTKLILPQGRDEKQAVLRGKNMPVVGLLILTLVPIVAPRERENEYKVWAPGGRGGSCGPAMLEIDINPMHKFPMFTKEFPWHQNLWEKEESKSGQKEKFICDVCPITVSADHPGRSGARTALQIRLATDQDEQQFLFKC

SEQ ID NO: 922669 - protein, 145 aa, Homo sapiens
MATKALDLHGPHDHYKASGIYSNTNELRKTTGTKERVVAIKILENVEVALELDQGIIRTFKDHYTWSSMKRTVNTMEENPDSTLRKSEENCPDVVHDFTGFNLSFGGVKSSIKNGLQSNKPTLHGLFLLFGGKTAYLRNKTKTLL

SEQ ID NO: 922670 - protein, 253 aa, Homo sapiens
MGVWFPGQWSCSHNHYGCLCCITQVTRELGESRQSQAPLSSYVTHSPKEIYGTLNLRDDLGYLAEEISKKQSIQVVTENKSLENLQPDDAVGKKSPFSGKKFKLAAEICVSNEEPNVNHQDNGENVSRAWAPCCVQPLELVPCTPATPAMAKRGQGTVLAIASEGASSKPWQLPHGVGSRDLDVRHGVQEDHFGTLRFNDCPIGFQTCMGPVAPLFRAYTAAEFSGRPEIGPSPFSTSLASRWQHKSESFFFM

SEQ ID NO: 922671 - protein, 155 aa, Homo sapiens
MSMPSECLQEKETVCRLLYRYLNTEFFCQFLCFVAGTFVNADPVAPFHFAAEDSAEKQRLSLASSGSSGEPQWAGRWHSQSMLEESTELCLQLEVFSFCPQLRRRQHLGSERKDEKIPAGKGSAGKETVYKVTSKLTFLVAFDFHNNSEKQQRQV

SEQ ID NO: 922672 - protein, 172 aa, Homo sapiens
MTVLNFPLKRMYQLRLSVEQDLEQLRFILRGKDQLTRAQASWLRGQTFCQHTSVWGNGKQRHLIPKLHLRHNCSLKPPPSSELLVIRPCGGQRCRCLSFPSFVDVRRNGGETVQQGLRHEQPGQPASDGTDGMQADSRREKARKQILPPGASYGNQPCQPHDFSPVTVIAGF

SEQ ID NO: 922673 - protein, 143 aa, Homo sapiens
MECPHRAFPFLVTQPYHLYRDPQPARAFQKVPFRNPQLCHRSCPLNVVKVGIQNTRALGKTDTCCHLVRQRSANCSCFSLVKSQEMVLNPGRQKGGEGEPGARPTAWDGQRKAILVILNKCSFHTKAARKGGKTVSALKRFAV

SEQ ID NO: 922674 - protein, 146 aa, Homo sapiens
MKKGCFNVSFQEEELEFDCRKICFMAVTNFRGSTQVGCCPEEKWECASPPLQDENHCCLHSASARCLSVPADVEEGTKALPGHLLRQQRCLQDGSFPLMVYDPPSSYLGPASRLKNENERNSQTHVDPGSEAICSLRAMAKCRAFD

SEQ ID NO: 922675 - protein, 212 aa, Homo sapiens
MELMFVGGEYGGNIKPTPFLCLILKMLQIQSEKVKRKKRRMRSWKECHHLIASGEATETWTSPVHLPHCATEGVGVCLPEGGIDLPKVEAPSPAEKGIRARVQDITAADPETGGTDPVPSPQILTVVTDTGATQNLPKGLRRATRRAGEGMNGNTDTEKQSHLLSVPQLVGVQVKLRIRVLVFWPYYISAIFPLQRHNSGLILFRNVEAILV

SEQ ID NO: 922676 - protein, 174 aa, Homo sapiens
MEDVTASPSAMIRNYNGNEKCYEPDAEKVPVARIRRGHKEAIGFHWSGRDSHKVHNTLSGLLDAVMRKNQGSKPLTLYERCPEQAHVFETNSSELSNPGEELQGPTQIWPAHGSPGFLKCRRVKDQGWWLDVPQSPCLWIATNAGEIDCKPVHLDSCSCVSAIDTAVQIPVQRC

SEQ ID NO: 922677 - protein, 142 aa, Homo sapiens
MVPISAWKPCENTNCWATPPEFLIYQRGFSSRWPLNLNWNLGFLGSAACQPLDWNWSFGSPGSPACAVCCSFQTCQPPSCSKDALGGISEKHGLISDRDGQSYPQMIGDSISNGWKTLIKGTASWTCRRKCYGFACVEAPKA

SEQ ID NO: 922678 - protein, 157 aa, Homo sapiens
MLHLGITSVFQVTSSCRQIIRDKNHLELTSTDFSTTFSDYQPIDLLGCCNSNCSFTIESKGKNCNYICINLIASQRRETREMTGQPAALLSSCVFWKILYLTCHLQALGITTLPSLTAMSGEPTATPDDQTLRDRDSTEVIQIADEWLDSQTLTIQF

SEQ ID NO: 922679 - protein, 144 aa, Homo sapiens
MLCNLLYLPEPQCSHLRNGNNSVHIMRLPEQAQGVGSHKENLEMTGKWRQIYRAGFLNYCCSKHVRIIDEIWGKKVIFAQKHNEHLHGLLKMNLKNKIFKQMKKSNPKKKANKIKQQEEKFNTDKIKIIRLSDRYFKICLSCSN

SEQ ID NO: 922680 - protein, 144 aa, Homo sapiens
MGTLDFQFHTIEFILIFSLYIFAAHFSSGKNSGFIILNVLPSLINPSVCDQCPCPPLILPSSNTLLSAWAPNPPFQATCHLRIDALISSGTQPPHICQDPPRERLDPLVHLLLVPPRDLHTRKRSHPPNSDKPELEPWHVCALS

SEQ ID NO: 922681 - protein, 118 aa, Homo sapiens
MISTWPTGKLKHRQSHYAHGSAAQVTDLGPVADFQAGALSLVPSGEWFSSAEIPSSFLFVNPNPPQSADTFQVTFLPDPTSPHQDCDSTTLTKSLRWGQSLFLGSSTFLISFQPTENM

SEQ ID NO: 922682 - protein, 145 aa, Homo sapiens
MVLLPNRDNDKMSSNRKSENNQIKIGISSTLAYFLPYEVVCQNPSREHSDLTHLHAIAQNALQHFSLLTPSEERPHAILNESFIRRSGSWVKAPAPMWEWTDLLAEMNVVAVRLFPCYKGHSSIPLVREREVLHTLLNLESIEKP

SEQ ID NO: 922683 - protein, 184 aa, Homo sapiens
MLLDQRLGSATSPTWSSCSHGTVEVTTPELPLSPLSPWTWPWQSCLPGTSWEAFGPRSPRLPPQLSIVTKIALLGEGSEKLFHGRLAVHKADVFQEMKLQPKPFMEKESRLTGQLLALPGFHNCVESETPGRGPSEEGEEEKPPQPSPSPDDQVRFIWLCPKRLSPLIDEREYRKKNHRVSVWL

SEQ ID NO: 922684 - protein, 140 aa, Homo sapiens
MGCTATVAAHVFVCVSVFRSSYQNTGLQYLEGKFPFVHFGSHKLYASCSGNVCISSCQGAVKPVLPQGSLRAKFDLIGCSPRSKESHGANLRTATNTGSSLHLQWVSMRGFWDMDEAGNHHSQQTNTGTENQTSRVLTHK

SEQ ID NO: 922685 - protein, 153 aa, Homo sapiens
MCRLVTYVYMQHAGALHPLTRHLTLGECKIHGITYAGDYAHNKRNGLPQRDQGKLGFMDPWGAARIPATPLTSYVILVVMGDYIKDSKPKLGVQGKPLGGSDISVETRLNGIFHLQMMLHDLFLMFLWPKARGPLANHWCRTNSPKAEELGVL

SEQ ID NO: 922686 - protein, 134 aa, Homo sapiens
MTSDQTDLTDNYRTLHSNATEYTFFSSAHGTYSKINHTIGHKTILSKFKKPKSYQPHWNYSTIKIEINTRRLLKTIKVHGNIKTCSRVTFRKPTKMNKFLKTYNLPRLNQEEIGTLNGPIIPTRKSPRPDRFSV

SEQ ID NO: 922687 - protein, 141 aa, Homo sapiens
MNQHIWGHQGFGLEISTCASHSQAKRRLQHRSLYPKALYHLDIGPRVEVLESQRAGLGHLGRVPGSLHLEHGQLWRPSCRHQALKMPPLQGQCHLSRATMEPSKVEAWVLLAQISGQFFLLSGFNNLGQDLIRKIANIIEH

SEQ ID NO: 922688 - protein, 131 aa, Homo sapiens
MSVLHTEDPKAGPAKSQDQVSGGGMPSVRGQIQSRIFWEFKLHGAGMGIPGRRSADHEFAVLSFPHFGISGGSLAVHRRAEGARSWPAGSVNISNFTCYSTITFCLMNKQRHYLWISNSQLVDPCEDRDGV

SEQ ID NO: 922689 - protein, 134 aa, Homo sapiens
MASKESADVSDKCSTGDAQGVPDTLAVPFENGMSSFLLKVQDDPSQQNQLHYPDNHTFLHASQDLPIEESRDKIYFLQSLLLLWGSGFDTHYKYLTRKIIPKSLPSSPRFRQIHVVLSEVASSLLCSAEYQGSS

SEQ ID NO: 922690 - protein, 146 aa, Homo sapiens
MPEKKEEAEKTEKAKLDGTNCSRTRGLTSFGPHLVLVWLLVSMTPNRRRFQFAPVLKVPLEQYVENKPELWGHTRSGGGDASDENGDGAEGEDDGSGSDSSDGEEATEKEIGDKGLRDGSFSPNGRGGFCLGRIMLSKPHVTLGRG

SEQ ID NO: 922691 - protein, 136 aa, Homo sapiens
MSCLAYEGHFQVFSWYSINFCSTLVSSFINQSVLSLQFQEFSPSLNDMIMKLSETCIQKCFSGSFPSFPELPKIHHIIGFCVLVWSPGHQTEVHITSDSFQHNQGEWLTPYVPRPHLESNGSKAATCTVKEQTRWH

SEQ ID NO: 922692 - protein, 169 aa, Homo sapiens
MRENHCKNAENSKNQNASSPPNDCNSSPARAQNWMENEIDKLTEVGFRRWVITNSELKEDVLTQCKEAKNLDKRENGTKLENILQDIIRENFPNIAKWANIQIQEIQKTPLRYSSRRATLRCTIIRFSKVETKEKLLRAAREKGQVTYKGSPIRLTADLSAETLQARRE

SEQ ID NO: 922693 - protein, 164 aa, Homo sapiens
MDCYVIDSNGMESNGMQSNGMECNAMEWNRMECSGREWSGIKWNGIEWNGIERNGMESKGMDWNGMDSNGIEWNNMEWYRMEWNAMERNGMEENGMELNGMEWNGNGMECNGIIWNGVEWNAVDTNGMDWNGMDTNGMDWSGMDTNGMEANGMEWNGMEWNGME

SEQ ID NO: 922694 - protein, 488 aa, Homo sapiens
MERTRMEWTGMEWIERNGLERNGLEWKGNEWNGTEWNGLKWIRSEKNYGMESNGMESNGLERNRMERNRIDSNVMDCYVIDSNGMESNGMQSNGMECNAMEWNRMECSGREWSGIKWNGMELKGMEWNRMEWTRMEWIRMESNGTIWNGTEWNGIERNRMEWIYGMESNGMESNGLERNRMERIRIDSNNGMECNGIIWNGVEWNAVDTNGMDWNGMDTNGMDWSGMDTNGMEANGMEWNQMEWNGMEWKGVDSNGMKSSGMESNGMEWNGNESNRMEWSNGMDRYGKTSNGMELTRMEWTGMERTRMEWTGMEWIERNGLERNGLEWKGNEWNGMEWNGLKWIRNEKNYGMESNGMGSNGLERNRMERNRIDSNVMDCYVIDSNGMESNGMQSNGMECNTMEWNRMECSGREWSGIKWNGMEWNGIERNGMESNGMDWNGMDSNGIEWNNMEWYRMEWNAMQRNGMEQNGMELNGMEWNGMEWTQME

SEQ ID NO: 922695 - protein, 160 aa, Homo sapiens
MRKLRHQAPSTHVDPDVEILHNCERNWGNKGWKGLVGRSESQTGQSEKLSMSSHHRGTVREELVVEEYIGGWCLCGSAWKLLVTGLEQLLFSRTRPQEEAVDKTWRTARQLESGTLLCRHCITLPWPSERNGGCFLSPSNMVCKLLFGAQNHNHNMKGFS

SEQ ID NO: 922696 - protein, 134 aa, Homo sapiens
MHLQDTSLSRKGSQSRGNNYANLKCKLSGAPATTCSVLPKLISNSVKNHSPAFILLLSVLLLRVAAEGTLIRQLSWMDLYKNHDVSKAAHGLGKLERILPMERDNITAATTMLSSEQMSDVQRDQVILIRIVEV

SEQ ID NO: 922697 - protein, 185 aa, Homo sapiens
MTDMEHGNQFLPKPVRTILYKLGESAQKPGELTGEEGHSALRPALFHPCTLSCSHPRLLTPCLQETEAQGQSDKNWHVKASRFGYVSFNSKSLVFSTPLEGIIVSGAELQETWGAWAQEKSPGKGEGTEKGDGETQITCFSFTAISGATSSWNKRTLRQSQVEAIDDFQLLPACPEPFGQCFKVS

SEQ ID NO: 922698 - protein, 260 aa, Homo sapiens
MGGSRVVLWGPGLGVVSGEKGLQRVTQLQVKECQQPPGLKRQGTGSPLEPLEGGWPCQHLDLQLLSSFQNCERRSSVVLSHQLVVIWYSSHRKPYANSELDVYEPVEDTFLLLDVLQVAAAELAGVEICLEIGAGCGQMFATNIEGKVDLLVFNPLYVVTPPEEVGSHGIEAAWAAGRNGQEVMHRFFPLVPDLLSPKGLFYLVTIKENNPEDIWKIMKTKGLQGTTALSRQAGQETFSPQVHQVLAYNVCPVLLETECI

SEQ ID NO: 922699 - protein, 119 aa, Homo sapiens
MAANPQTGFSQLREKLTDQWREKMYIITNFTNDVKRAEEKEQGSMRKFYKENKFYIERCVNSDQNVKGLATDGAYSFQAWDVDKTVQSFCYKKPLKPHGSKVHFCYLQAKNSKWDSAFC

SEQ ID NO: 922700 - protein, 138 aa, Homo sapiens
MGSTAGLLDFAGGPLQTLFAFVSPVEAAEQQVLQNSKNCCLILRIEASSQRGSRLYEVSVSPYWDVSPSVGCTHCPPTVQPVPMRCTRYLSCKCRNHPSSASVTLGAADWSCSYSAILEPKAQTFYQSKSVWFLQLSI

SEQ ID NO: 922701 - protein, 153 aa, Homo sapiens
MGSTAGLLDFAGGPLQTLFAFVSPVEAAEQQVLQNSKNCCLILRIEASSQRGSRLYEVSVSPYWDVIVGYHLASGPMSDPWWVLSEFCGTNDEPVNNIWEVNASELLLFSRGLGHQLSAVNIKTSVVHCKPHLGPLAFCFSFPWQAREENVSI

SEQ ID NO: 922702 - protein, 177 aa, Homo sapiens
MENGTAILEDNFSVHQKVIKVTIRSNNSTPSLYLLQIRSQLQQVEEYHNSEQERMRNEISDLTEELHQKEITIATVTKKAALLEKQLKMELEIKEKMLAKQKSMDFTNREQSRHTSINKLQYENERLRNDLAKLHVNGKSTWTNQNTYEETGRYAYQSQIKVEQNEESTGNNEQFME

SEQ ID NO: 922703 - protein, 143 aa, Homo sapiens
MLFLDKLSFIDELSEEAEIEAHEGESQGFPKTILEVESTGYFRMNEKRNPGPDKFTAEFSQRYQLFFGHLAEFGCESWSRDFFERQSSSYFGCQRLHCFVMIFGFLALGYDMLLYLSKIHFIFLIYTLKPTSVTSAISFSGQF

SEQ ID NO: 922704 - protein, 266 aa, Homo sapiens
MDYGFSLQTLPFSIPADTENSLYIVAEKYRKALLGHRGMSITLPLESGSDLQGLVPTDAWYDTTPNKNEYTYYGYKRNTPTKECFTTTVAFLASVFPDQGILHCPCDFSYLGPDQEILHLLCGFSYLGPNHQGNTLPLLLRLLHWSVHRVTWSPRYMKILSQAAGLFLPALLSPGLSITLGGSQFLTPEATAMRQLGAPPHGRGLDPPQRRMGILDGPPNLSEINFQCHERNSIRTLIFSARQFYFYRRVCLTGEAMARASLISFM

SEQ ID NO: 922705 - protein, 159 aa, Homo sapiens
MRILRVLLGRQLPQWNASPEQCVAGPHEGSMQWLNTRKELALRVRTSETWEETAFLGDLKGFSELKNFQELINQSALVHPRVDVWWYCGGPLLGPLPNKWSGTYTLVQLAIPFTLAFHQPEGEKIRHHKAREVPYGSFDSHVYLDAIGVPWGIPGQFTA

SEQ ID NO: 922706 - protein, 160 aa, Homo sapiens
MVFPTLPSSQSGGPLQLPEVNADGELLPLPRVADPPTSPLSDDEEEFDLSLFSPQEEEPGDDPLPPPPIMETVYVNSSSTKLLPPLPEEDMRHSSEWSVSRSSCPFGPLPFSKPTVSFDAPGPLLSEAWNPASPQSASQRPHSPSLPLSLHNGCVSHLFR

SEQ ID NO: 922707 - protein, 145 aa, Homo sapiens
MSVVLLWRNPALYPEDNATEVQRYSSSFGGQSFLTQNNSALKHHGSPVTELGSLQRTMIPPGKEKTIKEPLKAAILGWHMRNWEKPTKIPLAWCGHRALDKFYLMCTEEKHSCHHCWESRGKCERGLDWQGLVRWSGPKIAQQTE

SEQ ID NO: 922708 - protein, 142 aa, Homo sapiens
MKTLRVVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTVRSSKLQQHSRWGEVVMFLFKYTPLSNKSLE

SEQ ID NO: 922709 - protein, 157 aa, Homo sapiens [sequence omitted]

SEQ ID NO: 922710 - protein, 149 aa, Homo sapiens
MERWGTKYYPISTSLPSHRWDPFCSWCLTCISFAPGGALPGRVLHQGLDLQETHNFLGSTSSLCLPKSEWVVGYVCECSGGAVVQEQRIPRKESCTTVTQLVWRSSLIATDSATMDCKGRGAPNSLVVSSLAEGSGRGEALPPTLSAGL

SEQ ID NO: 922711 - protein, 194 aa, Homo sapiens
MQVCYDVETTFNKQDPCNWLELTYTVNFYSEEEPDKTLALFWLSSTVVKESKEPQGYGYSVCMPAFLDYALITQVWNSATCSKYTSKSPDWERQWSPHWIRSTADTLLDPEGWKSAAGLQWQQIAVVDGEQKLSLSRNKHGPEECAVARFNRVKTELPYKGRGPKGGLSSATVYGELPVPLAEPPDVFRPLYLY

SEQ ID NO: 922712 - protein, 174 aa, Homo sapiens
MVGKANWKPSELPLPRKMAHQKLFAISWQGQQYAITVLPQGYINSPALHHSLFGKTLIAFCFCEGSVAAFGLSYNQERGTTPGGPIWIFEATHSSFGCDNMARLMNNYCLFERQLLACYWASVETECLTMGHQVTMRPELPVMNWVLSDQSSHKVGSALEHSIIKWKWYIHDWA

SEQ ID NO: 922713 - protein, 137 aa, Homo sapiens
MSRDGAIAPQSGQQILYSFDVIANGIAFIILFSYCSLLICRNTIFYYNTLSSRVHVHNVQVCYIDIVFLIDNFFLTTCDISFHYLRTSKVFDGKSAHDGIENSFHVKSLLSCCFQDFVFAFVIEKLYYFLNNNNSYD

SEQ ID NO: 922714 - protein, 172 aa, Homo sapiens
MGLPSHQLRTWYKPLVDLLFWDLEDGGPDLNAPLDRAPVGTLWGSNPTFLLCTALVDVLNVGSTPAAEFCLDIQGFPASSELREKECHQGKCQILIKPSEFMRTNLLSENRMGENAPMIQLPPPGPSLDTRKFLQFKHSSVSKLLLNVHIMILISDKSEDFNNSNLAEAELK

SEQ ID NO: 922715 - protein, 150 aa, Homo sapiens
MARLAREECDLSPNQVLCSKGPCSQEHMKKKYSHSASDQRSSPKAQEQTSGRQSLNSHPQITAVNVWKYKMIEYSMVEYKPMCQRLLLSTVHWIAKSESGWQESSLIPKNVETQSKISKEFSKMIQELKDEMHILRKSQTKLLELKNSLQ

SEQ ID NO: 922716 - protein, 144 aa, Homo sapiens
MVACCIHQPIIYIRKSTWSTGLSLVCCDSQCRTFTLAAAAKFLDGHSSSCSVSITLQLVVKMPCSLCLSSELHCRRLALKMFFSEAAFSPHSGLYFEYQADTVAIASSNRVHLHFNTAPNLTQPAAFPPPYGEPPYSTPLRNTF

SEQ ID NO: 922717 - protein, 137 aa, Homo sapiens
MAGCPSETKLPEEESGSNMCHSAIFTVLQPPLVVIPRQTGSQVDLQQTPTDLQLRVLTVRRKTKKQKGHPHQNPILITNFSKLKEDVRTHRKEAKNLEKRLDEWLTRINSIEKTLNDLMELKTMAQELRDTCTSFSS

SEQ ID NO: 922718 - protein, 162 aa, Homo sapiens
MARAHLNKEGEGGLIPDAARDNEPQLFPQTDNTTSLWGLAQDQNQNRRYIHQRGPSRRVGLEKVLKQLKISRQDYTLVLSEGFWTDPTSNCPAGCPQQDLQLSYRKISSFPIRKGHLMVLQAWKFKDMATLASGEGVITWQTRSKEKRTGTKRENLKSIWAL

SEQ ID NO: 922719 - protein, 157 aa, Homo sapiens
MSSEEGLSLPLVFRRTESFHKSLEKPRGCASQGERQGGSALRWSPGACLTEEDLATSSGISFLCISICQLVCQGPEFCWQIECTCLAATLSSRKDLCLRPLALPSVSSLKTTEYMSSLYPVKVEPRAAWYPAGVHGDPEAMLMSQSLMLSSAIFMSV

SEQ ID NO: 922720 - protein, 117 aa, Homo sapiens
METYTLLCFADRWGNRQRYVTLEVTALTFCRLLKTALAFSEQRTIHKNAHGLQCIGVCLQDHRLRPSQKGPGEIIHLITFHLQRIICSFGKHYLIRFFTFFIINIIINFNSFSSKHR

SEQ ID NO: 922721 - protein, 153 aa, Homo sapiens
MRVLYVHQQLGIYTLHMWSTSWPLCQGQRESRVSERWTVIEALNLALAVVRFLSKTWLRPPVFEKVGACPDVLTHMHCDGCFCLFVAPVYAAVLVIKNILWLRWRTIPCDAFSTETSMESTLHAYYYCTGSPNSLMSQVEVRNQDLSVYPLVD

SEQ ID NO: 922722 - protein, 122 aa, Homo sapiens
MQCLNFLPLRLPESPLYPMQAPHPSLLIHPRMSGWCGGQSCSFKTGTQLPVPRGRDRHNRHQRLFTYLRDILALSKICMCLNWRWVGKCVEVVWNFCGSPESSCHCLLHSPSLPGGRVCIIC

SEQ ID NO: 922723 - protein, 153 aa, Homo sapiens
MCPEALGLSQPPELVGPAPPGQRPETLNVSPSTSMGKALCPRQGTSDFWASPPNHDHPPSFSPWSSSESKGDPSGASKCQWSFPSTGLCAGHCGDLPPDDPVILGGPVISLRAGDPLNLTCHADNAKPAASIIWLRKGEVINGATYSKTTNLR

SEQ ID NO: 922724 - protein, 139 aa, Homo sapiens
MVTGQSLAQSCFIPTSPFLQGWFWVPEPSFPGSGWVQAVQHHLSDSRLELVGREGSCLSILSLVGIKWKRIPPRALGPTWGMFRPETVLGRAPGLRDAGGVGRGEAGTPSGFPLFAECSVTHQLDFRALCTLAQASLAL

SEQ ID NO: 922725 - protein, 138 aa, Homo sapiens
MWFEPPFRYCGASVDSSCGVLISNVWGSRGGWQRALSQLLLAMQQSPQDTKAHRQAARHRQMALHQGIGPRHPGAGVNAADSQRFQDKDTPVSLEVFAEPGETAVCVAVNVGVRIDTLLLMFLDVYSEVELLHQMWLS

SEQ ID NO: 922726 - protein, 141 aa, Homo sapiens
MTTFNLNRLLKALAPNTVTLEMSVAKTDTCTEHDLIAISAKCQKGEGINTLNLLGIIHCLTGVFRTIKSLVMIHSVLGEHKKITTQGFSGNQHRVCAYGASLKIWNDSHHVEGFNASLEQKPRWPCQSDSWHKIRCAQMRF

SEQ ID NO: 922727 - protein, 137 aa, Homo sapiens
MLALWGATRGKNCAVFSIYNQMHSISPSSSHLHAQAVMAKRQAEEMEISLPWHLSPSLYHPLHHFSYHLCAEISPVYISRPNLSSMFQTQISTGTSNSTCSQLYRSASLKEQKEERKARRKERTRFFIPHLRSGPCR

SEQ ID NO: 922728 - protein, 148 aa, Homo sapiens
MRKWSLKDAASVACSPQIQNNFGIRLEYFRPKHIIHPGFGSAGNPEFFGKLSEKIWVWCDRHNKLKRAARRGGAAEMQPSTLWFPILVLCFLPALDFYHSTQTELSVCDEVRKECKVSRGAIYSWKTSLAFLSGTSAPSPGESEHTVL

SEQ ID NO: 922729 - protein, 137 aa, Homo sapiens [sequence omitted]

SEQ ID NO: 922730 - protein, 225 aa, Homo sapiens
MTAGHTREANTSSFPDNSSQCCSLDLTVHKKPKQKWLLCGPLPAWYLMIDTAYIFVPFLIFIPWDLKSLGIQGHCSPEFPRAAASVGSRPPALGMSEHGAMEAPSCALRQLPFLATAAFERCHLAEESDKPLHTVWPCVPPASHAPFHLQGLSSYVCGNQDSSAQKSADTKAAKKGEPLRRRIECGAAEGIHEGREEGGKTGRLRKGRRAHPPAFNTQTRPPDLE

SEQ ID NO: 922731 - protein, 127 aa, Homo sapiens
MKEARRERSHIIRFRLSEMVRTEWSFPAESGRMGTADVSQMGLCLSHILVNACQKQVSDVKFHTNNNPDERDCAAHWWYTCLAHFRFSGITNAVIHVDDLAETLTPNSCRRYTIAICPFTNKVDFDH

SEQ ID NO: 922732 - protein, 150 aa, Homo sapiens
MGQVGRQLAITRTTSTGTMTSEFQTMLQHLQPTAENAYEYFTKIASSLFESGINRGRVVALLGFSYRLVLHVYQHGLTGFLGLVTRFVVFMLQHGIARWISQRGGWVAALDLGNSPILNVLVVVGVVLLGQFVVKALTPIPGGLGPLPIL

SEQ ID NO: 922733 - protein, 149 aa, Homo sapiens
MSSNSCEAYRWRLTLLYYSPYIMKGHTTQSVDTWSDYLKSIPKPHKQPSLGYALEGIQQQIKFHWLIKIRNSTTTTTTTTTSTTTTNDVTTYLALTEFQSPLSVDDGLGVGVRDGSVDACLSRRSCPLFLELVKGKTPESDGWGSIDVR

SEQ ID NO: 922734 - protein, 162 aa, Homo sapiens
MAFVNCIGAVGSVAVRMTRKREREREREREARNLTGKKCLPFGRHARLLNGPSDPMGPVIFNPTSDLEFRHDTWSLGKMAALSNRKDKKGKGEREKHCLWQCGEGEMLRGYSRFLGRQKDVTGPRHLPKGEFMDFNNYKDDQLDISEFSVSFAVTELLELER

SEQ ID NO: 922735 - protein, 154 aa, Homo sapiens
MSCYMNMTSRQGTEEETLPKTGRWWSGVQSRGMKWLTVSGQHLSKKMPPATKINKPIRRAESRPEPLGVGPHLQKKAQRFFLGTDGPPAQGLTLCIAILKFLIIFEQDIPHSQFASGPANYAASPGLERQRAVTLYSPRHQVFAVSELYEELRI

SEQ ID NO: 922736 - protein, 173 aa, Homo sapiens
MCNKKIPIVIAGERQVLTEKMNSLHPRNICSEKPVNIVEKFKECRSLLVSALQTGEVKNIFTEEASKEKVQRKTFLEEAAAQKNRDVTNLLFFPRPGSQEFSKLQATQGPRFSSLFAGSSPHLRALQNPALLMNKHRCVCGAPYTLETMFSFKVFRIAQSGFVNDISGTALSG

SEQ ID NO: 922737 - protein, 164 aa, Homo sapiens
MDRRMEELDKCWSFPFKHLDSRQLAAFGSLLPLLCNLLLRESNEGEKILSAGEEAVRIPVWTKTLLSAKSLLKPPFKFKTSGQTQLLKWKRKDWVGGRQIGLSTVKLRPVFEGCVKHPLFQDVKEKAQSSAVSYLKTMPEAHLMISSPTLKSRVERCVEKRGEA

SEQ ID NO: 922738 - protein, 149 aa, Homo sapiens
MCHLDKEEGQKLVPGTGKGIQGIPELGKAAQEEWLSFEESAAFRHVLHNVKDVAWPEKLSGISQKREEPGGQMLAKAWRRRKSHRWVLNKGQVKSISPTLSKSFHITRNLCKLGTPSGNQSPKAILNFINVISIQPDMSLSLPNMIWSC

SEQ ID NO: 922739 - protein, 187 aa, Homo sapiens
MSDLHGTYYIIETNANYESSDPGAQDKVIDSWKNRQLDTRRPRVTKGVEYGELLKKTDARPQEGECKHLCWPGSLLWSPCWVLKVDEVDSNLGNGARPCLKEEEEEGGGGGGRRRRRRRKKKEEGGERKRKKKEEEEEEEEEEEERGGGGEGEGGRGRRRRRKGGGEEEEEEEEEEGGREEEEELEK

SEQ ID NO: 922740 - protein, 142 aa, Homo sapiens [sequence omitted]

SEQ ID NO: 922741 - protein, 174 aa, Homo sapiens
MCGKYDRGRCYLEGCSHLSAQVKTQLILTEAGRKLAERMLPITSILDPVVVAYLGAAAGSNEELREIAPSLNVRTKPLISLSPWTENGCICTLHGRKEKGLFLCQKCSAEPQRGLRDSYYSDTCNSGPGRPAEKHQGGFLVLLTSRMKLRTFAVSVTALKGDMDPKSEQQQDLL

SEQ ID NO: 922742 - protein, 179 aa, Homo sapiens
MVTRVCWTEVMSIVPNYTGMLDRATASAHTGRAQSPGASAATSHSSVRCSPTAHAAFRISSKHTLYDGPTCNASFLGKQKAPRAFLHCDISGGQQNTDQRLNTGIITTFLHCQKKLVICLFDYSPGLNTEAQELDSILITLEFTKGVCILNVFVLPLRKWRESSQVKQKPSYTFLYVFP

SEQ ID NO: 922743 - protein, 246 aa, Homo sapiens
MVGYFHIWIPGFAILTKPLYKLTKGNLADPIDPKSFPHSFFHSLKTALETAPTPALPDLSQPFSLHTAEVQGCAVGILTQEPGLCPVAFLSKQLDLTVLGWPSCLHAEAAAALILLEALKITNYAQLTLYSSHNFQNLFSSSHLTHILSAPRLLQLYSLFVESPTITIVPGPDFNPASHIIPDTTPDPHDCISLIHLTFTPFPHIPFFPVSHSDHTWFIDGSSTRPNRHTPAKKGYAIVQATSPTS

SEQ ID NO: 922744 - protein, 166 aa, Homo sapiens
MHHQTAPSGPSNWQTCLAVWTDSPVDNVTCESSSLGLLTQWAEQVCSSWNFEVKSAYRALHFGGKQIDPQRTKKGREWGWGNSPSRSNTEPKEPSPHSQGKRPCHQGFGSNTQSYMEFQQSSCSLTPVPGSGKVENSSVHIPRKRAESREPNSTPLQAPLPWHLTT

SEQ ID NO: 922745 - protein, 164 aa, Homo sapiens
MTDSASHNEGCDWNWKFKSQGCSLYHSRAPESLSLLLIPFYFKRNHVLSEAVSESRDPRIWSTGHVSLWLSLLLTCLRAYQVTLSSYSCMSALPTTFSKDCELCKDYMSPILSPGISADPWKSPSALLPASTINSPSLMRMAVTSLCPMQCGMKSTSDAGGPHG

SEQ ID NO: 922746 - protein, 155 aa, Homo sapiens
MRNGSCQEISVYISKRIDYSELEYLSLYSKHKEVQQPVESSYDYLKEKEAEAEIMIHITPAIVISTHSQEFPIYEYIYANTGSCGVIKALTSGVHTGSSSGFRQRLLVVFMHDDLRVQCFMFALHLYPGKLITIQNPFVLLREKQIRIQKSLVVH

SEQ ID NO: 922747 - protein, 161 aa, Homo sapiens
MSLTPHPYPTVVETPYLFPPDPEACVFSSLLMSLKFRINLSKASSLAFHCFANYYFSAYQVFRIKNGENCLHLLMRGAERSGHSKPQGNGRGNIPNLVISRNNGWCNICETASKCTWMNIECIISSGEQLWTMGDVLESLPLPIDVVINCMQWINSSCEED

SEQ ID NO: 922748 - protein, 225 aa, Homo sapiens
MVPLLWSCLPVPRHALSLFSPWVVDGTGRVEHGAALIGEAPAAQEPTESGESQAWWAAGPETCPVGRQLRPGENLSTAAAGPGAKPGRPAAPSAGSAQPTPTRNSRWPASTARSPGSRLRLSLHTSPQAEGAGSGLCQPRKGLPECSGGLKGSSSAAKVGAQAEEARRASESWQQSCPGQRSPKVQSALNILHSYLSGLGPTGFFRWLSGDVLLGDQNFGIRYLP

SEQ ID NO: 922749 - protein, 153 aa, Homo sapiens
MFRCNENEPCLAYEGNLAHQVAFASGSNKNALQNSFCNQAAWVEYSPADSRKILNVKTVQYGKRTYDRAVAECEITHVPKCLPTTWNTRPHAAGPPPQVKASVQLKRSFDTLETEVEPRGWKSLPVTTEFSEHNCKYPLGLFGRRMCIIKYSL

SEQ ID NO: 922750 - protein, 157 aa, Homo sapiens
MEKRGRVGWSSREALWSGEGEEEPNKEKQQSTWNISIPPSKAVLEEQPQSPIVPKSGKSVKTFIRNRYEPAKRCEELICAELIRMNKVTTDSAMGIADKDLSEELQCRSCSSIILVVIFFSRDSKLIEAKNEAFVSWGLITLASNTMPHASRCSRNA

SEQ ID NO: 922751 - protein, 438 aa, Homo sapiens [sequence omitted]

SEQ ID NO: 922752 - protein, 179 aa, Homo sapiens
MWVNPNIVYPPGKLEVSGRRKREDLTSTLPSSQPPQKEEDASCSEAAGVESLSQSSSKRSPPRKRFAFSPSTWELTEEEEAEDQEDSSSMALPSPHKRAPLQSRRLRQASSQAGRLWSRPPLNYFHLIALALRNSSPCGLNVQQIYSFTRYVPGALRGGGSGGQGPGLMPSNPSQALGC

SEQ ID NO: 922753 - protein, 153 aa, Homo sapiens
MFMCKAFLHWYVGWGMDEMELTEAESNVKDLMSESQQYQDAMGKQEGEFGEWAEEEVAWSILLLSEGWKSVTDRPGDEKGLYCVASGSGVRDVVLLNGGGQRFWEAHLCQDKELPHRTKSLTGLMGLTGKERDFLALIEACYQKFAEEIRYFP

SEQ ID NO: 922754 - protein, 141 aa, Homo sapiens
MVELVYSPTNSVKVEFPLSQCLAEPGAEPPQKPQTSGATDLQFQPSIVIDTRLQCVRDVAYGVPSKAMMMGPPKALGAQFLSHYVWKAGYQVKKCYSRVWKFNVACPNGCLEDREDICGLLGGEVSMEHTPPSQLRSNEGS

SEQ ID NO: 922755 - protein, 135 aa, Homo sapiens
MQFRSPDSCSNTLLPVQGMGLPESRTVVIVSALLDLATQWSYWALGWYWGVSSESCDVICLQVLQPRIVAPAPAELPSRDGSFLGDFLKFVFQHSIDYYGNMFYFVNYDNNKCEDLQSVTLLITPSATWKMSVKM

SEQ ID NO: 922756 - protein, 490 aa, Homo sapiens
MQQMSSFWKTRRASESMFLKIKKKKSQMASRVLSLDGLTQENSWIQEESDKGMVALCVLIFSQMSESVLLHMPQPVNPEFPTGPITGPVDRLNHFRGHWSNKDILRLLECMENNRPSDDNSTFSSTQSYMDWGKVAFKNFSGEMCRLKWLEISCNLRKFGTLKELVLEAKKCVKKMNKSQKYRNCPDFPKRPLTAYNRFFKESWPQYSQMYPGMRSQELTKILSKKYRELPEQMKQKYIQDFQKEKQEFEEKLARFREEHPDLVQKAKKSSVSKRTQNKVQKKFQKNIEEVRSLPKTDRFFKKVKFHGEPQKPPMNGYHKFHQDSWSSKELQHLSVRERMVEIGRRWQRIPQSQKDHFKSQAEELQKQYKVKLDLWLKTLSPENYAAYKESTYAKGKNMAMTGGPDPRLKQADPQSSSAKGLQEGFGEGQGLQAAGTDSSQTIWVNCHVSMEPEENRKKDREKEESSNSSDCSSGEEIEVDNSCTSVTLF

SEQ ID NO: 922757 - protein, 191 aa, Homo sapiens
MQKPQPVNPELTSWCITGVLDMLNNFRVDNALSTEMTPCYISLSEDVRYVIFGDDHLSAPTDPQGVDSFAVWGAQAFTSGKHYWEVDVTLSSNWILGVCRDSRTADTNIVIDSDERFFLISSKRSNHYSLSTNSPPLIQYVQRPLGRVGVFLDYDNGSVSFFDVSKGSLIYGFPPSSFSSPLRPFFCFGCT

SEQ ID NO: 922758 - protein, 239 aa, Homo sapiens
MAPKNNQTGASGKSSRQGNTQIRLAHFHEQDHTVTKDQNHQEGHGQLQLAGGVDKALRIFAPSSVQGQKRQFHCRGSVRGLFVAPGSATSNKLGATATGRVQPGDRAALLLAQARGSACWEAGVKGSQRGETGILLVGGCGMLFAWMKPSGALFLSQAECIRGRTTPVAVAEGLFIASGSLSPGKLRASTSCCVHPWVGQLFCGPELVALPGDELGGGGSREEELDSSPFGGCCMGVPG

SEQ ID NO: 922759 - protein, 126 aa, Homo sapiens
MRSWIRLMKHFVPWWRGYVLLGGKPLVWDAGIPQNYQDERLSLLLCRLWPPLPLGVQAQVYSNSVPEPLAGVIGETARKPHTLRKDVSGYDYTTSRKTRKPNRQKSDNSKYYQEYGVIQIIIFFGV

SEQ ID NO: 922760 - protein, 136 aa, Homo sapiens
MVTPVISIPSILWGALELEQPYRIVLYQGKDLHLFTAPSITYCMMMAFPAKDSKLMHQQALPLKGEKWSHSVLKWYLGGSLQHPLPTGHIRNLHNSPSHHKHGGLGGKNCFMGQVQARPAVYNLGTWCPAFQSLQP

SEQ ID NO: 922761 - protein, 213 aa, Homo sapiens
MDEYSKLVTVEWGAAEKLPENVEATLELGNRQRLKQFGGRRRQEMWESLKLPRDLLNGFDQKPDNDMDNKIQLKWSQMEMNFLGAEAKVQLRLLLQRVEAPRPWQLPCGVDPAGAQKSRIEVWAPLPSLQKMYGNPWMPRQKFAAGVRPSWRPSARAVQKENVGTEPPHRVPTGVPPSGAMRRGLLSSRPQKGRSTDSLPLHLEKPPALNANP

SEQ ID NO: 922762 - protein, 175 aa, Homo sapiens
MQKSSGWHLVGAPLGQSFQKKEQAAIFAVLQALPVISRQTGFGVDLKQTPADLQQKVLTIRRKTKKQEQYQHQQKGCPLRDPTGRSPTSKTKATQQNWMENEFDKLTEVGFRRWVINSSELKEHVLTQCKEAKNLEKRLDKSVTTITNLEKDINDLMELKYTAWELHEAYTSTDS

SEQ ID NO: 922763 - protein, 135 aa, Homo sapiens
MNCLLAWWLGEIPIFGHRNLMFVKDVYMCHVVVGGIGTAPVYSSQRERRRRRVISAFPTESEKGDRRHLENLVTHTLILSFSNGLSKQHTRRSYPVPCSDAPTPTEPRTLLAQQSEIKLQGGSEAGGGAPAIAQA

SEQ ID NO: 922764 - protein, 132 aa, Homo sapiens
MARENEEETKVESCDKPIGSHETYSYHKNSTRKTSPHDSITSFWVPSTTAGILGDRIQVEIWMGTQPNHIIPPLASPKLNSSLLCNCRLNTTWKLAPLYWYQFTVLVRFHAADKDIPETGKKKRFNWTYTSM

SEQ ID NO: 922765 - protein, 476 aa, Homo sapiens
MPEAWAGDRGTSQMASRVLSLDGLTQENSWIQEESDKGMVALCVLIFSQMSESVLLHMLQPVNPELPTGPITGPVDRLNHFRGHWSNKDILRLLECMENNRPSDDNSTFSSTQSHMDWGKVAFKNFSGEMCRLKWLEISCNLRKFGTLKELVLEAKKCVKKMNKSQKYRNGPDFPKRPLTAYNRFFKESWPQYSQMYPGMRSQELTKILSKKYRELPEQMKQKYIQDFRKEKQEFEEKLARFREEHPDLVQKAKKSSVSKRTQNKVQKKFQKNIEEVRSLPKTDRFFKKVKFHGEPQKPPMNGYHKFHQDSWSSKEMQHLSVRERMVEIGRRWQRIPQSQKDHFKSQAEELQKQYKVKLDLWLKTLSPENYAAYKESTYAKGKNMAMTGGPDPRLKQADPQSSSAKGLQEGFGEGQGLQAAGTDSSQTIWVNCHVSMEPEENRKKDREKEESSNSSDCSSGEEIEVDNSCTSVTLF

SEQ ID NO: 922766 - protein, 252 aa, Homo sapiens
MNSGILQVFQGELICPLCMNYFIDPVTIDCGHSFCRPCFYLNWQDIPFLVQCSECTKSTEQINLKTNIHLKKMASLARKVSLWLFLSSEEQMCGTHRETKKIFCEVDRSLLCLLCSSSQEHRYHRHRPIEWAAEEHRKMPAFHHEEEKHNLEMLKKKGKEIFHRLHLSKAKMAHRMEILRGMYEELNEMCHKPDVELLQGKGPSYFIHQPQNFVEWSRSESVLLHMPQPLNPELSAGPITGLRDRLNQFREW

SEQ ID NO: 922767 - protein, 152 aa, Homo sapiens [sequence omitted]

SEQ ID NO: 922768 - protein, 136 aa, Homo sapiens
MEEKPTFLPDTTTGHGIPPVSMREDGKYQWGSREAPHSPDFRPQAPQGKHPGQQSQVPSHPLEEVEDTELKFRYGDVTQGFEHSPSNGDWMLPVLSTSTFHGEGTKMKDRTTAVKVLQECHHFKCAIECVEDFHNL

SEQ ID NO: 922769 - protein, 154 aa, Homo sapiens
MESSTGFPFEIHKGCTGNGLEPWCLKWQSFQGTSGGLCPCTTNARSTAGPQRLLAPNIGAGSAFFFDFDASQILGCSLVSFFGDGCQPTSKPVKAVSDFDGRGGDLSGRGGRRRGLIAGPGICSHRACGASRGCCWLQPLGAGLAGKIHLSRKV

SEQ ID NO: 922770 - protein, 264 aa, Homo sapiens
MPEIFQDRRRKKYARRDHKKVAMPISGRCGIPRGDGPRAPGEGEEPGGKVDADKTPVERAGQQAPQDIACSKGGLGFRAHAHQRDHIKRLQLPGVNKPMGSAGAGRGPWERFRFRGLLEIGLRLTDLWGPGGLVRTLAFALSKRVPEYKSTKAAALSGKGRRPASPPPVLTTTEILLSTDPWQTCGRNWRPPARNGCGGPWIWPPGPPEPRGCCLKGAPPSLGHTSTVASWPLVTPLSPHEAMGTSMTAPHLGWVLAWPSEALH

SEQ ID NO: 922771 - protein, 129 aa, Homo sapiens
MSCHRILAGHQGHARKLRTCILTSTELCLKRRHVGSISTPRHDVQDSSGHLVSAITTTTTMARGFQALSKWCWPGLSWDFLTISDRRKKKDIVERWLSFWREKTLPLGMKFEEPSTCGVWDSSFSTKGL

SEQ ID NO: 922772 - protein, 378 aa, Homo sapiens
MWNCKDSGHSVCGPCYDILSRGLHPVGQSFPSYLWGLVNLQVGAALWREASPGDRGWDASLSIERNPGAPGVPTPSHCQGYGKDACLPPPMAGTPCAFGLQQQKSGVTRGRPDVTTLFTSSLAGPTGHSLDRFSEPLSFFLQGPPRKEKTPSTLDARLLITQTLLPQRPQVTPDSLTPCKQGNCQHLARAMSAAMGWGELQSLELAELAFKAKTSSSLCSLLVQPPIRPWGGQQLGDAASAFSGLHLAGETKQRHRKQRVKRGLAQKGDPSSKKVAPWLSSCHPDDWPTHGQWGLSRGRRGGFGGSHLLCMELGRTGGSHLATQKTHLGQFCKKTKATHCHFGGIHLGSNACGPLSPRGPSEQTWPPLALCVQHSPAQ

SEQ ID NO: 922773 - protein, 156 aa, Homo sapiens
MKRSHEIQGGEIGTQGYWRSYETISFIEGPPKECCSFRHSLCSVHAIQPNLPGPQWIGWCPLTLRDGQSSLHNPLIPTPMSSGNTFTDTPRNNALLLSEYPLTWSRTCSNNSEAFCPVSDSSGNVFSGRSLSTKVVASFKWIFSSWQGSILLVFTY

SEQ ID NO: 922774 - protein, 203 aa, Homo sapiens
MTLTFLLPDYGEAQEANPRPETPDTPNPRPETPDTPNPRPEIPDAPNPRSETPDTPNPRPEIPDAPNPRPETPDTPNPRSEIPDTPNPRPEIPNAPNPRPEIPDAPNPRPETPDTPNPRPETPDTPNPRPEIPDAPNPRPEIPDAPNPRPEIPDAPNPRPEIPDALNPRPETHDAPNPRPDTPHTPNPRPETPDAAVLTPGSK

SEQ ID NO: 922775 - protein, 203 aa, Homo sapiens [sequence omitted]

SEQ ID NO: 922776 - protein, 204 aa, Homo sapiens
MPLTTATSTNTGFGASGISGLGFGVSGVSDLGFGASGISGLGFGVSGVSGLGFGVSGVSGLGFASCQGRGQPGPSHVSGLDLGLVLCMPGPDPLLKSKRTHQVIHEGFASMTQTTPTRTLLQAWGSNSNMGFGEDMGTVPKTWQLDASEHTDGGCYQEGERSHNNTGLQVHLPIPGTLQHHFQFPGNRATNIGGKTPFQYEDAF

SEQ ID NO: 922777 - protein, 153 aa, Homo sapiens
MELASSWLLGRPREAYDHGRRSHKNSLSQRQHQAMRDLPPGPRHLPAGLTSSIEDYSSTRDVGKDKYLNYVTTELRKFSQGLVAVSQERQAKVHPGCLHLQILLRELAVPDSPQPLCGITLLGGEPMQATPCSLSHPCLEQCLAQARHTGVLS

SEQ ID NO: 922778 - protein, 176 aa, Homo sapiens
MKAARAAGQPPRHLVHGPGPVRPAGLVAGPFPALTPNRRPGRTSAAVTHCAQRKNKASLPDSWALEGPKKSLSPRACAAPASFSWGNQDATSGPLGQCGASAWAPGPNILTGLHACPHKPEYRQTGKMGSEAVCQLEMQDWVTRIKGDDKTCPSKLGQSPRSPADYSLCTEDKGSL

SEQ ID NO: 922779 - protein, 147 aa, Homo sapiens
MQRFDDFTSINRHADHCQFSGITAPDTPGCIIFAPGWNIPSHGQGVQPPSLEMLCCKCPEMCISLAGAGLTAPNRSWQQALTGSTGAPGSSKPSGKNLDFDTRQPGFKSWPLPLVAVDFWPSHLTPLSLSFLVYTYGGKNSTYLMRA

SEQ ID NO: 922780 - protein, 326 aa, Homo sapiens
MSSKGSIVLACSGSLDTFCILVWLKEQGYDVIAYLASIGQKEDFQEARKKALKPGAKKMLIEDVNREFVEEFIWPAMQSSTLYEDRYLLGTSLARPCITHKQVEVAQREGAKYVSHGTTGKGNDQGHSDLTEYAKQRGIPTPVTPKNPWSMDENLMHISCEAGILENPENQAPPALYTKTQDPAKTPNTPDILEIEFKKGVPVKVTNVKDSATHQTSLELFMYLNEVAGKHSVGNIAIVENRFIGTKSRGIYRAPAGTILCYAHLDIEAFTMYREVHKIKQCRGLKFAELVARSLQNRPPYKEELGPPQFADRPSKGANCCDNLYL

SEQ ID NO: 922781 - protein, 196 aa, Homo sapiens
MQSVYYSTTEVNGKLQQPNSLANPGRTTNDPDPSGMKVCATPPGKKPQPAEVLAEDKRNTEWVVEAPSPTNHDPRNTHLTSPLNVGPTKQEAVPRAERYNFLFKGDQLETQVCVLEVRGRCLRRERLKGEERRMWVEKRLEGGTSVNWPVVQKVLKPGAKSTGNHEFPSRPCVFEADPWKSRNPWLGFWSGWETVY

SEQ ID NO: 922782 - protein, 138 aa, Homo sapiens
MLITLESIAISAKRIIGLLPKEVLLNKLKDLRQLEEKVSVRRTAKGHPYQSPGAELTSVENSTHRDRSPGKFPRILKRPRLMVCELPTKTPRSEKCYLAVLVSGMQLYPSSTKAALYRVLLIISGVVRFVPLHGMKNV

SEQ ID NO: 922783 - protein, 141 aa, Homo sapiens
MEWEGGLPLEMGRPVAGLSSDCPWLTNPQRLHCSTVAGQPAPAGVCRFPHYSIYCKQPGQRCLGCGVDSSWLGAILAIVSKGNKVGYTKHHPVIKWKRYIQYLASAGPQGTHKLHEQVTPIHMYTFSAISLPLSQSTSVVS

SEQ ID NO: 922784 - protein, 168 aa, Homo sapiens
MTKSEDPHPVTTATSGLQEALQATADVPLRLRVPHSVCGEYFLVWDSPFREMVSPLARSRFRNDIQEPSTESSAPKAHFVLHTPVAELFAGNKSCQDWFLPFKAANFFMAQGVSRNVQELAGWKGGLMTLTGALYCFGCAGIQDARQSPPHSSISSPQAEERGLKNEK

SEQ ID NO: 922785 - protein, 144 aa, Homo sapiens
MAASLSDEGTLTGFVDDSLLVSSNGREKREREQMLMSFNRGRLQAEEQGSQSKSQNLKSREADSAAFGLWLKARESLANHWYAQTGTSHKSGLPELLTTQLQVGVHMTPPLRTEALYPLNSSSPSHCPAHFHLPQPPGHLFLSL

SEQ ID NO: 922786 - protein, 157 aa, Homo sapiens
MCGVISEASSGPSAAGLLEFAGGPLQTLFAWVSSAEAAEQQRLLPAGRCLPVRRHGELAGRDGRLSLLKLLPQPPLPPGALSQGDGNFIYKPLPGAAVFFSEMPCPERRSLERQSGYSGFAELWRSPLSWNLPVLCLNCEGKTAYSSLNNGGRPSPD

SEQ ID NO: 922787 - protein, 206 aa, Homo sapiens
MRPELPIINWVLSGPSSHKVGYAQQHSIIKWKWYIHDQFRAGPEGTTTPVIAQWAHEQSGHGGRHGGYAWTQQHGLPLTKADLAMATAECPICQQQKPTLSPRYGTIPQGDQPATWWQVDYIGPLASRKGQRMVSENKIKENSDQNAQGMLLLSCEVDPSLLNLHFTFPVAASDPGSSVPLSTTVDSLPQCTLTLHMGQVVNLRWF

SEQ ID NO: 922788 - protein, 170 aa, Homo sapiens
MPHTPYALFTAEDPPPGHVSCCSLDRKPIPKTRSIAKEEGFNQVLQLSRREISLKSICLTDYNERANIHVLDTNIVSCQGILTASVLCLLLCAPVSEGIWPDLHRCITFPSTGKFSVKEKWQVNLDLDVQIYGSSMTISLSCKNECFTFTGKPHMEESYSYPKCSKQTSK

SEQ ID NO: 922789 - protein, 142 aa, Homo sapiens
MFGVSLSLVSLAAQDCLLQFSFIFLMLLFIAEEKKSRKQRPLNKSNFTEKPVLKKGLSDLQFGILHAFRRISSKSQESDILLNANSNVKALRKIENTIIGNIEGSSTVQFATVTGQSLHKAEGHYNVVNSTLNPVYIKMILH

SEQ ID NO: 922790 - protein, 142 aa, Homo sapiens
MGCHSTVKCKGFCRQAGGCKLTVEPQWGQDPSRCEPSTAYWAKQAERGQWASSAAWTEVVAAAEISGWQSNTGGVLTKPNEGFVRAFVMDSKPISNIKICSDKDINLAKNDIRGIIHISLGLSKGVCIMKQCLNKRSDLSIV

SEQ ID NO: 922791 - protein, 178 aa, Homo sapiens
MITEVKRQQRRFSGQIKPSKMNLTQSLEDRKTYKSTACSILIQKEQQGKRPEEGAYCGFQNTIEEEREFNPRLNYSTINGLCYVLQVCLCGNCSCKIEGRVGTEYSLPVENSVQETGKRKVPVSMHTFSLQIDQMTVTLERMEQYRIKNNGNNTGRTVNMTSPVEISDQSTINGYKIN

SEQ ID NO: 922792 - protein, 164 aa, Homo sapiens
MLVVAEIRVTLSYWWWIHTGLQQLQFCLFRRNDYTEGHIAEKETKASSKAGDKVYFKRLLNRKERKICLQETQVDKNGHLTLILGLYRLAPFPGFFFSERRSNKRLHECCSLWKWSLGSIKQRRMKNNASVPESFETMWITCLSTFYLSNRRREHTFTFFSTVE

SEQ ID NO: 922793 - protein, 138 aa, Homo sapiens
MNPQGRNEQLQARHVQCCVKKPVEVNPSSLSQKNGTYGPASGSGSNNSKHHVNLNSRVPIDSDFCSNYSSKSFGQFEAARPALPNGTIDLWLLQSFSNGDSNRYNTTDTPEASLAYGSLALGSVPCYFSWRDERWCLL

SEQ ID NO: 922794 - protein, 147 aa, Homo sapiens [sequence omitted]

SEQ ID NO: 922795 - protein, 185 aa, Homo sapiens
MGATIQDEIWVGGTAKPYHLWRFINYTCWVPMPRSLLGSQHLCLHRTGITVQGTEEAEAQLKALLEFTWKIEAIGRDLPPAPQEMLLTQSSKCAQDSTNPPHLRCCYLVQASISHLGCCSCLLTGLHKAANILCYINLSAQNHPSNGFHLGQRNSAHEVLCDPSPTTAFLPLFPMLSSFQACSFL

SEQ ID NO: 922796 - protein, 289 aa, Homo sapiens
MRSTVLSIIDVLPHLDLLPPASPPPPVLLPCEDEAPAPMGASLIADLEQLHLPPSPPPPQAPAERPSVQPGPDPLWPVEKELPPPPAEPVEREASTDIRAFCHKTVSPQELAVEAMKRQYHVQFFTCRTCRRQLAGQSFYQKDMRPLCEPCCQDTLQKCSKCGEVVRDHIIRAPGQAFHPACFTCVTCARCSGDESFAPGSQKEVYCLDDFYRKFAPVCSICENPIIPRDGKDAFKIECTGRNFHENCYRYEDCRILLSIEPTDQGCYPLNNHLFCKACHLKQSAAGCC

SEQ ID NO: 922797 - protein, 145 aa, Homo sapiens
MPLTIDGVSQRYLAVFFSFLLLKKTVIGLIRVRLAQRAKKHLLRKPHQEENLSTARGALLGSLSGEVQDSKWELQTQRMGKGSSMDRRWDGRDRNCRVRRRNCSPKANKLALWNPRKAQELRDITEGRVKRGREDREMEGRKLLK

SEQ ID NO: 922798 - protein, 141 aa, Homo sapiens
MLHKYLNSQDSEPSSAWLAAGLVFYKFPALSHCQGSSRSFRKFVPAIALHCCQQVEGDIQSCPLRPDSTSPGLPGSLQGAIPAMPPAPAGICSHKCCCLFELSCCCWSCQELSSPLAEAVSVHKLPWFQPLPVCTGILGLS

SEQ ID NO: 922799 - protein, 145 aa, Homo sapiens
MASHSNAPEHTTREYWAQSQDYPSVKPTPFHINSKLVLGTEEAVFHAEDKNIWWTYHPNYLGRELRGYMGVIICQCRLHPGCAHLWTLNLCTSVPPTPTRLCLPLANWDLQLQLQDNGASHLAASVQAQCARNLGPKEEELRALS

SEQ ID NO: 922800 - protein, 138 aa, Homo sapiens
MNEGDGSSSPHGVVTVKMPAAEGEVQLGLCAPWSYSSFLLVAPPRKLRNEWEKACSITLGTRISTYGFAGDADIQSITGTLGACSSNSSNKEDCCCSYPVQRPLPFTAVPLVSMLLLTAHLLPLTTLMLVMGLWSCLS

SEQ ID NO: 922801 - protein, 151 aa, Homo sapiens
MNHAHEQRRYMPYVCPSFLPSHLHTEFSVPHEHKILVDPQYNTWEKILTIVEETAPIEIKDAKDRITELGCVNAAGTYTCKLTVIDGEIVEMVLNQGDSDSRDDEDVVNAAEKMPIDDMVKMCDGLIEKLEQHTFITEQEIMSVYKVKRNP

SEQ ID NO: 922802 - protein, 147 aa, Homo sapiens
MSLCLRRLQWINSKCPENTTISPPYLWVPHLWIQPLTDWEKWEITKPRFLEEPEREGEEVYSSPDTEKDTTSFLGIQQEAVKGNFDQDILVGFLKKMNNRVESVTNSCTWSCTPKCGLAKRLSKLEGCRPECPGSLPNQQFAFGPVI

SEQ ID NO: 922803 - protein, 163 aa, Homo sapiens
MAWPGLRGLTALALSCFTVGMTLDKITLNKATLDSGDQIADQAMSLNSPSDCGYNLLLSLEVLYPNYRIHNSSLLSWIPFHLSPNKSQFRCLTDRLSLINNCLSLLLSYLLEKGTIPRLQDLEMLNRQPSIDPGASKEPCFTRKAEDDHNGCQLCSPETTSWG

SEQ ID NO: 922804 - protein, 173 aa, Homo sapiens
MAVNIDETSLAHPLFTSCCVDQYWSMALGLETPALELQNYPLHRMPVLLWDGGGVVLLIQDWFSYVFSTSFSDMKLRPGTIDDPNSNLEEAINEAEAITSVNSLGSKQALNTDYLDSDYQRGQLYPFSLSSDVQVATFTLTNSAPMTQSFQERWEAFTEGVTKLNLTFSSYVQ

SEQ ID NO: 922805 - protein, 600 aa, Homo sapiens
MTFYPTMEEFADFNTYVAYMESQGAHRAGLAKVIPPKEWKARQMYDDIEDILIATPLQQVTSGQGGVFTQYHKKKKAMRVGQYRHLANSKKYQTPPHQNFADLEQRYWKSHPGNPPIYGADISGSLFEESTKQWNLGHLGTILDLLEQECGVVIEGVNTPYLYFGMWKTTFAWHTEDMDLYSINYLHFGEPKTWYVVPPEHGQRLECLARELFPGNSRGCEGFLRHKVALISPTVLKKNGIPFNRMTQEAGEFMVTFPYGYHAGFNHGFNCAEAINFATPRWIDYGKVASQCSCGEARVTFSMDAFVRILQPESYELWKHRQDLTVVDYMEPRVAESQEPSNWREDIALRRAALGLRHLRNHITSCPTRTVAPRLCYNPKGGGTDAVPGSAIQALETSAWVLPPSTGRWGPCRGCGRGRGRGRGRGRRPRELGTEETTVQSAAKRRLSVGTGSRAPGRKPQLQFADEALTDKPAPLSGGLPHFAKASGCCCAPDLQPLGPPLDPDEPMHPGPCLLSLDSTASSLPLVVPMTPPSVTVPLITLSRDTGGDWKSPVNLAKVVAMDHSYASRVIVTKISENVEVALELGNQQTLEECGGPRRL

SEQ ID NO: 922806 - protein, 628 aa, Homo sapiens
MTFYPTMEEFADFNTYVAYMESQGAHQAGLAKVIPPKEWKARQMYDDIEDILIATPLQQVTSGQGGVFTQYHKKKKAMRVGQYRRLANSKKYQTPPHQNFADLEQRYWKSHPGNPPIYGADISGSLFEESTKQWNLGHLGTILDLLEQECGVVIEGVNTPYLYFGMWKTTFAWHTEDMDLYSINYLHFGEPKTWYVVPPEHGQHLERLARELFPDISRGCEAFLRHKVALISPTVLKENGIPFNCMTQEAGEFMVTFPYGYHAGFNHGFNCAEAINFATPRWIDYGKMASQCSCGESTVTFSMDPFVRIVQPESYELWKHRQDLAIVEHTEPRVAESQELSNWRDDIVLRRAALGLRLLPNLTAQCPTQPVSSGHCYNPKGCGTDAVPGSAFQSSAYHTQTQSLTLGMSARVLLPSTGSWGSGRGRGRGQGQGRGCSRGRGHGCCTRELGTEEPTVQPASKRRLLMGTRMVAFSILPRLLAAAVSLIFNSWGPHWIVMKPCTLACACYPSTALLGHWWGLELIKFTRDTCLVNMGKAVAMDHFYGSRVLTPTKFSRISWAPDSSAGSKDTEFRDIFLQYMINPLDPRLWNMVTNVSVSLIPTPGSEKILYLQWGLVGDDWIMGVVCHE

SEQ ID NO: 922807 - protein, 143 aa, Homo sapiens
MGDDSSMHGTAPEDLPMGHDVEVEDSDIDLTPLSEEDMTLDDPDPTSRKDLLPSHEESVRRQHVAVAVSSTSSDWHQSLIQSNALTFFNSVEAERGEEAEGEKFEASRCWFMKFKERSHLPNMKVQGKAASADVEAAEVIRDI

SEQ ID NO: 922808 - protein, 156 aa, Homo sapiens
MYGQSFLKDLAYKLNNTVTYLLFPILFQKDGLRFKTFEQICSKTNKHHIETREHRDNCSMPSLLHLTLAVAAAAPTHTRTWRLGLCLLESLTGFPGSYSLLAAGMRMLLSCALSEWAQVLLIATQAYTCPRFWDWVGYVCVALSWPPTDRGYGFLP

SEQ ID NO: 922809 - protein, 176 aa, Homo sapiens
MGYILTHCSLLSALTNTQYSNRNDGEKNKPEEQSSFQPSCSTFLTASLESRLGFSKVPLHREAPGGRVGLKHLHTCAWWTTHSPPQRPHQEVTELLPPGKKFLYCEPHKRIKEVLEEERHIKRDECHIKNPAAVALEGIWSIKRNLPVGGLKPGLPSRNSLLPQAKYYSRHGGLRR

SEQ ID NO: 922810 - protein, 145 aa, Homo sapiens
MSLSLFFQPCVAFGGKDQLKFLSKSNEGKKEWYQFLLVPLVEFGCESIWSWTLVGKLLIIATISDPVIGLFRDSTSSWFSLGRVRYYVPGNVPYTGDTAVNKTGEVLPSWSLLSKSELPTPAWNTKIIFISGSSNRQSNRTLGSN

SEQ ID NO: 922811 - protein, 177 aa, Homo sapiens
MKLPEEGSGSNICCSEIFAVLQPPLLISRQTGSRVDLQQTPTDLQLRALTVRRKTNKQRANPHQNPICTSPSSKTKATEQSWMENDFDELREEGFRRSDFSKLKEDVRTHRKEAKNLEKRLDEWLTRITSVEKSLNDLIELKTMARELHNECTSFSSRFDQLEERVSVIEDQMNEMK

SEQ ID NO: 922812 - protein, 155 aa, Homo sapiens
MPLEREERNEYIKGTAWRNSQNCFPSKFTQNINKSGQINISPRVRRSFLNKDTECCSDEFIPHSENLSFLLHPSSKEISPCLEGFLLFWPLLPGWSSRTFSPYPDLPALAQLLSLTSFPCTHLLACSRHPGLLPFHEHTNLIPASGSFHVLWNMN

SEQ ID NO: 922813 - protein, 547 aa, Homo sapiens
MAFSTTKIQKVGAEGRHCYSLGLWPSWLEEVQAGWVLTGAAGGAQTALPEEVGIYDYHHLTDKKLRVIEEKEIAQAAYLTSDGDGTSGRNKNDDMVPPGKNYTYVWPVREEYAPTPADANCLTWVYHSHIDAPKDICSGLIGPLLVCKEGTRNDVDREFVIMFTLVDENQSWYLNENIKHFCTNPDSVDKKDAVFQRSNKMHARITNISGPSRLCRGVSSTSVFLFPALNGYLFGNFPEPDMCVGESVSWHLFGMGNEIDIHSIYFYGNTFISRGHRTDVVNLFPATFLTTEMIAENPGKWMITCQVSDHLQAGMLGQYNVDNCKSDIFYPKMKGQQRRYFIAAEKILWDYAPQGYNKFSGLPLNASGSDSDLYFTQGDNRIGGKYWKVRYTEFVDATFTKRKRLSAEEAHLGILGPVIKAEVGDTLLVTFANKADKVYSILPHGVIYDKASDAAPNLDGFVKPGAHVKPGETFTYKWTVPESVSPTAGDPPCLTYLYFSAVDPIKDTSSGLVGPLLVCKKGVLNADGTQLCLHDIKHINEKRKTVI

SEQ ID NO: 922814 - protein, 150 aa, Homo sapiens
MIIWGALSRLYERESIIKELRGFASVLASLKSPGSVHSIDEERKFHMCSDNGSRCVGILSLALATAVIIANLLLYFPSGQVLEPAKITDLMKCVPKDLSSHKAIISSGGHLTYAPRAWPAALPLYPVVTYEKTIYLCEIPVPSTECSANG

SEQ ID NO: 922815 - protein, 159 aa, Homo sapiens
MRSFWIRDGPKSNMTGIVIRRGKEIHTGTKEGPVKTKAEIKVLLPQPRNAKDFWHRSSLAQSGSQSLTQTLDARCLVQKQPAQPNRVTLLKPQMSNSPANRGCFCSFPLALTPGMKPDTDYPEDELSTLQWAQHTAASETIFSALTTLAGSSLWWGNWA

SEQ ID NO: 922816 - protein, 128 aa, Homo sapiens
MIQPSRLSFGMEDREFPITEEWDQMAWRCPPKTRLSASAWHMLEPSWTNVGFLYWRNQERLCRFLLTRLAGYLPVGNISDRCACTERRLEAEDLPLSNCCGLLSRVEDSSRDLMVMPGPDAQLAHSAR

SEQ ID NO: 922817 - protein, 140 aa, Homo sapiens
MAYFWTQLYSIDLSLMYNASAFDSEGFSTLAAYIRFFSCTGALMYNEIALHSKAFSTFTAYMGSLSSMSLLMYNKKMMISKASNLLLLPSLLHLSYLAFGSQDLRAAPESLQTLLAVTKHGIHVRNRFLFRCTPARPTGR

SEQ ID NO: 922818 - protein, 247 aa, Homo sapiens
MAHVYLYPTKILPFSYSRSFLHHTLSFLEVFLTAGMERNSSDAKNNTKEKIPMGLPPVGCTHCPTSPNEMNQVPQLEMQKSPIFYVNLTGSCRPELFLFDDLGSDSSGLPELRAFAASILALAPWIHFLSQTVFSHSFDSAGLHCPHDLVLSLITPTSGVFALTIFCILTNQSACTPHSESIKDPALRSLNCVTCTPYLGYMCEKAYLQASGRLGACWLRVDVETVSQRVIARPRCWKSQHFMIPPP

SEQ ID NO: 922819 - protein, 151 aa, Homo sapiens
MQTGRHLPAGADRPKLEKSMKMVRNQHKKAENSKIQNVSSCAKDHNSSLAKEQNWMENELDELAEVGFRRCITTNFSKLKDQVLTQCKEAKNVEKILDELLTRITSLEKNISDLMELKTQHENFVKHTQVSIAESIEQKKGYQGLKINSMK

SEQ ID NO: 922820 - protein, 149 aa, Homo sapiens
MCIFEYKKRVTTCEKGEYEEADIPFVNQRTRRPIYPGQSGPDGEWQEINSEKWYLVVEISKEQNIQELTLVLLKAFSFMYSQIHGLELELTLKREGEHKSLENLQPDDAREKPFSEEKFKPASEICQCENGLEQYLFSTGKFIVDMTKI

SEQ ID NO: 922821 - protein, 179 aa, Homo sapiens
MSVRLPQPCGTISEDVWKCLVVEAKVCCRYLLNGCDQNADSDMDNEVQVEVVTEGNEKLTENWSKNHSCYALARELVSKDVWKFLNVQTEVCCRGRAFMEILNHSSAERKCGVGAPDRVPTGGLPNVTVRSGPLSFRPQNGAQFLQQHDQDVRLGVKGDYFKALSCDDYAAGFQTCMRP

SEQ ID NO: 922822 - protein, 880 aa, Homo sapiens
MDSKYCLVGNHCYPVDTKYCLVGNHCYLVDNKCCLLGNHCYLVNNKYFLVDNHCYLVDDKYFLMGNHHYPPDTKYCLVGNRCYPVDNKYCLVGNHSYLVENKVTTVTQWIISIASQPVDTKYCLVGNHCYPVDNKCCLLGNHCYLVDNMYFLVGNHCYLVDDKYCLMGEHHYRLDTKFCLVGNHCYPVDNKYCLVGNHSYPVDNKSCLVDNKYCLVGNHCYPMDNKYCLMDNHGYPVENKCCLVGKHCYLVDNKCCLVGNHSYPVDTKYCLVGNHCYPMDKYCLVGNHCYPVENKCCLVGNHCCQVDNKCCLVGNHSYLVDTKYCLVGNHCYPVDNKCCLMGSYCYPVDNKYCLVGNHCYLVDDKYCLMGSHHYPPDTEFCFVGNHSYPVGNHCYLVDNKYCFVGNHCYPMDNEYCLLGNHCYHVDNKCCLVGRHAYPMDNKCGLVGNDYYPVDNKYFLMGNHCYPVDNKYCLMDNHCYPVDNKYCLAGNHSYLMDNKHCLVDYHGNPMDNNYCLAGNHCYLVDSKYCLVGNHSYPMDNKYCLMSNHCYPVDNKCCLVGHHCYLMDKCCLMGNHCYLLDNKCFLGGNHCYPVSNKCCLMGNHCYPMDNKYCLTGNQSYPVDNKYCLVGNHGYPVDNTCCLMGNNCCPVYNVLPRGVTTVTWWIILVASRVTTVTRWIISIASQGNHCYPLDNKYCLTGNRCYSVDNKYCLMGNHCYPMDNKYCILGNHCYPVDNKRCLVCKHCDLVNNKCCLVGNHCYLVDNMYRLMGNHCYPLDNKYSLVEKHCDPVDNKYCLVGNHSYPVDNKYCLMVDNKNDLWGNHCYPVDKKYCLVGNHCYPVDNKCCFMGNHCYLVDNECCLVGNQCYPLDNRFYVVGNHCYPL

SEQ ID NO: 922823 - protein, 135 aa, Homo sapiens
MALYVSLKSRITFPNLPIYTLVSVHLHFGQCHSEGNAFSGPEAAKVKGLSFPERAGQIDFLLDLTAGTLAGSSGPRRATSSTSEQREVGELDLITPGYKAEASEEDSVHVCYLPKDGFFMISESEDGKGGREGGP

SEQ ID NO: 922824 - protein, 144 aa, Homo sapiens
MVICLCFCYSFCYFITFCLMWFCRLSPCLLNWPGCPRSPGNTTCKVLAHHQGLAQHVRSIRQIPGDGTRSNGKKCQGFRGPGTVPGLRYMMESWTGGAPLTGSRQASGKDKETILMNCAVVSYGSTWKRQLNWSMGSWRAPRRQ

SEQ ID NO: 922825 - protein, 149 aa, Homo sapiens
MIYLSDLKSTPLSHFLQRSEAAQCDWEADSPAEGPPSLLSPGKGDSLKGTKTYQTRILNIGPHSLLARRVSGERSAVSLMGFPLWTGPSAAGLLEFARGPLQTLFAWVPAAVAAEQRILVNCKCCCLIVPLKVLSQRSTRQCEVSVCPY

SEQ ID NO: 922826 - protein, 150 aa, Homo sapiens
MVRGAKWSLRLDMGLGPLQTLLEEGHTPVAQRSSRTSSLGRRPPEKILFIFPARRTTSISPVRGMGFFLKIWMRILAFPISYLFWRHWPTGPRKLPCAASRVPLTLFFPLPGMPGFGKDASAGSGSGPLSVKLCLTFFRVSSLSPLLVFP

SEQ ID NO: 922827 - protein, 141 aa, Homo sapiens
MYRQGNEASQESVGPSLKRGLGKERGEDVKNKLNIRNRDLWASECSQLRSFKEKASAENLHEDSPMSGFDSTPVEKGKSGFWWTTSILYCWCFKSQVETQQAVGRGSRAERGGEERQPLLAAFNQGDLFDASDDGPQSMDG

SEQ ID NO: 922828 - protein, 189 aa, Homo sapiens
MLKPLVSVFHARGNENGPLDYLCPQVVAHVSIERHVNCSYRPFACPEVSSESQRLESKTLELYLMFYCISAELALKLQDASLPTLSIFFQRQRSLILWPWPTKAHRKYCQTTTDVPLHGLFSQLVVDVAWPGTHCSGQWAPLWPRASPEILTKSQTLELGTLRGHLVLYPPVAELVPKVKDKCKDNDMK

SEQ ID NO: 922829 - protein, 146 aa, Homo sapiens
MGIEDSGNRNPENRVEIPGDEVLAGKAEMSFAGSQPHRKAEYSRLDGELEDNSLITNAAFESGKLLSFRVRKDAATKRCDSSRQQPSPNTKLAGALILNFPASKTVRNKFLFFMHHPASEPESTMSFCSGSVHIPLGKLQWALPLG

SEQ ID NO: 922830 - protein, 136 aa, Homo sapiens
MGKKQSRKTGNSRKQSTSPPPKECSSSPAMEQSWMENDFDKEKRIKRNEQSLQEIWDYVKRPNLRLIGVPESDGENGTKLENTLQDIIQENFPNLARQANIQIQEIQRTPQRYSSRRETPRHIIVRFTKVEMKEKC

SEQ ID NO: 922831 - protein, 151 aa, Homo sapiens
MVQPLWRAVWQFLIKVNILLPYNPEIVLLGIYPKEVKAYVYAKACTQMFIAALFIIAKTWKKLRCPSAGEWINCGTSRQWNIIQCYKGRHKRLQFTIANDNLILSVRGSCQVPKTMEAHPLHHRALDTHRQKELALSEMRLWTWTFVLMLE

SEQ ID NO: 922832 - protein, 189 aa, Homo sapiens
MLPNSTEFILRQPALLLPAMVSVVLCAPTPDSALENSHSVEITAKFSWKFPSPCGLFPNQLAAHPKDPCEIKSEMGSLGAGSAFRALPAASSTFIFASLSKFTSALGKVKTFSDDLDFQSSCGAATLKAFAVEIPESQTSDYYCSSGTSQPVGLPHSRLVLGNVCKGSGVVIHLQVSQQWVPARVSLHF

SEQ ID NO: 922833 - protein, 147 aa, Homo sapiens
MLCCPELEEKQCGQGKGYMELGMFKMAAPSSFLFASHVYSKEQAIWHRPGDPFPEVWETLQRSPWRKQYSVKLVRNNLAQEMGLFGKCLTESEEQPCGQEMKSEGVEAVFCTESVPGWEQDDQMRQFIIWVVPADPSSAGSAKYVKP

SEQ ID NO: 922834 - protein, 171 aa, Homo sapiens
MRKMSPGHVRGLHGSPSHQRPGGLGGKSGFVGQAQGPCVVCSLGTWCPMSQPLKPGLKEAKIELGLWLQMVQASSLSSFHLVLGLAVQKGNVGLQPPDRVPTEAPPSGAQISLLRPDDFKKRSSPEQVLSLSLPAAIHVRCDLFIFAFCHDCEASPATWNLVLVLGPNLKE

SEQ ID NO: 922835 - protein, 158 aa, Homo sapiens
MEFCCGACRVAQCWRLELPNRAQCEGNIFYWPFAEQGKYPLIMQVEAQMIDFTSFFSNTCIQRYNSPSEHCFRCTSQILIQRKMVEKDFPAIIPLQKFQLEQLSKHKNAFTREKKQTKKWEMTEPGCSKIIRKDVLKKANGTLTHYLHHPRLTPGNTA

SEQ ID NO: 922836 - protein, 149 aa, Homo sapiens
MENAGTKTKQPEWERYFQWYLESKRGEDLLISLQKANNQFRKDNQELSNFFSLLKKPWESLTSPLAPLPPPPTPQLYPDLSEFPQPDLYPPSPACSNLPSSPPCLPLAQTKTVESLTSKTLPPADSLVAPVAASHWKMWRRGTLQGHFS

SEQ ID NO: 922837 - protein, 158 aa, Homo sapiens
MESLQGHPPLSYRATQEVISPSEESTGGIRTSLGPSQVLTCPLPLCFLLPPPGITLFPTGSTSLPSSPPVSLPQPETFRPEEHPGICWGSEGFGDRRELRVEKGSEVGTENFSSGRGWPALNLTGTIVLLPWTCLSVYSGGPGPVILATPSLIVASVS

SEQ ID NO: 922838 - protein, 135 aa, Homo sapiens
MKSCPAVLYSLVKSRFFSSPCFTEAQHTSIESEGSTFMKEAPESSFTSFTLEEQERVPSMNKKMGPHQTSNLQAPSSWTSQAPELVPPSMNGTLESGHCALITSTAGIDATFAPMTTDGGGDFGQISALNIICLD

SEQ ID NO: 922839 - protein, 149 aa, Homo sapiens
MCFVKHMLEGSMLIKNHHHSLISSTQGHKHCGRLQGPLPRKARDLCSLSDFELFIWGYSISFYIIGKCSKTFHIVLFWHHHKLLAFTNRPPDSSFPRTTVPISLYLPKIGSLIGTATDLLKSDKLPRYEPSPGSASLISSTCFPNLLVL

SEQ ID NO: 922840 - protein, 139 aa, Homo sapiens
MVLGVVCTESCDVNTHRSLSHGYQHLFQWRWQRVQWTLEEQFANLTAPRTRQVQSDSRSAMWSYNIAGQKGKRHRNFKTRTQNSQNCDSKRTVVLLLTELLAAGVKELFPVFPAPSTEETALSPVYVLGTFVKNEFTNH

SEQ ID NO: 922841 - protein, 187 aa, Homo sapiens
MNNITGKCKAPAMNNVTGEVYAPCYIGSNIILSPLDTKNNTTVGCTPRAILGVISSSPLLDIRNNITEGMYTLCINGSNILAPLDIRDNITVGMYLNCDVKSNIILLPLDVRNNITGRVYTPCDIGSNISLSPPWILETIPQEWCTLPAKLGEISSSPPLDITENITGEAYTCCDIGSNIILSPPGY

SEQ ID NO: 922842 - protein, 161 aa, Homo sapiens
MSLKEAREQQRLVPAPSGTSDLKGQQPDASRITPNCQEKRPSPLVQRDCCDTSPNSNSVPEPLAGVIGDPAGKPRPMRKAGSGLGLKRHSGHRNCHSQCASVAWVREWDLPIRGLHSSVEKAQFPWLGSTLTRHLPWLGGGGSPSPCGSQVGRAPHCSFSP

SEQ ID NO: 922843 - protein, 176 aa, Homo sapiens
MYLEGRKMYGSKAQKRELGGRKGFGDVSVYTTTYQKNTECAKMNKIQSLPPRSMQSHGEKNRQTVTAEGMVAVPRKNVIRSGIGEREGARGEFLNATLQSSLASSAARWVWLPQEDHCCCCCCCQWCTLPPPLAKRPLSRLLASSFSLKCFLFPPPVWKDPPNSTSSFHNELLGSG

SEQ ID NO: 922844 - protein, 330 aa, Homo sapiens
MVLLDCRDCTVEMPILKNLATMAFCDAQSSQEIHQTVLNEAVGATMYHTITLTREDLEKFKALRVIVWIDSGNDNVDIKAAASSELLCATSQHGANPRGGLGSGPHPWVDAVGLMSFGRTRQAVAFQAKAFGFSVIFYDPYLQDGIERSLGIQWVYTLQDLLYQSYCVSSHCSLNEHNHHLINDFTIKQMRQGAFLLNAAPGGLVGEKALAQALKEGRITRDSFAQGPLKDAPNLICIPHTTWYSEQVSLEMREAAATEFRRAIKGRIPESLRNCVNKEFFVTSAPWSVDQQTIHPELNSATYRYPPGTVGVAPGDFLQPWKGSSLEASQ

SEQ ID NO: 922845 - protein, 156 aa, Homo sapiens
MRDKNSRCPIHGQVCASQLLLQQLLNECDSRHTPTHGTWADKLILNHVFSDNHFRPEKGLFSKCFCSQSQEGGKEVWLTSSGVLCPLLRVYITTKAVNDGTKMERRRHCDCLMGRVCVRKKASGGEKHTQGVHLILPPEQSGLWFSFTREMSLTLV

SEQ ID NO: 922846 - protein, 142 aa, Homo sapiens
MPASPSPLIPTVTKDAVYSWRNYIETTLLHTHTIKVKCPNQPTAYIQLEEKVFPYNIEFINWKKQLLQQVHRYQCKDKKTRKIKFVISRTQNSSEIDPNQKEIYKILEKIIQNIDFKDQSKPPYVNSNLKYNELNFPLKRYK

SEQ ID NO: 922847 - protein, 140 aa, Homo sapiens [sequence omitted]

SEQ ID NO: 922848 - protein, 288 aa, Homo sapiens
MGRPIYREGQPTVGLFRAVLTLQIKLLFIVFTLHLSAYLILPAHKTRTWAKVPPATEVSSQRRDTPNIPRELRQDSRLQQPSSLGEQFLSLLRAHNFKGVRFTPNQNQNQNQSIKKSKPGRNQNESIKQSKSSQKQKPKCRYRHTVGVQATLPLKWNGQVPKTSLSKFQMSGLQVPVPSRCSATVLILCGGLHALLWQGIPPGQLPTQERSQDLRCSSWLESPAGMFHRASLSHLRGCLNRPLITSLPGQGTKKCSRTSRRQNPSDTKLKKEGLYSARSFSKTHVSNN

SEQ ID NO: 922849 - protein, 382 aa, Homo sapiens
MHLFLWLVTENIQAFSTMNLASKLLNLRVILGNSKLIVEKWGIATKIPENVEAASEVGNEQNLEQFGRLRRRQEDEGKGCMEMPGFPGRSLLQGWSLHGEPLLGKGGGEMWGWSLHKEFPLGLPSGAVRKGPLFSRPQNGRSTDSLPHAPGKAAGTHFPSNSQARLLQVCRSLLEVCSQPCLPGYLWQRLQNSKDCCLFFPLEALSQRGTCQMPARALLYEMSVSPYWEVSSSQDTRGSVTHLKKQAVPSQILNAVLGDPLLSSELPGSPWLGLLPFFQRRPTQRGGNLERQFGCSSLAELQGAPPSSNFLELCLHYEDVGSSRVDLADLLHTLYPHRFPQRLVQPPVLPVQMEVELTICSTAMDRMLHTAILSLLAALMFS

SEQ ID NO: 922850 - protein, 271 aa, Homo sapiens
MDQVEGKAQEIIWHEKDVKMIEQHNQEYSQGKHSFTMAMNAFGDMTNEEFRQVMNGFQYQKHRKGKQFQERLLLEIPTSVDWREKGYMTPVKDQGQCGSCWAFSATGALEGQMFWKTGKLISLNEQNLVDCSGPQGNEGCNGDFMDNPFRYNPKYSAANDTGFVDIPSREKDLAKAVATVGPISVAVGASHVFFQFYKKGIYFEPRCDPEGLDHAMLVVGYSYEGADSDNNKYWLVKNSWGKNWGMDGYIKMAKDRRNNCGIATAASYPTV

SEQ ID NO: 922851 - protein, 157 aa, Homo sapiens
MFYLLFLSAFAALNTEKEKKPESQRLTEKAPALVPVMAPGPGLQRSLELAVTGRRSWICIPGLARCLSLEVLTPSQCTRTPFCCQSWLVVLSGMAAFPIPLQAWVDLLAGKRTKELQVVQIRSTSCPGGIDIHQIASLIGGSECGPIYPVAVLRFND

SEQ ID NO: 922852 - protein, 142 aa, Homo sapiens
MSGNYLQHLNIGLYLWVQLVSQCCRPLDECEYPYAPHISQPLGRKVANELQHLKTDVLPLAFSSVVMVALKVRAPRFTAIRFKQIESLSCPGGQVGRRKPPGPSDRLVLALPGSTQGLEGEAQNCARSFLYGLLCLDPAGLA

SEQ ID NO: 922853 - protein, 140 aa, Homo sapiens
MTCGWGTAEETLGPENTLNCHRNHRNTGPSDKGYGFDIYLAVPTPYVRPTEVESQGSRLDVYLSHNPAGTSVQNMLHWAQASSSSTKKDVQDIGLPTDEETDRSSYEHGLPEFQQQQTAASLNINHDENNFKLKIRTKLE

SEQ ID NO: 922854 - protein, 236 aa, Homo sapiens
MTRPLDRKQSEIIQHQGYPCEEYEVATEDGYILSVNRIPRGLVQPKKTGKSKITLSSFLLALHSQSTVTHTFSPLRDKMRQMEFMKTVKMLDEFGVEGFCPTGRLHVCLVPVYSNNNKSYPSDLRILMVCYRAEQVYMLPTLLLEHLCKIFYTGARDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 922855 - protein, 150 aa, Homo sapiens
MVQTPPTRPHLQHRELQLSMRFDPGQTSKPYHSLCKKQTTDRLKDTIFALESSWFNGGNSCRDNCHIMYRSSCQHQEWGTMRFILQMQTLRPKEVRQTAQDLMIASSLCECLLADTTWAPANENEHCPSCHIGACISLFSCCYEDISKTR

SEQ ID NO: 922856 - protein, 133 aa, Homo sapiens
MQLTAQFYFFFPLGSLGDRQFAIGHIMTKKSKELSQALQYLAQTIAAGNCRLSELEDSLQITRGSSFTDEENQAQRENVTPQGHTALTLGELFTLSGYHFPYLEIESVETCGSSFEWVLGRHKKGGPFSKCVI

SEQ ID NO: 922857 - protein, 176 aa, Homo sapiens
MNVDQPNPSVRKSAALCTNSQLHGSASDQASARVPEGNPLNAALESSPPVSPGIGHHSPSRQSSREACCSQGFGVFPEEKGGGNEMAFPHLLCSPLSKCKSNSSNTHLHNSLRGGEWSGEESRQEDSKLLLLGDRGERDSQRKREKGDNEKEKGKKEPCSASAGKRCLGSPLATTG

SEQ ID NO: 922858 - protein, 142 aa, Homo sapiens
MGVGTQIRVRGHGRGHSDPCARPWARALRSVCEAMVRALRSVCDAMGMGTQIRVHSRTNPPPPTSQINGKMPPDNCRVTHFLRWAKDRLDLFLSYHCFLCLNTYEEILRTYGIPILLLKHTCRNQKLHTDGSPCIEHSRQTR

SEQ ID NO: 922859 - protein, 128 aa, Homo sapiens
MQSTSCTTILWSPLFMVIAVIHNSIFESYTLDIQSGGSGRVTAAPGLQCRLAAPGLQCRLAQIFGTCQRHELLLTHDDYIQAGTLSVLDIEDDELGVCVNECMPSDCINSPNLLCGASVVSDQCLLDE

SEQ ID NO: 922860 - protein, 199 aa, Homo sapiens
MHCAVDSCCGVLGLPSILGFTPEPASYDCVGQLEKDDPRPLKFLCPDPKHRPECSWGPGASTHYSLGPTVCTLRPGGLPLLCTCLSQAGGHQRLCPHLRIRSHLASLPGCGAFRRALPTVTICLTLEAQATVELCWWTGSGVQFPQLHLCIPQSNVPAFTGSCFFPPSQHRGTVPMQCSRGSGDLRLLTTSWLTVTFNS

SEQ ID NO: 922861 - protein, 149 aa, Homo sapiens
MLLRGKGVGHLVCRHRKEEGNRRDAAASLGVVPWQEVEGARGLYLLWKIEIKTVTQEQGGCGLAGALWREGEAQDVAGGLWREGEAQDVAGGLWREGEAQDVAGGLWGEGEAQDVAGGLWWEGEAQDVAGGLWRERGARGMAGGLPPVR

SEQ ID NO: 922862 - protein, 144 aa, Homo sapiens [sequence omitted]

SEQ ID NO: 922863 - protein, 269 aa, Homo sapiens
MPKGKKAKGKKVVPAPAGMKKQEAKKVVNPLFEKRPENFGIGQDIQPKRELTHFVKWPRYIRLQRQRATLYKRLKVPPVINQFTQALDCQTATQLLKLAHKYRPDPKQEKKQRLLAWAEKKTAGKGDIPTKRPHVLRAGIDTVTTLVENKKAQLVVIAHNVDPIGLVIFLPALCRKMGVPYCIIKGKARLGRLVHRKTCTTVALTQVHLEDKGGLAKLVEAIRTNYNDRYDEIRRQPSVVTELMGQWLREEAVLQTQGPSGEHTTDMSH

SEQ ID NO: 922864 - protein, 139 aa, Homo sapiens
MLMVTTSQASAGVGTKQWVRMIIKMEIIDTGGSKSREDGRRTRVEHLPVGYNVHYWYIGDTGSPIPTELDLHSNAASQGHNLELVIIYTVFWSPHLKLPVPSALPPLLGNILSSTFSTSPRLQLRHAPLMHHLPSIRAR

SEQ ID NO: 922865 - protein, 147 aa, Homo sapiens
MQRISLYVCWGALGTSNESLKEGRFFKSGDLADTGSSFFLGTAFLVLSPAVRLGLLTGGCHTSWTFLPLSQLAPSKLTVAPDCSRTPASWPICYQHYTCLSVPPGNASVLDLFLHINLPWSSRPTFPTFSLPAPLSQLSRRQMQTVT

SEQ ID NO: 922866 - protein, 151 aa, Homo sapiens
MNRDFWAPSLSPPSTWLPNSLLLFSQCSSPHLLNLPLLDILTLPGAIIFQLPLRGTWVPSLETDLLMVIWSSGTLGKGGYHRWSDDTGGWMMFGIYLLYLPDHCSTAIPATHQNATFGPFRKLNCVIAICCQTFASAVPCTGTLSFRLCEI

SEQ ID NO: 922867 - protein, 143 aa, Homo sapiens
MSTTPCSRAPSPIDHPRAEECRGTALDWQAAPPAAPVWDPPGKASWAPESAVTLTVKVCSFTPEASETTSPPGRTNNSRRAILRAVTFTARVRGFILEVIFDNLIGIIGAASQGRYPRFKARGIFKDSGLGLSHLLESKNQNN

SEQ ID NO: 922868 - protein, 154 aa, Homo sapiens
MTVSEAFKVFPSLMGATAWSHPGVSKPNYAHRLSSSEKIFSFKKGVLKKAICFPSSKSKCSKVKCWRHLWEDIEGQGGPLKLHQPPPPHFYGKIVFHEIGPWCQKCWGQLPWTTPEGSTHLEDNGMVPYGVLQRDGLDLGPSCSNHDVLITCLS

SEQ ID NO: 922869 - protein, 141 aa, Homo sapiens
MRIIWNLLKPLVLRLYPKIIEFKSLGWIPCIGVILGFQVQLRLPVEIVRTHSCFRMVRAVNGPGDWILAYICCQRAVELRCCLKLVAWDARAAASPLCPPWWLHCQKQHIVSLLDACRLQGRDTSDSWPGNSPDVNCQNTP

SEQ ID NO: 922870 - protein, 137 aa, Homo sapiens
MWARDTDLLSIPHNIMLVQKGIVHIALWQTCLFQQQLHVNLLSEFRMHSCLCRPIGYSVPNSRYNRGLRFLTHSRLEILQRHQGCTFLKAELSVLLLCSPSFNGPIIYGYCEKVHILPGVIPARTGHIIGCARLVPT

SEQ ID NO: 922871 - protein, 182 aa, Homo sapiens
MVQITDQGQRQSDSGGVMWMRMSLRKLAEASHFEHLCVRPWAGAFSDRILLNLPILQMRKQKLKLLNWSKIPRDLNQGCLVWRPKHLQFHFTAWDWYSLRSHWDYAHMNHLCKIMVTAITDNSSLRWVSSQLADTRLCEFGSNRFHPGLILPPPAQSSLWTLEEGPSIHNELLVGRGNNGSY

SEQ ID NO: 922872 - protein, 135 aa, Homo sapiens
MVRIEKKDELSERKLVQAKNSGQQWDPKKWQVAGFPVPAFWFHSSYLRSWKTNISRQKRLYYQLPREEATVLCWHYSNPTSWGIRKPFQREHSPGSDDWAGPHDLTRPSLLIYFGAWVEATAAMAQGLQEQESHR

SEQ ID NO: 922873 - protein, 139 aa, Homo sapiens
MAEDEEEQRDVLHGGKQGNMCKGTPLYETIRSLRTAKEGLTEDVTFEYRQECEGVSHFDIWGKNIPDGGGTPDAGETGAKALMGSLIHVLKEQEETGVAEMEGAQQEMQSEKERGGGPGPTGPFKGFGFYFDKTLMERT

SEQ ID NO: 922874 - protein, 140 aa, Homo sapiens [sequence omitted]

SEQ ID NO: 922875 - protein, 135 aa, Homo sapiens
MRPQTHQKEENSNTSEHQKEQTPDTPPLRTVTLTMRVCGFILEVTREESFDDVLGSLLALASAKRGPQPPCNCSSSENSRAIGPEPSKSSRKDTKHDTISGFARLPSTTPELLSPWLSVNSILFLAAHDCCLDCP

SEQ ID NO: 922876 - protein, 134 aa, Homo sapiens
MQPSVFLTFLGPRKIIPVVRKWACCAGEALHCIANGDGSSLDIPVLTKSKNIFHVWEGLVWGQRQIQVQCEMDMDEAGNHHSQQTNTRTENQTPHVLTHKWELDNENPWTQGGEHHTLGPVGGNLHILHLYPRT

SEQ ID NO: 922877 - protein, 201 aa, Homo sapiens
MAIYELGSLPSPDAKSAGALILDFPVSRPDFRPNTCSALDSKRPPQPTLPTGLSSLATTASLAQRGAWVLSEAPAPVLGLYVTRWGCGRPRRSHPRSTRCMYIHCCGAICEAQLVPAPPSAALYVPSFKGISLLCCSTSFQGYHRMSLELCSLNSLDSSPKSWQPSLPHEKVAGATFGNDSVWEGGHCRTGFCAGGPVEAW

SEQ ID NO: 922878 - protein, 155 aa, Homo sapiens
MTVQRQGQTLIKLGKNRGFPHFLISLRGRAVSSRLVICGFYYVEVCSQVGVEPGHGAAVDSSVGSKAGGPLTRVFFAKIYGLPVKMESSAGEKKAPLLPGFLETHITFHFGESEGGEGDLEDPEIFREEARMDDTFLQRVKRYLKAWSNGNEIEY

SEQ ID NO: 922879 - protein, 140 aa, Homo sapiens
MTLALHRHAPFYKLCKQYASAKIVKQRGIRAVSPFAIITGDRVGGGHVDNNRVIRPMGCGLLSVVSSPTKWSFLACTLLSPFLSAACPWMLISRVATVQQGNLPANTALGTAAGHVPAHQDLSVIRANDVSIPVHEITWR

SEQ ID NO: 922880 - protein, 136 aa, Homo sapiens
MLLEDGRESWSSSVLASENRDSGGWERQARVISALGPLPNVSCLPPYAGVSEAAASVAADAGYAQQGRRLRHEETWPSRRALWKLAGMLLETHRQPRGQGPEDSESQSGCRPGINEDKGMEALLTAVLRERFFAIQ

SEQ ID NO: 922881 - protein, 193 aa, Homo sapiens
MWTEKCPPYLLGSLEQVNMSPSVHPVVINCSGPGMLPSASHGHLCTPLLPLETSFSLASVTFTWMAEGKHKTDLLLCDVQSCWAQQVLSKLFLTFSQLATILKESSFFSPGKIPNSVSPKERLKTNLHLHRGRRTPCNPCPPPQEAPPPLSGVWSYPLASIKTTKLPKNTAEQRWYFPIHLAVLLVRSDWQFD

SEQ ID NO: 922882 - protein, 148 aa, Homo sapiens
MGEIRKAEISPELSSRRPPYTECWSCPHLSYDHSFLPSRAGAKHWLLLSKGMTMMIFASQKDPSERRLENEWVDVCIKIKGFGRRLVRGKGVEKQKFTRSKDNNAELTCWLTREVHQLLSESDLILSEEQIENIKRRDCGNGMILKGM

SEQ ID NO: 922883 - protein, 137 aa, Homo sapiens
MKRGKSGEGPEEGSQPIVFPEVSFKEACGAYLREGIVIEKWVKAYLELIVIPVPRIKGDISVEERAASIIDVYSGKPQSAWSPCDMQFFVTIVGSTTLTRKRGYWLSILSLRGTGLLSMLSVFGLWITHSRKPAGTL

SEQ ID NO: 922884 - protein, 134 aa, Homo sapiens
MFAQGPGTLPSANGKANEAYVLPFRVAMSPRPQSLFQRYEVKTSSREYEGNYYYIYFLETKNFDRSPKAENILCYSAYEEQAQGWWQLPAVCQLLGASPSLSHLNPTLFFVNCPFIKLSSSILFECAMYFLLRP

SEQ ID NO: 922885 - protein, 185 aa, Homo sapiens
MNPNLSSSKLTGFLPLSSCFNEDRVGFSVPSKIHHGVEGLLRGVGQALTFPTVDSWEQTLPDGLSQPDPVSADALLTLPPSTSCLSQLESGSIAQHRGSSWGSSLAGAQSYSLHALEDLHHTPGYPTPPPYPFTPFMTVSNDLPPKVGPLSPDEEADTGSLHDPSPWVKEDGSIAWGSYECRRAY

SEQ ID NO: 922886 - protein, 152 aa, Homo sapiens
MEKFLEDVTSKLSGRRSGNQQDKGRFGGRRVACRGNGTLKDPSMKKKEDVNCHVVSCSMEKSAWQGIKGCQQLAASKKLRPLIQQPMKSKFCLQLWHFQDLPPVGPSDKTAAPADILLQPSEKPLGGSMKLSPVQIPNPETMRQYLSYLVWK

SEQ ID NO: 922887 - protein, 162 aa, Homo sapiens
MQPTPGRLDHLSGKGTIWASGLPYVQMCLEFLPSSGFVVSLTSRIKPQTFTVSVTALKGGADPKRHPNCCWELGNDHSSYFLLDRGEEGEEINAEKVCQCPGGSQFPGLQCLNVWGLSEGDDMSWHLSWAPSVLLLGHLVGGFWPREPLSSGAVCLPVIASA

SEQ ID NO: 922888 - protein, 152 aa, Homo sapiens [sequence omitted]

SEQ ID NO: 922889 - protein, 164 aa, Homo sapiens [sequence omitted]

SEQ ID NO: 922890 - protein, 144 aa, Homo sapiens
MRLLDTAGPEFNIIFIFDRLAQPPSLNYSSSHNPTMLWAGPWYPRPKTFQSLETSHNLLWPDVKEWSPDLTVPVSKVIHSLNSYTQKCSGFAPLGPLPFQGGIPEEGTVIIGGDSSIHITAPEDLPVGQDVEVKDSDTDDPDPV

SEQ ID NO: 922891 - protein, 125 aa, Homo sapiens
MPNCSATQWRFELNHTQFGQFRHDDSQVPQSGGRAPPDPEPTEDAAFLGRSLRHLSGDPWSLALPWSITHQVLLQDLALGFSTYLLPGWLYKPDDGYLNTLEKVNSQRLSQGKSYQLGSSYIMLG

SEQ ID NO: 922892 - protein, 138 aa, Homo sapiens
MGSQHRCIDSESLRSHHTRLSAPILKQRLPNPPHLQGWRGWCVQTVFLGALHGWSQDSFNLDMVGGMAGMPMHLVAGHWPTKQFTGLREWLQASIPWGMMRNHQPWGHLCDEYLLVEQDGGWELGGTLEECCDNYNKR

SEQ ID NO: 922893 - protein, 148 aa, Homo sapiens
MEYQREEDWHAWEYRQAHGMLHHPLLLRPSYSLALFISGKEDVKARISIPGSGGHHIEQRKDQSSLLGQLTRDICKYQRTHPQICREAGTWEEQFPQQLAKLGSSKWMQRPALLPSPSSESAFSGLLLQRAIFFHMALIFLVLCFMTP

SEQ ID NO: 922894 - protein, 175 aa, Homo sapiens
MGGYHEDAGYLELLGQRQEGFKGLAHSGDFLSIHADLPNPHDPGLHLVQFQIKSLPLGQDGGNTGADPAKEGEKIEQMYNWVLYRDIQFPGAGRRQWPSPISTARGFPLLLIHLSTDPLRVSGRVTVRSFSSHEAIFQTITWGETLDNTPLSRAGVPAAFHSALCPWFIETREWR

SEQ ID NO: 922895 - protein, 188 aa, Homo sapiens
MKLSEEGSGSNICCSAASAGDTQANRVWSGPPANSNRPAAEGPDCHQHQRPKVDKTTKMGRNQSRKTENSKNQSTSSTPKDCTSLPATEQSWMENDELTEIGFRRSVIRNFSELKEDVLTHCKEAKNLEKRLDEWLTRINSVEKILNDLTELKTMVQELRDARTSFNSRFDQVEERVSVIEDQINEIK

SEQ ID NO: 922896 - protein, 135 aa, Homo sapiens
MGPSDKKRAAPAFLPTFSPQEVPRELQALKGNEDPGSGSSSSLAPGHSLMKSSEEASAVIVATSSLPGPVLGLIQAPAPRGKLQMFLLFLDAGMLPMNEPVTWKSQFSLQSLLLTRSFPFIVLPDFSSYYGTGMK

SEQ ID NO: 922897 - protein, 153 aa, Homo sapiens
MTYIHHYSIIQNSLTALKTLCAACLLSSLATTDLFAVSRVVAFSDRLLCLAYPQFVLTYLEELNAQVDVTQTEYHIHHGAWTTAHQEHGRNLAEEVLQESASNLGLKQLPEPSDNHLMPEGSLEETGELTVALVRKLEEKHPKASAQSYCKRG

SEQ ID NO: 922898 - protein, 150 aa, Homo sapiens
MAHVCIRYKPARCPHHVTTLKVFDILLLLGFFIQPSPFSNQRILFYHLYHDMPKCITSIPSPTPLDCSRLCGIPCMMFLFLLFILSHYFTFSLKLKPFNCSHPKEDWFLAAGSSALWGPTSCFASYSSFPSCHWCSLTGSHLGERSVFYC

SEQ ID NO: 922899 - protein, 124 aa, Homo sapiens
MRNINFSEQSRGKRSDLTLENGILTGCCKAKDKKKETWMELEAVILSKVMQQQKTKHCIFSLEAEIHYEEQIGKIIVETQELKWQKTDPKVVQIVGVKSGLNYMKDKSETDLSVEGKNMEGKNR

SEQ ID NO: 922900 - protein, 222 aa, Homo sapiens
MSNGTLHHYFVPDGDYEENDDPEKCQLLFRVSDHRRCSQGEGSQVGSLLSLTLREEFTVLGRQVEDAGRVLEGISKSISYDLDGEESYGKYLRRESHQIGDAYSNSDKSLTELESKFKQGQEQDSRQESRLNEDFLGMLVHTRSLLKETLDISVGLRDKYELLALTIRSHGTRLGIYLEAVDERHQATLASATTKARLLEAIRSYKKPAGVLCTAVPRSCVQ

SEQ ID NO: 922901 - protein, 180 aa, Homo sapiens
MSHAAFTTVVNACMEGGLGTAKEYVPHRAAATANENGSCCYRRMAAATLADTTQQNVVTSSLGAPRLFQCSGFPTLRSQRTKSGSSTSPPELEHADKRKKKPSKCQQLQRLKEDKPTKMRKNKCKNSDNSETQSAFFPSNDRTTSPTRVLNQAEMAEITEIEFRLSIEIKIIEMQEYFET

SEQ ID NO: 922902 - protein, 139 aa, Homo sapiens
MVECCVGVLGAGRILLYSVPGFSMGPGGGFSRGPPLWIVECLTNGQKHVSPGGSPQSSSQGPSPPSGATGHAESLWQAAGAAKAFGYFAHFINKCAPMPTTWRLPPRNKSRNMLWGDFWLDFGDKGNRQGSMGRRESGS

SEQ ID NO: 922903 - protein, 390 aa, Homo sapiens
MITSSSSGRMNSFSAAQPCALGSSTLCTGQLNPMYWEALPHALGSSTPCTGKLYPMHWAALSHALGSSTPYTGRLYPMHQPALPHALGSSTPCTGKLYPMHWAALSHALGSSTPYTRRLYPMHQPALPHAPGSSTTCTGKLYPMHWEALLHAPGNSTPSTGKLYSMHREALPHALGSSTPCTGKLYPKHWETLPQALGSSTPCTGKLYHTYWEALPHALGSSTPCTGKLYTMHQETLPQAPGSSTPCTGKLYLMHRKALLHALGNSTPSTGKLYPMHREALPPCTRKLYSMHWEALPQALGSSTPSTGKLSSMHREALPHALGSSTPCTGQLNPMHRAALPHALGSSIPCTGQQLDSHWYCCHQAIYSWHCLPHPSLPDPTSPLQWALLE

SEQ ID NO: 922904 - protein, 154 aa, Homo sapiens
MSHKVMPGCKEGWEVYKNELSTCVGLILQADSPLCEQLSQTGESRDTRTGHEGRSTQKNTEDRENDLAPDKDGFSLSSRISVNEDSVLEDSRCLTSWRTKQKSRHFELSYPCLNISAQVTGQWLESKLPRLLFTVNSPAFSKQRKAGPSTDVYI

SEQ ID NO: 922905 - protein, 144 aa, Homo sapiens
MVLSVPVIALGATLGTATSILALCGVTCLCRHMHPKKGLLPRDQDPDLEKAKPSLLGSAQQRAESGRNLKDSSPPPSSSELQPVRGGWYGLPQDVSADVPGDRRAFIPCICSWPEPLRAGNSPCSHCKEQQKGSGEAVWKDFPA

SEQ ID NO: 922906 - protein, 150 aa, Homo sapiens
MATPPLSPHPIYDPITLKTQSPLLNVSKGEDESEKNNGKPERNWETWRLRGSKQRQKIWSWREKDPDHSSHHMLLPQSNPPMANTQSKAPAVMQSSMVHLLSAYSVSGTVLSTSCALSFHCSSNDCHAHVQRLSLAACLYPHSLPFITWP

SEQ ID NO: 922907 - protein, 145 aa, Homo sapiens
MFTFSHYKIMYQSFPSNSQAPLLQVCWSVLEVYSRPCLPGYHQQKLQNSKHCCLFFPLKASCQRGTHQMPTSALLYEVSVDPCWESQQAITFKSAETAPTAALSPRDALPREEESREAVWLQQLCRALVGSTQFKLLRGFVYLES

SEQ ID NO: 922908 - protein, 454 aa, Homo sapiens
MKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTGAATNAADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTGMRPLF

SEQ ID NO: 922909 - protein, 161 aa, Homo sapiens
MLLFYPTVLFLTQRRVQISESLKFSIAKGLTQALRKAFHQNDVSAHIVSTSNASQAVTLVYVVGNQSTFLNGTVASSLLSQLSAELVGFYLTYPPLTIAEPSALPSASTVLQGVDNSLVGLHNQSFARVMEQRLAQLFMMSQQQGRRFKRATTLGSYTVQA

SEQ ID NO: 922910 - protein, 137 aa, Homo sapiens
MSGLLSSSQCCLSCPSCWLFPTAVVKNPPNNLWIIAAVLAPIAVVTVIIIIITAVLCRKNKNDFKPDTMINLPQRAKVYGSVSGPDGLWLSDAHSAISASKCFIYSSSLILTAALGGSTIILQMRKPRHRKLQAKET

SEQ ID NO: 922911 - protein, 144 aa, Homo sapiens
MCLCCASVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEKAPKEMEHVLDPDSELCAPFTESKNRCSL

SEQ ID NO: 922912 - protein, 191 aa, Homo sapiens
MVTALLLLAVTVSQIFLIFDDLDSFWEVSIDISSRSLVLSTMSSLLMKYGNFTFTSRNSSKLSFYCFYQLLTPAASASDCQIIRVAGGGGKLGTKEEKKERERERERKKEKERKKERESQKESDKERKKKERGRERKKRKKEKEERKKEGKKEEGRKEREGRKGGRERRREGEFTISFIPFYKQVNRVLES

SEQ ID NO: 922913 - protein, 138 aa, Homo sapiens
MIKKGTDLATGHIYSQPYKIPSSVHRNYKSSKYCPIYPFLSPALQLEQEGPLPVVWLGTESGETWILALAHHWFMAHEPISSSKNEESPFLSYPICLHSGFRANFRWAICSLSSVPLPKLSPAPQSPPSLPCVYLFKN

SEQ ID NO: 922914 - protein, 169 aa, Homo sapiens
MSGFHCLLPAPGQQPAELGPTLSQHWVTPSPKVCGHTEPAHGAGVEPRGQGHLKEFNNPSPAHRLLPGKPDAMLQDFLWRGPLGKELMSLASSQRGPKICQQPYEKLMALGPFWSLRRDCTSLAARAPQGTRPQTLKLNAVSLGSREMRVQGTVHYCLYFGIYFLEDLN

SEQ ID NO: 922915 - protein, 150 aa, Homo sapiens [sequence omitted]

SEQ ID NO: 922916 - protein, 135 aa, Homo sapiens
MEACSSCHTLTSRATSLPLPHLGPVAMGRQGHTQVGQGSPRRPENNIFNDADIGEVFDPDGSDARCLPRLGYEGSYAFHLVLLGCQLLEPPCFEEAQAACREAHLRKNHSPLLAAQANSQRQPASHCPNCGFKSK

SEQ ID NO: 922917 - protein, 122 aa, Homo sapiens
MPVVGLPPADRPCRKAFSGRCRTALYALWGFGIGGTEVHSVEWGGRRGRRRVAVRSVQPSAPSGPLTSSHGICSFIHSATILCPLYVLGTALGTGDDEEKTLPTFMELICWWGPQQLQGEHR

SEQ ID NO: 922918 - protein, 169 aa, Homo sapiens
MELNSRAAEITVEREKVAGQTWCSSPFTTGLHPTLALTFSINSEKACALTSCSGTLNLISHSTTLSLYLSHVGNHRPSLDIHQSKPLSTAMLLWAAGVDDVILTGYKVPAAFQLRPACLCPVFSLDGPSWVVLSRPVQVFIIIHQPRSPSDDFRLTYSLERLPEPEPSS

SEQ ID NO: 922919 - protein, 171 aa, Homo sapiens
MVIRKEERLHIARRNLVQIEAEPPLVSWMALLMGQNAPPPRLGSGSQDWVSPMDSLLSRPAAWMAGDSEIPTDQCTWWQPLPMSGSTAARSSLLCCSKAIDWRLISPGTDWDWEPQTERMFNSRFLNCAGKGVLGNGRAMKGAKWWGGVGQGESYREKKQFTSGGLERLTW

SEQ ID NO: 922920 - protein, 146 aa, Homo sapiens
MPSNLLCSFFSVVSSSIERLLFDDAYQNAITSMSASPQPQDHSDSHPKMIPHQGTSDNMETFWWSQLGQCCCLHRVGRGHNVPYNVQHSPHTTNNYLASNVHGAEVEPLALEKCRVCPHTYGNSSSGSGAPQEKFLQDKSPELVRN

SEQ ID NO: 922921 - protein, 306 aa, Homo sapiens
MPLCWNCNLVLLPCTGLDLFPRSPVAQTCEGTKARGRKALPPDPTPPLTDPSLTGSIEQEKKKKMKTQKTPKTQTGRRCGEENVLGASVASLLLVVSGIFRGLSRARTVACTRGSPIGHWALRAVLGVVYLPAQAKDLAALVGALRVAHLQGHERVVTLVGSQLGVIDVPPGPGSRRAHLAGTLVCTHLEADGRAVHGGQYVVLGVIEMPPRAVRGHAGLAGAFVGAHLQPDDALAGIHGGVLKVPLLLLRVRVTDVRPSLRPLSLGLPCQGEKRHLHLHRVPTLRQVVGLKQVHGVHAIWTCQPS

SEQ ID NO: 922922 - protein, 167 aa, Homo sapiens; identical to SEQ ID NO: 759607

SEQ ID NO: 922923 - protein, 136 aa, Homo sapiens
MVGDIPTAFPGLMAKENEVQFEVSCNIILLSGQKKELVCWQGQGSSSGPSSTMDLLWDFRQSTSSLLASVPSMKYCSVYCLLCAHKNSLLQVGRTCGMAECRSQQILFSQNNYEARQNCQRQSFKDWKFDQSHTTD

SEQ ID NO: 922924 - protein, 164 aa, Homo sapiens
MDFQRPAGHRATEAGSLGDDNTAVKGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCEHFVNGLRYGVPRSQQCPGLGGPWCEKPPVP

SEQ ID NO: 922925 - protein, 251 aa, Homo sapiens
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKLSFGLRTCADYEILLWWLVESARWLIITNKLDEGLKALRKVARTNGIKNAEETLNIEVLYGAVALIVRCLALLTLNHMGRRISQILFMFLVGLSILANTFVPKVIVHMLVLPSIEWA

SEQ ID NO: 922926 - protein, 162 aa, Homo sapiens
MNSLTQKYIQVISVWVKKLYKKQVTKKIRLWFQLYKYLWENSTQVWAVKAILRRESKWEPIYIPPLGCIISMIHYHLPGGMEEITATVQKLVEVNIIWPAEFFQSYVTEGLWASDEMFRLGQSGFAVGHSLEMAGTSTWGKGDWWLFLEVHCDIVYLKPYLK

SEQ ID NO: 922927 - protein, 137 aa, Homo sapiens
MENEFDELTEVAFRRWVIANSSELKEHVLIQCKEAKNLEKRVEELLTRITSLEKNTNDLMELKNTAQELQIGNYVKRQNLHLTGSPESDGENGIKLENTLQDIIQENFPKARQAHIQIQEIQRTPTDTPREEQPQDT

SEQ ID NO: 922928 - protein, 171 aa, Homo sapiens
MDLDLTLNFSIHLLMCPQFSLPLLPSPRSPTLPPHPLGLTVYQQQISHILNIFSGQFCHLLALKETWLSCDIITSPAALRLMPSGLGVASVHSAFCPPLSSEGPGPLKFVPSDLTTSPVCSPAHSSQELFHIVSSLSLLSLIPPAPGPIADHQGLYCLPSHGDSGPQLLPH

SEQ ID NO: 922929 - protein, 186 aa, Homo sapiens
MEDANKLALGQKLIVRVPQAVDTLMQQRGHSALLDKLTAAWGSGRGAMPDKLIDASYTSVTTPKMITDLLYQRRTISLAGCLTQLFVEHLLGGSEIILLIVMAYDRYVAICKPLHYTTIMQQGICHLLVVIAWIGGILHATVQILFMTDLPFCGPQYHTSEFQQQNLNLGLPNLSRTSNKTVVHER

SEQ ID NO: 922930 - protein, 138 aa, Homo sapiens
MGSNIIFSSSGSRNNITQVCTLSVILGVISTSPPLNIKNSITEWMYTPCDFGRTISQNGCTLPAILGVISFSSSANIRSNITGWMYTHCYIGSNVILHPLDIRINITGWVYTYGNIESNTMLSPSMDIGNNIIAVFSH

SEQ ID NO: 922931 - protein, 263 aa, Homo sapiens
MIILTKLDSHLHTPMYFSIRHLAFVDLGNSTVICPKVLANFVVDRNTISYYACAAQLAFFLMFIISEFFILSAMAYDRYVAICNPLLYYVIMSQRLCHVLVGIQYLYSTFQALMFTIKIFTLTFCGSNVISHFYCDDVPLLPMLCSNAQEIELLSILFSVFNLISSFLIVLVSYMLILLAICQMHSAEGRKKAFSTCGSHLTVVVVFYGSLLFMYMQPNSTHFFDTDKMASVFYTLVIPMLNPLIYSLRNEEVKNAFYKLFEN

SEQ ID NO: 922932 - protein, 138 aa, Homo sapiens
MDRGESSKRVGWSTLALGLFEPVQIVAGERSQDVDLKRGFLDLMHKGIQGKSQSVIRDVKVLNLKRYKFGDDLISVMTKSGSLLKNVKSLHSNCFLIHDSKGTFENMQSSFINKTIGDKVGERNHKVKGIFYYIKKGI

SEQ ID NO: 922933 - protein, 280 aa, Homo sapiens
MTRKNYTSLTEFILLGLADTLELQIILFLLFLVIYTLTVLGNIGMILLIRIDSRLHTPMYFFLVNLSFVDICYSTTITPKMLADLLSEKKTISFAGCFLQMYFFIALATTECILFGLMAYDRYVTICRPLLYSLIMSRTVCLKMAAGAFAAGLLNSMVNTSYVSSLSFCGSNVIHHFFCNSPPLFKLSCSDTHLKESIFSTFAGVNKVGALLVILSSYSYVLFSIFSMHSGEGRHRAFSTCASHLTAIILFYTTSIYTYLRPSSSYSLIRTKWFLCSTQW

SEQ ID NO: 922934 - protein, 171 aa, Homo sapiens
MYLVTVLGNLLIILAIGSDSHLDTPMYFFLSNLSLPDIGFTSATVPKMIEEMQSHSRVIYHGDCLTQMSFFVLFACKDDMILTVMAYDWLHMKSNDKCYYKRQRGRRSLRGKKVQRNREGHHVKVKAETGMIQPQTKDGQDSPKQKGARNESSLKPLKEVSSCQRCDFGGA

SEQ ID NO: 922935 - protein, 230 aa, Homo sapiens
MLVDLLAKNKSIPFYGCALQFLVFCIFADSECLLLSVMAFDRYKAIINPLLYTVNMSSRVCYLLLTGVYLVGIADALIHMTLAFRLCFCGSNEINHFFCDIPPLLLLSRSDTQVNELVLFTVFGFIELSTISGVFISYCYIILSVLEIHSAEGRFKALSTCTSHLSAVAIFQGTLLFMYFRPSSSYSLDQDKMTSLFYTLVVPMLNPLIYSLRNKDVKEALKKLKNKILF

SEQ ID NO: 922936 - protein, 175 aa, Homo sapiens
MGNYLLHQRDLDVRHGIKGDDFGTLRFHCPAGFWMFLGPAVDQRVQHGVDNCVKYRGHFDCLPRVFGVGYTVKEKDGPMEDGDRSQDSPVENSDGSQVGSTGRESFLVPNSRRHFYDSNKDENIGSEDDSQAAHLIEYCNDKTKHLADVGVRAGDRDDDRVLTDKIIDDVRPTEG

SEQ ID NO: 922937 - protein, 162 aa, Homo sapiens
MPLPVDTSLSSQHNCLAGTDMFICQLNTHQKLQPKWTGPYTVILSTPTAMVLEIVTSQTALALEMLVQQQNQMGTAIYQNRLALDYLLAEEGPVPRCKAICTSSMHQQDSRNRKRASQDTGKNNQDDADLLAHDGWVTQGLTDGHIAINSHENEDKDLHAAK

SEQ ID NO: 922938 - protein, 183 aa, Homo sapiens
MEDANKLALGQKLIVRVPQAVVTLMQQRGHSALLDKLTAAWGSGRGAMPDKLIDASYTSVTTPKMITDLLYQRRTISLAGCLTQLFVEHLLGGSEIILLIVMAYDRYVAICKPLHYTTIMQQGICHLLVVIAWIGGILHATVQILFMTDLPFCDHTSEFQQQNLNLGLPNLSRTSNKTVVHER

SEQ ID NO: 922939 - protein, 140 aa, Homo sapiens
MDTRCFHILAIGNNAAINIGVHISYQVPTFNSLGYIFPEVELLDHMSRVLRDGAILEDWERKHGALWVEVSQGAPLWEQKQKPEVCGTCSHHLTGLGLVPLQGSQINPVGSQITNQPALSLLAQLCPPGGSGFLQGKAGA

SEQ ID NO: 922940 - protein, 136 aa, Homo sapiens
MILQVTSRTGTDGPCVIAALFVLSTAAVLHLDQCQADIRSSSQRTQVNEYTRERKKELESRAMPEGLTSDLREEEEKEERYTEMLKWKENNLKLSNVKEYVSLKQEIKSSALSGELNRIRALCRIRERWKSLWEVR

SEQ ID NO: 922941 - protein, 150 aa, Homo sapiens
MALRVFLHSSLGVIPYLMWFQFRVDQKNNVHAIWDVRVMQQPFLSEVHHSQTCCQTDKEMSTLWVLGGSGPPLLCIQLVLQTVGPDDQQQLQAVHPQRQTPPEVTVLYGSTGSHLNHLGGEEDLEDLVASRSLNGLKFWKAPGVTYKCDP

SEQ ID NO: 922942 - protein, 151 aa, Homo sapiens
MGNSVYHSSEMGRSLGVLEKLRRGWCGCGLTAIEEFEFQNAGVYAGGFQTGPNITVEMTDNIIATEWQLDEQHRLTKDNGEAHHPGAQGQLQAEFAGHDGGVVKGIADGEVAVKRHDSEDQELGGAHEEVEEGLQQAAGHADYCSCHYKGS

SEQ ID NO: 922943 - protein, 134 aa, Homo sapiens
MGRHWKNLEIPEEDGKTRESLQLLRDLLSDYDQIAHRNMDSEGQADKVSDENHEVIENWSKGYPCYILARNLAALYLYPRSLCKVELKSGRRNLYAAKHSRCGLPAYDSLGSDIKQNNYLKFGLQSHHLPERLA

SEQ ID NO: 922944 - protein, 264 aa, Homo sapiens
MWNMLAPHKNQILESGHSTIGLLRFAGGPLQTPLSLASPASAGGSWGPPLEDLTQSGGTGSRTHPMKKSGCFLVEQTCCAGAEDPPSKEKWVGVPVKEVVWLKKQSVHHLVRQLYCAPGSFPFLCPWQAGMAESTEPQIWWSSLLPGTPCQGEIGVLSVEQRTHAVRRTMSGPRLKKQSGPDLARPLCCTVGAPIHLDCMRSPQPASWNGCFPLNHKDGGRPSLQEQGLVSSRLNPLPLAGQILTQWVLTHEVLWKWGLQNDAA

SEQ ID NO: 922945 - protein, 238 aa, Homo sapiens [sequence omitted]

SEQ ID NO: 922946 - protein, 373 aa, Homo sapiens
MESRLVARAKCSLPGQVGEKNPAAMSKLKQRNHQPQRFLSGKERDTAIYSINVSFVAKGMTSRSVCEKMTMTTENPNQTVVSHFFLEGLRYTAKHSSLFFLLFLLIYSITVAGNLLILLTVGSDSHLSLPMYHFLGHLSFLDACLSTVTVPKVMAGLLTLDGKVISFEGCAVQLYCFHFLASTECFLYTVMAYDRYLAICQPLHYPVAMNRRMCAEMAGITWAIGATHAAIHTSLTFRLLYCGPCHIAYFFCDIPPVLKLACTDTTINELVMLASIGIVAAGCLILIVISYIFIVAAVLRIRTAQGRQRAFSPCTAQLTGVLLYYVPPVCIYLQPRSSEAGAGAPAVFYTIVTPMLNPFIYTLRNKEEKWCTY

SEQ ID NO: 922947 - protein, 155 aa, Homo sapiens [sequence omitted]

SEQ ID NO: 922948 - protein, 311 aa, Homo sapiens
MSNASLVTAFILTGLPHAPGLDALLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATGTWLSGSLHSAVQTILTFHLPYCGPNQIQHYFCDAPPILKLACADTSANVMVIFVDIGIVASGCFVLIVLSYVSIVCSILRIRTSDGRRRAFQTCASHCIVVLCFFVPCVVIYLRPGSMDAMDGVVAIFYTVLTPLLNPVVYTLRNKEVKKAVLKLRDKVAHPQRK

SEQ ID NO: 922949 - protein, 311 aa, Homo sapiens
MSKTSLVTAFILTGLPHAPGLDAPLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATSTWLSGSLHSAVQTILTFHLPYCGPNQIQHYLCDAPPILKLACADTSANEMVIFVDIGLVASGCFLLIVLSYVSIVCSILRIHTSEGRHRAFQTCASHCIVVLCFFVPCVFIYLRPGSRDVVDGVVAIFYTVLTPLLNPVVYTLRNKEVKKAVLKLRDKVAHSQGE

SEQ ID NO: 922950 - protein, 177 aa, Homo sapiens
MLVPRSHRCWKEMEKLFNAIISSTRLHTPMYFFLGNLSIFDLGFSSTTVPKMLFYLSGNSHAISYAGCVSQLFFYHFLGCTECFLYTVMACDRFVAICFPLRYTVIMNHRVCFMLATGTWMIGCVHAMILTPLTFQLPYCGPNKVGYYFCDIPAVLPLACKDTSLAQRRRGSGQKGD

SEQ ID NO: 922951 - protein, 126 aa, Homo sapiens
MEWEDNLPLESRLGTVNLFSEVPPSSLPSKVKLLFSKVQLLLLFSPSLPLCCASLLEELGIFMGTGCGAEQDRVVLEKATFRRENWDVKFSFRAMSPGLRVEPSPETPPFQPSIPCLLSVSVLGEF

SEQ ID NO: 922952 - protein, 125 aa, Homo sapiens
MSPQQFYPLAVTIPGVGVIIVEAQVTARAEHTTRALNYTQVALLLLTDEADQIRKEFLFSNSTGPIALVCLYQLLNDLNIMFGMWKNTSGDIIYSFIMCHANNAPYQPHREVVTFILPFKEEGMQ

SEQ ID NO: 922953 - protein, 169 aa, Homo sapiens
MNLKRGTIQQVLSPTSYSPAELPAAYSLPVSRPFARHPYLLWDLAEEAVTHRALSESHEGPYLRKVTNERGQISKFQAKSKFQPGYGDFQISNFLFTQTSKGSDVMVETTFCSLKTKTAGLCMVTLAALFEKVQFVTACLGYLARKGKSPDPLCFPVPQLHCQWPGEKG

SEQ ID NO: 922954 - protein, 141 aa, Homo sapiens
MAMLGLQEKPAERSVRRAKVSYGSKSSIGRWPVLAELDCRHSCTKCSGLYISWLAAPTTSLSICPCQLECLWVIKGPLSVKVPEACSESQLLLHSSTHSFSWSQEQVLMCDSPMQGSQLSPHSAQLLCLPSVYSLPSSHVC

SEQ ID NO: 922955 - protein, 155 aa, Homo sapiens
MARGMMKAILCWQQECTSQQSRMGGKMFAIVLLGSNRLFDVQQQEKRGYAQRLLYTPVRGQCTGDPGNSPLATPGSRPAQSKVSPQSPRLQTCPSTRSETLASDTRLASADTGSRPTQCHTSPCGLKLRQTHGPDPCQWTPVVGEPPRPRPQNHP

SEQ ID NO: 922956 - protein, 126 aa, Homo sapiens
MVDPLTACTMHLEKPQTLNASPLKYPWWGSVPCKATGLEWPKAIGAHLLHQCNLDGSIQQDLSSLNMCVPNAGAPRFIKQVIRDLQSDLNNHTITVEDINTPLKVLGRPSRQKINKDILELNSTVN

SEQ ID NO: 922957 - protein, 146 aa, Homo sapiens
MTVFLKTPIILDWGLIFLTSLNLNYFPRGPVWKYSHIEDNQTLWASFRKDTIPVLLLAGSNLNLLKPQVHLPICRKYRAQRNIFKCTMSTQSAKSRDCEKLQIKHCVDKEQDVYLKDTLNQNFKVARIKDGILKDKSGLKHTHRGK

SEQ ID NO: 922958 - protein, 126 aa, Homo sapiens
MTEYIVTYAKIDTDHLSTSWYIPEIISMINSKSLLNTYYMPNTGKSMVNKGKVVLVLQKLLDAKTHPSSPAGLPGGQWESKESRQKAEKVSVAAAEPKALQKWSGGYASHGLKPVSKRQWRMLDRA

SEQ ID NO: 922959 - protein, 311 aa, Homo sapiens
MAAENHSFVTKFILVGLTEKSELQLPLFLVFLGIYVVTVLGNLGMITLIGLSSHLHTPMYCFLSSLSFIDFCHSTVITPKMLVNFVTEKNIISYPECMTQLYFFLVFAIAECHMLAAMAYDGYVAICSPLLYSIIISNKACFSLILVVYVIGLICASAHIGCMFRVQFCKFDVINHYFCDLISILKLSCSSTYINELLILIFSGINILVPSLTILSSYIFIIASILRIRYTEGRSKAFSTCSSHISAVSVFFGSAAFMYLQPSSVSSMDQGKVSSVFYTIVVPMLNPLIYSLRNKDVHVALKKTLGKRTFL

SEQ ID NO: 922960 - protein, 203 aa, Homo sapiens
MRKDNDLKYIEKAIKKLSKWQQYHIHAHDPKGGLDNARRLTGFHETSNIHDFSAGIANRSASINIPQTLGQEKKGYFEDHCPSANCNPFLVTEALIRTCLLNETCDEPFQLSSVERIDLEDNTPDEVDQYASNRLVASHKKNKDIEDEDTKSLEEKMDRYCNVGTSQRCGRSEEGEIGSGEEFREDISEGIFEPGLQGSAQYL

SEQ ID NO: 922961 - protein, 150 aa, Homo sapiens
MGQPGSANQSCGPHPGTYSTKEDSFNCCVGLSGLGGGRSAISAGGNHPIGCGPRRNKYRRRICLSLRAGTDFTGAVLDIRSPSSLAFGLKDLLQGTPGTITVLCPSYLQNLGRFSTTLDFTAWGPASVGLPQWEHTKRGIQHKARESEKL

SEQ ID NO: 922962 - protein, 162 aa, Homo sapiens
MHVIPALWEAEEPFNPPLRCGGPSLGLAEAEAGSLCWRGGVEWEARAGAGAACRTRQLARFLGGRGLSGPHFARRPAPDGLDQGDELPLGCWRAGARCRKVPLQVPLRGEAGWASGSAASLLKPARPGTHQKEETPDTSEHLKEQTPDTPSLRTVTLTARLG

SEQ ID NO: 922963 - protein, 139 aa, Homo sapiens
MVRGSRGIFRPRQSSCVKCGSSCAEALQLERSATLQKKSESESAGNKINPSSLCFLFVYFSWVDAQVWEEENGYSSEWVSCEFLASVFLDPTAFGSGGGQKSRFKVPANVVLSGGSEGSVSHASLLASGGCQQSLTVLS

SEQ ID NO: 922964 - protein, 161 aa, Homo sapiens
MPTALSYEQEQPHMLMKLIQLYSLYIPHSLQTTSGQILHILDRISQSSLPSPAPPSMPPLYAGVFTLRHLLEDRHYFSSLKPPVPRSDSEAPGKQLQDADWICGAMLITSHIPLFLSAPLSLSDWLCSRTFQQKGLEAMQITCVPLINNCMLYHGFYIIIV

SEQ ID NO: 922965 - protein, 150 aa, Homo sapiens
MARIIKPSSSRCQRLRRVSVFFDYSLVITYPPEHLQDQFIKQAFMDFGNSFMGTAGYGDPFGNEKRGVVGTALIVTGPARPWVRVACSPASDTDLQQDNRKCGAWVACCVILEWQGLEEYGSERQCRNIVAAKSELNAQNERFTQNVDST

SEQ ID NO: 922966 - protein, 183 aa, Homo sapiens
MPITIPLKPNHPYPAQRQYPIPQHALKGLKPVITRLLQHGLLKAINSPYNFPISPVLKPDKAYRLVQDLCLINQTVLPIHPVVPNPYTLLSSIPPSTTHYSVLDLKHAFFTIPLHPSSQPLFAFTWTDPDTHQAQQITWAVLPQSITDSPHYFNQAQISSSSVTYLGIILIKTHVLSLLTVSG

SEQ ID NO: 922967 - protein, 357 aa, Homo sapiens
MHQFNTVLEFTRWKHRSKLFGENRKYIGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKSAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKMLAKMVESQDVKI

SEQ ID NO: 922968 - protein, 637 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGWSPVGTKLDSSGVAFAVVGACQALGLQDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQESLGLPPMVRPLQTLQRPHCSHSYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 922969 - protein, 265 aa, Homo sapiens
MMVALLLMVVVVTEMVLVVTEMVVMVVTEMVVLVVTEMVVMVVTEMVMVVIEMMVVVVVIEMVVIEMMVVMVVIEMVVIEMMVVMVVIEMVVMIEMVVMIEMVVMVVVVIGMMVLVVIEMVVIEMMVVVVVIEMLVVVIEMMVVMVVIEMVMVVIEMMVVVVVIEMVVMIEMVVMVVIEMVVMIEMVVMVVVVIGMMVLVVIEMVMVMTEVMIIEMVMMMIKKVLIEMVVVVTEMVVVVVVVMIEMMMVVIEMVMLLVTERSLTE

SEQ ID NO: 922970 - protein, 123 aa, Homo sapiens
MHLPGCIRWPWNRSSGTEVLQQQLDVLFGKKQFKSQDSGRGGVRYKLTPGSEDLRTPKEHFTPLPPITDPILLGMASLGDFLLLPGTDTTQDSEDGYREMGTSRAVRGTLLWEVSAKGKSTFV

SEQ ID NO: 922971 - protein, 160 aa, Homo sapiens
MACMKEAPAALPNPVVVIICSTGLMTGGCYRTGLPSVHGEERIPKRQRPCSTLNPQRQDDAITKMCNEGGKACQAGVFGRNENNPLNDENGTVRNMPEQVLMRLGRNEIGRSEKNGLGKSDGNEQMGVSTLSYVNTTAGPLKLSTADEALKNQIEKEANH

SEQ ID NO: 922972 - protein, 159 aa, Homo sapiens
MLELVAQKQREREEREEREALERERQRRRQGQELSAARQRLQEDEMRRAAEERRREKAEELAASQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 922973 - protein, 133 aa, Homo sapiens
MDLGYWRRKAILEQTNWYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 922974 - protein, 150 aa, Homo sapiens
MKQPPSKAASAILTPPMRRCGVQIQRSGPKEAMFPQGSAGGGFAMMKLACGGSLLRLWPPFFDTNRQEKKGVPAPAERQQEQIHPLSAFLFYVGPQLIGPTLGEAPLDLDRRSSSHGRDAEQSPDQQVVLWRSGREHRGPVLLNVSGAAS

SEQ ID NO: 922975 - protein, 204 aa, Homo sapiens
MGSDDAPKALISTRYNDKTKLCIKAIRSSTVKRTGGFGNNNPAGKAVYWVNQVSDKRPICTVTVQGKDFEGLVDTGADVSIIAINQWPQHWPKQKASTGIVGVGAASEVFQSSLILPCQRTNGQEGTIQPIITPIPINLWGRDLLQQWDAEIPIPMDQYSNHSRQMMKNMGYHLGKGLGQYKNGQSEPLELKGQTDQTELGCHF

SEQ ID NO: 922976 - protein, 198 aa, Homo sapiens
MAYDRYVAIWSPLLYAVVVSPKVCRLLVSLTYLQSLITALTVSSCVFSVSYCSSNIINHFYCDDVPLLALSCSDTYIPETAVFIFSGTNLLFSMIVVLISYFNIVITILRIRSSEGRQKAFSTCASHMIAVVVFYGTLLFMYLQPRSNHSLDTDKMASVFYTLVIPVLNPLIYSLRNKNVKDALKRFLDNPCRSLKLM

SEQ ID NO: 922977 - protein, 386 aa, Homo sapiens
MYFFLSHLSFVDLCFSSNVTPKMLEIFLSEKKSISYPACLVQCYLFIALVHVEIYILAVMAFDRYMAICNPLLYGSRMSKSVCSFLITVPYVYGALTGLMETMWTYNLAFCGPNEINHFYCADPPLIKLACSDTYNKEFLSILDLCFSTNFTPKMLENFLSEKKTISYAGCLMQCYVVIAVVLAEHCMLAVMAYDRYMAICNPLLYSSKMSQGVCVHLVIVPYVYGFLLSVMETLRTYNLSFCGTNEINHFYCADPPLIKLACSDTYSKELSMYIVAGYSNVQSLLIILTSYMFILVAILRSHSAEGRKKAFSTCGSHLTVVTIFYGTLFCMHLRRPTDESVEQGKMVAVFYTTVILMLNSMIYGLRNKDVKEALKKAIGKQTLGK

SEQ ID NO: 922978 - protein, 313 aa, Homo sapiens
MLHLGKMLNFTDVTEFILLGLTSRREWQVLFFIIFLVVYIITMVGNIGMMVLIKVSPQLNNPMYFFLSHLSFVDVWFSSNVTPKMLENLFSDKKTITYAGCLVQCFFFIALVHVEIFILAAMAFDRYMAIGNPLLYGSKMSRVVCIRLITFPYIYGFLTSLAATLWTYGLYFCGKIEINHFYCADPPLIKMACAGTFVKEYTMIILAGINFTYSLTVIIISYLFILIAILRMRSAEGRQKAFSTCGSHLTAVIIFYGTLIFMYLRRPTEESVEQGKMVAVFYTTVIPMLNPMIYSLRNKDVKKAMMKVISRSC

SEQ ID NO: 922979 - protein, 277 aa, Homo sapiens
MITLLGNIGMIILISISPQLQSPMYFFLSHLSFADVCFSSNVTPKMLENLLSETKTISYVGCLVQCYFFIAVVHVEVYILAVMAFDRYMAGCNPLLYGSKMSRTVCVRLISVPYVYGFSVSLICTLWTYGLYFCGNFEINHFYCADPPLIQIACGRVHIKEITMIVIAGINFTYSLSVVLISYTLIVVAVLRMRSADGRRKAFSTCGSHLTAVSMFYGTPIFMYLRRPTEESVEQGKMVAVFYTTVIPMLNPMIYSLRNKDVKEAVNKAITKTYVRQ

SEQ ID NO: 922980 - protein, 300 aa, Homo sapiens
MVNADDFIASGGVSQWEGELRRGWGGIEKMLNFTDVTEFILLGLTSRREWQVLFFIVFLVVYIITVVGNIGMMLLIKIKKKTISYAGCLAQCFFFIALVHVEIFILAAIAFDRYTVIGNPLLYGSKMSRDVCIRLITFPYIYGFLTSLTATLWTYGLYFCGKIEINHFYCADPPLIKMACAGTFVKEYTMLILAGINFTYSLTVIIISYLFILIAILRMRSAEGRQKAFSTCGSHLTAVIIFYGTLIFMYLRRPTEESVEQGKMVAVFYTTVIPMLNPMIYSLRNKDVKKAMMKVISRSC

SEQ ID NO: 922981 - protein, 225 aa, Homo sapiens
MSTNIVSEKTISFAGCFTQCYIFIALLLTEFYMLAAMAYDRYVAIYDPLRYSVKTSRRVCICLATFPYVYGFSDGLFQAILTFRLTFCRSNVINHFYCADPPLIKLSCSDTYVKEHAMFISAGFNLSSSLTIVLVSYAFILAAILRIKSAEGRHKAFSTCGSHMMAVTLFYGTLFCMYIRPPTDKTVEESKIIAVFYTFVSPVLNPLIYSLRNKDVKQALKNVLR

SEQ ID NO: 922982 - protein, 297 aa, Homo sapiens
MLDDELVGLTDDPVLEKILFGVFLAIYLITLAGNLCMILLIRTNSQLQTPMYFFLGHLSFVDICYSSNVTPNMLHNFLSEQKTISYAGCFTQCLLFIALVITEFYFLASMALDRYVAICSPLHYSSRMSKNICISLVTVPYMYGFLNGLSQTLLTFHLSFCGSLEINHFYCADPPLIMLACSDTRVKKMAMFVVAGFTLSSSLFIILLSYLFIFAAIFRIRSAEGRHKAFSTCASHLTIVTLFYGTLFCMYVRPPSEKSVEESKIIAVFYTFLSPMLNPLIYSLRNRDKASGGMHPL

SEQ ID NO: 922983 - protein, 150 aa, Homo sapiens [sequence omitted]

SEQ ID NO: 922984 - protein, 310 aa, Homo sapiens
MDKENSSMVTEFIFMGITQDPQMEIIFFVVFLIVYLVNVVGNIGMIILITTDTQLHTPMYFFLCNLSFVDLGYSSAIAPRMLADFLTNHKVISFSSCATQFAFFVGFVDAECYVLAAMAYGRFVAICRPLHYSTFMSKQVCLALMLGSYLAGLVSLVAHTTLTFSLSYCGSNIINHFFCEIPPLLALSCSDTYISEILLFSLCGFIEFSTILIIFISYTFILVAIIRMRSAEGRLKAFSTCGSHLTGITLFYGTVMFMYLRPTSSYSLDQDKWASVFYTVIIPMLNPLIYSLRNKDVKAAFKKLIGKKSQ

SEQ ID NO: 922985 - protein, 358 aa, Homo sapiens
MPSHTNLATGIPSSYISKGGADRAVPVLIIGILVFLPVFYHLRIPYYASKGYPMQRSNHTVTEFILLGFTTDPGMQLGLFVVFLGVYSLTVVGNSTLIVLICNDSCLHTPMYFFTGNLSFLDLWYSSVYTPKILVTCISEDKSISFAGCLCQFFFSAGLAYSECYLLAAVAYDRYVAISKPLLYAQAMSIKLCALLVAVSYCGGFINSSIITKKTFSFNFCRENIIDDFFCDLLPLVELACGEKGGYKIMMYFLLASNVICPAVLILASYLFIITSVLRISSSKGYLKAFSTCSSHLTSVTLYYGSILYIYALPRSSYSFDMDKIVSTFYTVVFPMLNLMIYSLRNKDVKEALKKLLP

SEQ ID NO: 922986 - protein, 222 aa, Homo sapiens
MQRSNHTVTEFILLGFTTDPGMQLGLFVVFLGVYCLTVVGSSTLIVLICNDSHLHTPMYFVIGNLSFLDLWYSSVYTPKILVTCISEDKSISFAGCLCQFFSARLAYSECYLLAAMAYDHYVAISKPLLYAQTMPRRLCICLVLYSYTGGFVNAIILTSNTFTLDFCGDNVIDDFFCDVPPLVKLACSVRATRLCCTSFWPPMSSPLLCSSLPLTSPSSPPS

SEQ ID NO: 922987 - protein, 312 aa, Homo sapiens
MEVGNCTILTEFILLGFSADSQWQPILFGVFLMLYLITLSGNMTLVILIRTDSHLHTPMYFFIGNLSFLDFWYTSVYTPKILASCVSEDKRISLAGCGAQLFFSCVVAYTECYLLAAMAYDRHAAICNPLLYSGTMSTALCTGLVAGSYIGGFLNAIAHTANTFRLHFCGKNIIDHFFCDAPPLVKMSCTNTRVYEKVLLGVVGFTVLSSILAILISYVNILLAILRIHSASGRHKAFSTCASHLISVMLFYGSLLFMYSRPSSTYSLERDKVAALFYTVINPLLNPLIYSLRNKDIKEAFRKATQTIQPQT

SEQ ID NO: 922988 - protein, 298 aa, Homo sapiens
MGRGNSTEVTEFHLLGFGVQHEFQHVLFIVLLLIYVTSLIGNIGMILLIKTDSRLQTPMYFFPQHLAFVDICYTSAITPKMLQSFTEENNLITFRGCVIQFLVYATFATSDCYLLAIMAMDCYVAICKPLRYPMIMSQTVYIQLVAGSYIIGSINASVHTGFTFSLSFCKSNKINHFFCDGLPILALSCSNIDINIILDVVFVGFDLMFTELVIIFSYIYIMVTILKMSSTAGRKKSFSTCASHLTAVTIFYGTLSYMYLQPQSNNSQENMKVASIFYGTVIPMLNPLIYSLRNKEGK

SEQ ID NO: 922989 - protein, 157 aa, Homo sapiens
MSMAFFSVLQLRKSLRRAMARLKEHCNTGAAGTHPWTLPWGWRPKHTFWLLQLLISMLTLLALQKSNVWSESPHRVSTGAPPSGAVGRGPPSSRPQKGRSTDSLSCAPGKPTDTQGDVKMTVCSMDSKVDPYLRNTGLLCQPILAQGFLIAIAHLVQ

SEQ ID NO: 922990 - protein, 139 aa, Homo sapiens
MVLRLERKYTIVSEGCKHKVSIMLLPYQCMAIDAWSCHTYWLQVNPGSSPDPVVLRVFIRARLHTAPVIDGQYNHRGPYKQKKEAEVWSEGLEDAVMLALKIGKGLQPRNATDFYKPKQGKKMDHFLEPPERNTALLVT

SEQ ID NO: 922991 - protein, 118 aa, Homo sapiens
MALVVDRIVGPQNIHFLILKTQENVVLRDMRWEDYPRLCRLVHVNRKAGYLGGPYLISKKMGTSILHPQGAEFCQQLEHVRKMIKPKLQLGFPGLSEGPLITNCMSPYWERGLFIWNH

SEQ ID NO: 922992 - protein, 327 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARDT

SEQ ID NO: 922993 - protein, 185 aa, Homo sapiens
MPPFLGKDGEGGFSWETPGFEIPRSLSSGPRTPPPPRHAPSPLPSHLFHSAAPRQTRLQLASAPAQPPPQAPGSGGVSRRPSPRRPEFLPPSPTGVRLARGKLRDPPPTTTTVARAASRSHAAPPAGHTKDLARTWRLPPPPGPLLARAQPPQTIRKLRIPDTECRDPGKPTESQPNPLVGASQF

SEQ ID NO: 922994 - protein, 161 aa, Homo sapiens
MFRYLSRLKYALTGDEVKICMQPFIKIDGKVRTDITYPAGFMDVISIGKTGGNFCLIYDTKGCFAVHHITPEEAKYKWCKVRKIFVDTKGIPHLGTHDARTICYPDPLIKVNDTIQIDLETGKITDFIKFNTGNLCMVTGGANLCMKNWCDHQQREAPWIF

SEQ ID NO: 922995 - protein, 172 aa, Homo sapiens
MQKSPAFCADVAGSCRPELKLYWLYLEKSDFPPFARHRHILLGPLQLLLTGVLLRYCGQSSQSGSVNTQVKVRPSRWPSKPCSIQLATTPFLSSIFVSFPTLLMLLTLCYLHLLPHSTEDMPAPATNRKVEGPPDSGLGFPQRNRLLLDTVPQFIALFALCMLRGKPHVHNY

SEQ ID NO: 922996 - protein, 145 aa, Homo sapiens
MRKLYACRSVMCCQMNDTCEIQPPDGDPSTFSQGFPLWHLCLHDSSSSDVSSSPELCSDILSKCAASPWQPHSQSPQSRAPWRSHSQAPNISFHQADIFTQCDYHIPWLNLIHTLLNTRNLPDISDLWYMPAHRSLLSHGAESRS

SEQ ID NO: 922997 - protein, 183 aa, Homo sapiens
MGNLGMITLIHADPQLHTPMYFFLSVLSLIDSSFSTVDIPRLLESFLISSQSISFAGCMVQMALMILHGTAECLLLAIMAYDRFTAICHPLLYHTIISQCLCALLVVTCYTVSVANSALLTGCIFKLPYCGPNVINHYFCDIPPVLQLAGADTTRLRPLSSHCVPCSSSLPSPLSQSPMPTSS

SEQ ID NO: 922998 - protein, 134 aa, Homo sapiens
MDTGNADGHKEEPRDLLPGANTQTDHLPVVASLLLSSLSDSALWWEAKGNYTVSSPAGSQLRCDGTAVPEAGLESRTWEDQEHAWGTSKHKPKEANLYGSESRWERAQGGRKSMAFAIKQLLVVCWQFWVFLGL

SEQ ID NO: 922999 - protein, 160 aa, Homo sapiens
MTTAHLSAFKLPDLTATYQAYLAAKALWVAYQNLMSCSEREGPFLGGTYANAWEARLSQVSGQEAFPSPCPFQLSVSFRLAERQCGVTLLLIMVMTSKLPRALEICWSSTKQGDHQKGEAELEENTAVLPSRSLHANADMQQKPYEIHSRKELTTKLENW

SEQ ID NO: 923000 - protein, 192 aa, Homo sapiens
MDPNKEEIPDLPEKEFRGAGLGMQVCQGTAAILQQDHGEVGGAGGEGLVAALSRTDAQDGTGDEHVGDADEQEGDGQHEDAHDIEDSLVNTDGSAGQAQDGRYIAEEVVNFLAVAAEGQAVIGHDRQEETVSTTKCEKEEHLGPTSSQWNGLLGPKNVGKHQGHHNGGVADLYKGQVGQEEIHWGSENAAID

SEQ ID NO: 923001 - protein, 256 aa, Homo sapiens [sequence omitted]

SEQ ID NO: 923002 - protein, 319 aa, Homo sapiens
MPVGKLVFNQSEPTEFVFRAFTTATEFQVLLFLLFLLLYLMILCGNTAIIWVVCTHSTLRTPMYFFLSNLSFLELCYTTVVVPLMLSNILGAQKPISLAGCGAQMFFFVTLGSTDCFLLAIMAYDRYVAICHPLHYTLIMTRELCTQMLGGALGLALFPSLQLTALIFTLPFCGHHQEINHFLCDVPPVLRLACADIRVHQAVLYVVSILVLTIPFLLICVSYVFITCAILSIRSAEGRRRAFSTCSFHLTVVLLQYGCCSLVYLRPRSSTSEDEDSQIALVYTFVTPLLNPLLYSLRNKDVKGALRSAIIRKAASDAN

SEQ ID NO: 923003 - protein, 312 aa, Homo sapiens
MHQGNQTTITEFILLGFFKQDEHQNLLFVLFLGMYLVTVIGNGLIIVAISLDTYLHTPMYLFLANLSFADISSISNSVPKMLVNIQTKSQSISYESCITQMYFSIVFVVIDNLLLGTMAYDHFVAICHPLNYTILMRPRFGILLTVISWFLSNIIALTHTLLLIQLLFCNHNTLPHFFCDLAPLLKLSCSDTLINELVLFIVGLSVIIFPFTLSFFSYVCIIRAVLRVSSTQGKWKAFSTCGSHLTVVLLFYGTIVGVYFFPSSTHPEDTDKIGAVLFTVVTPMINPFIYSLRNKDMKGALRKLINRKISSL

SEQ ID NO: 923004 - protein, 241 aa, Homo sapiens
MYFFLSHLSLVDICYSSAIIPQMLAVLWEHGTTISQARCAAQFFLFTFFASIDCYLLAIMAYDRYTAVCQPLLYVTIITEKARWGLVTGAYVAGFFSAFVRTVTAFTLSFCGNNEINFIFCDLPPLLKLSCGDSYTQEVVIIVFALFVMPACILVILVSYLFIIVAILQIHSAGGRAKTFSTCASHLTAVALFFGTLIFMYLRDNTGQSSEGDRVVSVLYTVVTPMLNPLIYSLRNKEEWI

SEQ ID NO: 923005 - protein, 310 aa, Homo sapiens
MAEMNLTLVTEFLLIAFTEYPEWALPLFLLFLFMYLITVLGNLEMIILILMDHQLHAPMYFLLSHLAFMDVCYSSITVPQMLAVLLEHGAALSYTRCAAQFFLFTFFGSIDCYLLALMAYDRYLAVCQPLLYVTILTQQARLSLVAGAYVAGLISALVRTVSAFTLSFCGTSEIDFIFCDLPPLLKLTCGESYTQEVLIIMFAIFVIPASMVVILVSYLFIIVAIMGIPAGSQAKTFSTCTSHLTAVSLFFGTLIFMYLRGNSDQSSEKNRVVSVLYTEVIPMLNPLIYSLRNKEVKEALRKILNRAKLS

SEQ ID NO: 923006 - protein, 297 aa, Homo sapiens
MDHPKLEIPLFLVFLSFYLVTLLGNVGMIMLIQVDVKLYTPMYFFLSHLSLLDACYTSVITPQILATLATGKTVISYGHCAAQFFLFTICAGTECFLLAVMAYDRYAAIRNPLLYTVAMNPRLCWSLVVGAYVCGVSGAILRTTCTFTLSFCKDNQINFFFCDLPPLLKLACSDTANIEIVIIFFGNFVILANASVILISYLLIIKTILKVKSSGGRAKTFSTCASHITAVALFFGALIFMYLQSGSGKSLEEDKVVSVFYTVVIPMLNPLIYSLRNKDVKDAFRKVARRLQVSLSM

SEQ ID NO: 923007 - protein, 324 aa, Homo sapiens
MAVGRNNTIVTKFILLGLSDHPQMKIFLFMLFLGLYLLTLAWNLSLIALIKMDSHLHMPMYFFLSNLSFLDICYVSSTAPKMLSDIITEQKTISFVGCATQYFVFCGMGLTECFLLAAMAYDRYAAICNPLLYTVLISHTLCLKMVVGAYVGGFLSSFIETYSVYQHDFCGPYMINHFFCDLPPVLALSCSDTFTSEVVTFIVSVVVGIVSVLVVLISYGYIVAAVVKISSATGRTKAFSTCASHLTAVTLFYGSGFFMYMRPSSSYSLNRDKVVSIFYALVIPVVNPIIYSFRNKEIKNAMRKAMERDPGISHGGPFIFMTLG

SEQ ID NO: 923008 - protein, 547 aa, Homo sapiens
MVEAGCFSKDDVVICLCVSSKRKLVLESQETAVGENIKHQVQESEKKEKTNFLVEDARSISYYINTDLCLYSKVNAKFSAEFQRMKTLQVKDKAITTRVQVRNLVYTVKINPTLELSSGFRKELLDISDCLENNQRRMATYLAELLVLNYGTHVITSVDAGAALIQEDHIKASFFQDSQSSRSAVTASAGLAFQNTVNFTFEENHTSENVLTKSYLSNRTNSRVQSIGGVPFYPGITLQAWQQGITNHLVAIDRSGLPLHFFINPNMLPDLPGPLVKKVSKTVETAVKRYYTFNTNPGCTDLNSPYFNFQANTDDVSCEGKMTNFSFVGVYQKCSQFSGNKNVVLCPKLEQKNPLTGDFSCPSGCSSVHLLSKTCEECCNHLECHKKCTLLVFCKTVCEDVFQAAKGEFRAFWCVASSQVPDNSGLLFRGLFNSKSINPMTNAQSCPTGYFPWRLFENLKLHSWEPLVVPATSKDLGAPSLKKCPRGFSQHLALISNGCQVSYCVKAGLFTEKFLPPASLPPFTQPPLMSEADANTVIVTSSENARS

SEQ ID NO: 923009 - protein, 283 aa, Homo sapiens
MTVGYHKLSQVVTPIAAAVPDVVSLLEQINTSPGTWYAAIDLANAFFSILVHKAHQKQSVFSWQGQQYTFTVLLKVKFLGVQWCGARGDIPSKMKDKLLHLATPTTKKEVQSLVGRFGFWRQYISHLGVLLWPIYQVTQKVASFESGPRQEKALQQVQAAVQAALPLGSYDPADLMVLEVSVADRVAVWRLWQAPIGESQQRPLGFWSKALPSSADTILLWREFLACYWAFMKTERLTEGYQVIMEPELPVINWVLSNPTSHKVGHAQQHSIIKWKWYICDRA

SEQ ID NO: 923010 - protein, 298 aa, Homo sapiens
MGLLADSLPFSVLVKKRVFLASPTEVAKVCLQTQMQQLRPLASGPLSVPLVCPVSPVCSVSKYHGLLHCLAMVAHEEGLHSLYKSSSALLFWDSHSFATYFFSYAALCGWLGPTGHSQPEITGPAARPSQRGPGENTSHLLVLQAGAGGQRQTCFSPSTILERQAVLQLSLCAQPPSTLDPRSPTHCSSYTVPFQTKLAGLPSRLGTTGQQGQAWSVPHLSDKRTLPAGVGVLFRQSLRHHGGAGSRPHTSSPNTCGATAPVRPNPDVPLSLREKFSRKPLDFSKMGEVWEVCSPPLP

SEQ ID NO: 923011 - protein, 144 aa, Homo sapiens [sequence omitted]

SEQ ID NO: 923012 - protein, 137 aa, Homo sapiens
MWPQALKGFAYYWGSDGDKNECVGYQDNQESYKDIEAHNINKNKLANMSIRARENHDCWNITEKVMDFIGLTERETKCVPSVDGGIQETTERQVTEKKVHGIVETGIPEYQYNNSQVSNQSDNIDEGERYKEGNLQF

SEQ ID NO: 923013 - protein, 309 aa, Homo sapiens
MENCTEVTKFILLGLTSVPELQIPLFILFTFIYLLTLCGNLGMMLLILMDSCLHTPMYFFLSNLSLVDFGYSSAVTPKVMAGFLRGDKVISYNACAVQMFFFVALATVENYLLASMAYDRYAAVCKPLHYTTTMTASVGACLALGSYVCGFLNASFHIGGIFSLSFCKSNLVHHFFCDVPAVMALSCSDKHTSEVILVFMSSFNIFFVLLVIFISYLFIFITILKMHSAKGHQKALSTCASHFTAVSVFYGTVIFIYLQPSSSHSMDTDKMASVFYAMIIPMLNPVVYSLRNREVQNAFKKVLRRQKFL

SEQ ID NO: 923014 - protein, 314 aa, Homo sapiens
MENNTEVTEFILVGLTDDPELQIPLFIVFLFIYLITLVGNLGMIELILLDSCLHTPMYFFLSNLSLVDFGYSSAVTPKVMVGFLTGDKFILYNACATQFFFFVAFITAESFLLASMAYDRYAALCKPLHYTTTMTTNVCACLAIGSYICGFLNASIHTGNTFRLSFCRSNVVEHFFCDAPPLLTLSCSDNYISEMVIFFVVGFNDLFSILVILISYLFIFITIMKMRSPEGRQKAFSTCASHLTAVSIFYGTGIFMYLRPNSSHFMGTDKMASVFYAIVIPMLNPLVYSLRNKEVKSAFKKTVGKAKASIGFIF

SEQ ID NO: 923015 - protein, 133 aa, Homo sapiens
MQLFVRAQELHTFEVTGQETVAQIKAHVASLEGIAPEDQVVLLAGAPLEDEATLGQCGVEALTTLEVAGRMLGGKVHGSLARAGKVRGQTPKVAKQEKKKKKTGRAKRRMQYNRRFVNVVPTFGKKKGPNANS

SEQ ID NO: 923016 - protein, 254 aa, Homo sapiens
MQAEAPISHTTSSMQPPVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPVGKDIAPQESCSQAPAEVRHFTDRQPVPRQAFSPCKRRSSQQPKRHGAQTSKDSPKDREVAEGGLPRAESPSPGEPS

SEQ ID NO: 923017 - protein, 164 aa, Homo sapiens
MSDTENPSSNELGSQQQPASKAGSEEHRPVHLWFSTLAGGTQDTCALALRIILPLAPTAGIHPPVASSSSFSSLSWYSSSSCLLLLLLFTQLVFILQLPPPPPPPPSPPPHSAGIHPPVATSSSSSFSSSSSSFSSSSSLSWYSSSSCHHLFLLFLLNAVKFTP

SEQ ID NO: 923018 - protein, 133 aa, Homo sapiens
MGCDLLRRNCPWAFTCTCMPTRPPAVARKHPRSLGYVLHTCCLTSPVGPAPLGQVFPLSINHQQIRALRERPDLGWLLLAITGQQFRPQGESSPSPEAVLSESWTRLRVSERKAWWLAGHRKWWASACQGVGH

SEQ ID NO: 923019 - protein, 326 aa, Homo sapiens
MSVQYSLSPQFMLLSNITQFSPIFYLTSFPGLEGIKHWIFIPFFFMYMVAISGNCFILIIIKTNPRLHTPMYYLLSLLALTDLGLCVSTLPTTMGIFWFNSQSIYFGACQIQMFCIHSFSFMESSVLLMMSFDRFVAICHPLRYSVIITGQQVVRAGLIVIFRGPVATIPIVLLLKAFPYCGSVVLSHSFCLHQEVIQLACTDTTFNNLYGLMVVVFTVMLDLVLIALSYGLILHTVAGLASQEEQRRAFQTCTAHLCAVLVFFVPMMGLSLVHRFGKHAPPAIHLLMANVYLFVPPMLNPIIYSIKTKEIHRAIIKLLGLKKASK

SEQ ID NO: 923020 - protein, 309 aa, Homo sapiens
MYAVALGGNTVILQAVRVEPSLHEPMYYFLSMLSFSDVAISMATLPTVLRTFCLNARNITFDACLIQMFLIHFFSMMESGILLAMSFDRYVAICDPLRYATVLTTEVIAAMGLGAAARSFITLFPLPFLIKRLPICRSNVLSHSYCLHPDMMRLACADISINSIYGLFVLVSTFGMDLFFIFLSYVLILRSVMATASREERLKALNTCVSHILAVLAFYVPMIGVSTVHRFGKHVPCYIHVLMSNVYLFVPPVLNPLIYSAKTKEIRRAIFRIPPLDIRCACSIFTFHSDFKFPEAFPEAEPMPASCFP

SEQ ID NO: 923021 - protein, 137 aa, Homo sapiens
MAAATGKHFGRTAETALQAGKARWRPWERLADWGSFRSDLPCPVGKRALLSPGRILKVCGKSGSLHAYVSHPVPTSTQGQKGVLVLDYPIQAFQLLPVSASSCIHSGCLLSEDLFSVCWSLDDLVSSWEKLLLAVAS

SEQ ID NO: 923022 - protein, 263 aa, Homo sapiens
MGGFGTNISSTTSFTLTGFPEMKGLEHWLAALLLLLCAISFLGNILILFIIKEEQSLHQPMYYFLSLFSVNDLGVSFSTLPTVLAAVCFHAPETTFDACLAQTFFIHFSSWTEFGILLAMSFDHYVAICNPLRYATVLTDVRVAHNGISIVIRSFCMVFPLPFLLKRLPFCKASVVLAHSYCLHADLIRLPCGDTTINSMYGLFIVISAFGVDSLLILLSYVLILHSVLAIASRGERLKTLNTCVSHIYAVLIFYVPMVGTEQ

SEQ ID NO: 923023 - protein, 155 aa, Homo sapiens
MNSFLPMESCTFMVKDYDHYVAICHPLQYLSIITHQFVAKASVFIVVQNALLLSPVPILSAQLHYCRKNVIENCICANLSVSRLSCDNFTLNRLYQFVAGWTFLGSDFILIFLSYTFILRAVLRFKVEGVAVKALSTCGSHFILILFFSTCWLWC

SEQ ID NO: 923024 - protein, 314 aa, Homo sapiens
MASPSNSSTVPVSEFLLTCFPNFQSWQHWLSLPLSLLFLLAMGANTTLLITIQLEASLHQPLYYLLSLLSLLDIVLCLTVIPKVLAIFWYDLRSISFPACFLQMFIMNSFLPMESCTFMVMAYDRYVAICHPLRYPSIITNQFVAKASVFIVVRNALLTAPIPILTSLLHYCGENVIENCICANLSVSRLSCDNFTLNRIYQFVAGWTLLGSDLFLIFLSYTFILRAVLRFKAEGAAVKALSTCGSHFILILFFSTILLVVVLTNVARKKVPMDILILLNVLHHLIPPALNPIVYGVRTKEIKQGIQKLLQRGR

SEQ ID NO: 923025 - protein, 265 aa, Homo sapiens
MTIWLEASLHQPLYYLLSLLSLLDIVLCLTVIPKVLTIFWFDLRPISFPACFLQMYIMNCFLAMESCTFMVMAYDRYVAICHPLRYPSIITDHFVVKAAMFILTRNVLMTLPIPILSAQLRYCGRNVIENCICANMSVSRLSCDDVTINHLYQFAGGWTLLGSDLILIFLSYTFILRAVLRLKAEGAVAKALSTCGSHFMLILFFSTILLVFVLTHVAKKKVSPDVPVLLNVLHHVIPAALNPIIYGVRTQEIKQGMQRLLKKGC

SEQ ID NO: 923026 - protein, 303 aa, Homo sapiens [sequence omitted]

SEQ ID NO: 923027 - protein, 671 aa, Homo sapiens
MADSSSSSFFPDFGLLLYLEELNKEELNTFKLFLKETMEPEHGLTPWNEVKKARREDLANLMKKYYPGEKAWSVSLKIFGKMNLKDLCERAKEEINFIVNTGVPNSWATDPYWSAAPRESGRIAGGDGTEYRNRIKEKFCITWDKKSLAGKPEDFHHGIAEKDRKLLEHLFDVDVKTGAQPQIVVLQGAAGVGKTTLVRKAMLDWAEGSLYQQRFKYVFYLNGREINQLKERSFAQLISKDWPSTEGPIEEIMYQPSSLLFIIDSFDELNFAFEEPEFALCEDWTQEHPVSFLMSSLLRKVMLPEASLLVTTRLTTSKRLKQLLKNHHYVELLGMSEDAREEYIYQFFEDKRWAMKVFSSLKSNEMLFSMCQVPLVCWAACTCLKQQMEKGGDVTLTCQTTTALFTCYISSLFTPVDGGSPSLPNQAQLRRLCQVAAKGIWTMTYVFYRENLRRLGLTQSDVSSFMDSNIIQKDAEYENCYVFTHLHVQEFFAAMFYMLKGSWEAGNPSCQPFEDLKSLLQSTSYKDPHLTQMKCFLFGLLNEDRVKQLERTFNYPDFDDEKQFLSDSSCLESCGLTEAGCEYLSLALISNKRLTHLCLADNVLGDGGVKLMSDALQHAQCTLKSLVLCKEAFDEEAQKLLEAVGVSNPHLIIKPDCNYHNEEDVSWWWCF

SEQ ID NO: 923028 - protein, 137 aa, Homo sapiens
MGLCNVIFEVHPSPTFLETISVYPSTQCTCNPERRGLGGKQQACWKGLSCQAREIDLYPGGNQEMSKLSIMTIKETSLKTKMAPRKAEWRNGKIYVLNGFIKLLVLSPNNAGPYQLGQQPWPARSGSLRPEEHAASR

SEQ ID NO: 923029 - protein, 167 aa, Homo sapiens
MQHFTVTANRTWEEATLHWLLAANERPGKGLPGDPVEPRKHRRPEDKTSPGLRVRFISTSTEITLQKHFKRGRICGCLAFLVAAFFSPCYNQLNSVLAGSWTSSSKHASGPVLAQRMGLETPCRPCLRPGFCWFLSELDPVASSHHNQGIDTGAIEVSLPFGTKTSL

SEQ ID NO: 923030 - protein, 238 aa, Homo sapiens
MHIITHFGFPTSIQSNNGPSFSSQITQDFSTSLGIKWVLHTPYRLQSSGNVEKVNSVFKAKLTKLALETHQSWTGNLPFTLMRLCATQNAPSIYSPFEIMYGQTFVLGPPPLPNSEPVSNYLPVLIQTWSFIHEAANEAMPLPIVISLSSIHNCLAGTDMFICQPDPHEKLQPKWAGPYTLILCMPNAVRVQGLPHWIHHTRVNLTPKATSSSKTLIAELSSRPISPTKLKLTKNFFS

SEQ ID NO: 923031 - protein, 370 aa, Homo sapiens
MFTDGSSFLEQGVQKTGAAITMETDILWAQALPVVTSAQRAELVAFTQALRWGKDKHINIYTDSRYAFATVHVHRAIYQEHGLLTLAGKTIKNKEEILALLEATGIPQQVAVIHCKGHQREDMAIARGNQRADSAAQEAARLPVAPLILLPAVSFPQSNLQDHPIYSAEEVKLVSDPQASKNQESWWILPDSRIFIPQTLGEILIGRLHSTTHLGGVKLTQLLRSCFKIPHLQNLANQASLQCKACAQVNAKQGPKPSSSNRLWGDLPGESEIIPPHGLPAAIGSDNGPAFTSSIAQSVNKALNIQRKFHCAYRPQSSGQNEMRGVFKIFEQIMVENFPNLAKVKLHIQESELTSNKIISNKSMVEANHK

SEQ ID NO: 923032 - protein, 148 aa, Homo sapiens
MHFHRGLLLRQAAGTRRQATVAFIVKRAVALCLRLTPCDWRMRIREAGSGAWLTLILSTIAPPRAYSVVGSHWRRRRLDCELGAGYCSSDSFREKGCVQASGLMGLGIQSARLCGKGKNHDKVKSKVKQRSHTWNSHPTGADEVERAA

SEQ ID NO: 923033 - protein, 147 aa, Homo sapiens
MRNKCQAGAWTCSLVSLQLLSNPDSENQQTWRVNFLVPEQEEMDLAEAGKGSGGSAIALLQAGLADAGRAQIQRSNQALGGGHVALWVGTSLLRWLLVSRGTQPGAPSPHTACWLHCGCCCHHWHTFRWFPEFHIRDSDKRSLQLKG

SEQ ID NO: 923034 - protein, 178 aa, Homo sapiens
MLQLGQHLALTAQSHHEDLRHRDGALGQVVGKLKSENLKSKIFRDLLSAKRVGAQAQELQGVQRGPRAIFPRTKFQINTPPRKEPAIEGTSGVGAKKKFQKYAYGLRAPGLIGDPINGNETTSLLLILPTVTKVSSEDVSTESHSALSAPTCLQPTALIPQPSFVQSSTSLNGRHYPK

SEQ ID NO: 923035 - protein, 124 aa, Homo sapiens
MGLGQVTIISPMDNCSSLLPGLPCIFPPSTKYFKHRSQKVVHASAQGSQVAFTTFRVAFENFSVDQNHLKVLLKQISGPTSRVSNSVAPREHHGILFTSFNSLLNRLLVHEDFPSIFFKTVYST

SEQ ID NO: 923036 - protein, 183 aa, Homo sapiens
MGALPLALRTAGRCVEPLCVGVRMNSFVPWEQLETKFPCNKSELVASFLITIIHSTSSKEMTGPQVMHPHDWEKLAILVLFEHGASSWSCPAAACQAFLLLRTPYSSLFPGFWAPHNDLYEFQSSGDTLHCSACKLGHSWRWDIPELFKRLHPAKFPLAEEPESVLQGGWGQRLKQPHHSTSL

SEQ ID NO: 923037 - protein, 134 aa, Homo sapiens
MPDKPGYFGASQQQNCRLRTKDLAHVHIPAGVTYQLNTSAFSYVPILGKPEIGNLNIISHSENHSWWEKHGSWSWLIDRVFPYKPVAQIQVLMLLEHSSIAATVLSQTTGSCIFNQATWTERSFQWSPTKSSQP

SEQ ID NO: 923038 - protein, 149 aa, Homo sapiens
MPMLPVQEPGLRTTRDGRISTTLMQGTHYAASVCPTRKALSEQGMQLWRAARGSAFLAWLFNVHPPPQLREKHGPFAVAEIVLVRELNDLSLLDTHSFCQPWVTCLYTRIASKFSVHLMRLLESSNRITWERTLEGRRSHSKANTKDCK

SEQ ID NO: 923039 - protein, 141 aa, Homo sapiens
MASTGPIWHLPWVHSGDVPSVSCLPPSSFTHLLALWYEESTGLGNRELTSPAIDVEQGKEDAALRQQPIDHLTKFTEHLHVLEAVLGAVLNPTGLKTPWALVSRGLQIEKVQGIELSERQAGLNVCQPPRPGTIGHRSVKV

SEQ ID NO: 923040 - protein, 208 aa, Homo sapiens
MVWRDTDGDYEYLHLPTDVNQNVNSDYLLEIFPLDSDSTTELSSDTEVPAINSAPDLNSVNPDNTQPGIWPFNALSSDPDQEANGQGQQQCRMSFSPTKEGHIAWEHFPDADTTVYMDTPLFEHHPQLSTLAGTLVVCTHPRQSQSYTYAHDCPFPHAYSPPLTYPNNQSLLAHFQCTCTLTGHAHLPDTLSLNKPCLQCTLWHTHPP

SEQ ID NO: 923041 - protein, 116 aa, Homo sapiens
MIGWGMGVDLGECWMSHQFLQAQGWVQKIMYAKYPGKLKSDFYMPVVITLIIIITVLGKKGPLLSVWNMDEDEALPDLSHPHLTQIIPECVLHNVVVRDSGPLAIGCCFMYSPGIS

SEQ ID NO: 923042 - protein, 390 aa, Homo sapiens
MVCTGARRRETAQLSPGTAAGSSLWEPCSSSQRPCTHHQHPFHLQLKIREVPRRSCSHQSHGAACEAEAPPTGPPPNWHHCCPCPYSQLHVTLGQKQWWGSQGSVKSLSQVRCGQDPHRAGSQGRGRTNLGGEDVCIVGLEGGCGLVDRKKQWAWKSCMIRAGTGPGWIGGPWGLRIQQGAAGVKEEGMTGANTFPPKPLLPSGSSPELSPLSVGHPLLELEIGVGGAKAIISNDIITPSSSWMTVCSSPWLVGLASELDFFRSLLQVGHLHLEGQVVFLHLIGPQGVPPLAQHLADGPVILVGVTLVRPARAWCRLLKIMSATHGPPDVLQDKFEHLKMIQQEEIRKLEEEKKQLEGEIIDFYKMKAASEALQTQLSTDTKKDKHRKKQ

SEQ ID NO: 923043 - protein, 145 aa, Homo sapiens
MSQRGSPHTTRNSLTDTGKGLHHHAKSKAKPLESFDQSSNMMCLGFFKEHSGSCMENRCRNTSQEATAAVKEKEEARTGQRTQALTMEETEHVSAELALTLSAGPCNMLPKTRDPSFSLRDYSLFTAKVERSKTHQLYSVISVIG

SEQ ID NO: 923044 - protein, 143 aa, Homo sapiens [sequence omitted]

SEQ ID NO: 923045 - protein, 146 aa, Homo sapiens
MSIELPIQASAMADAPTPAKLQSPRSKRFGKGISNKINSVVAREESGRVPIESGRLGFNSAATIDISGSQVAKLFAHYVENIPREKWTFISIALGFGCDHQQSRFRMLASHILIKSLVETLGVLSQPQEVWLQLKPPCYGDHMETL

SEQ ID NO: 923046 - protein, 169 aa, Homo sapiens
MIVTFLRPPQPCGTGHGHSWLCSPTDASAPNPLGSISAVFLLLPLLYAALPANWRSARVPEACGKSRLLIASSTHLFSQRHLGPGISPELNLHNGELVVKPEMLTSCSSWQSNPLGDGERESNKFGKARITGSSAGEREEVRCLYPSCPAQAIRLEGVHLVSVKETFPY

SEQ ID NO: 923047 - protein, 197 aa, Homo sapiens
MLLLDQTLAFNEKNVALAVACEFGDTWYLSQVNDRMTTEERDKFPSGQQALPSMDPHWDLNSDHGEWSCKYLLTCVLEGLRRIMKKPMNYSVMSTITQGKEENPSAFLKWLQEALRKYTPLSPKLLEGQLILKDKFITQSAAAIRRKLQKQTLGPEQNLEALLNLAILVFYDREQKEQAQKEKQNQRKAAALVMVLR

SEQ ID NO: 923048 - protein, 142 aa, Homo sapiens
MQINGNKPSKATSETQNETPNPITPLKATSSQTLIVKGSVGPRRSGCARGPEGFGGTGQEAARFSFTRKRCLHPPSMLFLRYHPLAVFWKLSRKLDLSLQRAYGQRTLRMICSSSRSGLECSDHLLNARQDTCELRVLAGAT

SEQ ID NO: 923049 - protein, 144 aa, Homo sapiens
MHEEISQNSTAVLSPFHSRGNCNPEKSDPSWKFTFFRKPSQIKPTPISECFCTWQTSCPANHYFYYNHDSTYGYISKRTESRERDICTPKFIAALFTIAKKVEETKLSINRQMDKRHVIYTYNGILFSLEKDGNLGTCFNMDAS

SEQ ID NO: 923050 - protein, 167 aa, Homo sapiens
MSVTALKAARLDLFVPPGGFLVSLASGVKLQTFASPIDAGTQLASPSGYSTASAGGAAHQSCALCPHSSALGRSMGPGAAEQGAALVGGGWGCPGAHGGDGEAQASQTAAAAADRALPHREAAEARGELKCSAGGPALLGDLAHPPPLLARVLSPSLPGAGGAGRLL

SEQ ID NO: 923051 - protein, 173 aa, Homo sapiens [sequence omitted]

SEQ ID NO: 923052 - protein, 177 aa, Homo sapiens
MSKTPCRYQAKVSYGSKSHLGVWPLLALLCYRHSHTQPSGLHISWLGAPTTSLSSSLCQLECSWWSRSLPLPEFQRHVVRTGCSLPVQLTYSRRAVVGQECFLVCGSPVLGSQLFSISASVSSFQLLYLPSIHSQDFPSEDLSGTCQSSWSLDGWCSTWLHLVGHLTLHSDVTLFTV

SEQ ID NO: 923053 - protein, 138 aa, Homo sapiens
MRKLITELIFLNIWNFTVRTSTVLPQIEDCSQCIHQVTENVLHSAQVYYMNHYRSVMQEDIGSEDEEMLLQWIGKEHLVQREYKTIIGETFEFCENGKKVLRKTVPTLVRPSWTIKRQIMYNQTVLMLISSSLSSPQG

SEQ ID NO: 923054 - protein, 142 aa, Homo sapiens
MNPILYASIPSLTSHVVLLQIAMWQNHSLRLSQLSTPLQGCGQLDTAGENHTTRLTNVTSSDTAPQSYLGPQGCRDAYQQPKIHKAVGIDLMVRVWLVRKLLSKAGNMAIHSCNGKTFSEINAHGFLGKIFVPNKLVAIEER

SEQ ID NO: 923055 - protein, 138 aa, Homo sapiens
MIKSSSYGVHGADPCLRDADGCLWWFLGPAAFLGHGCKSKSFFRNTSRAGEAARTKAVEDTAQVALQKNTPFINTVIEYIKFKIHLPFNTTVKQEDAQSSPFVWDRGVSWGAELSCKTKKVISKLRQVGYPTGKEKTS

SEQ ID NO: 923056 - protein, 745 aa, Homo sapiens
MAQSTQNVDYNQLQEVIYPETLKLEGKGPELVKENKTQPPVAYQYWPPAELQYRPPPESQYGYPGMPPAPQGRAPYPQPPTRRLNPTAPPSRQGSELHEIIDKSRKEGDTEAWQFPVTLEPKPPGEGAQEGEPPTVEARYKSFSIKMLKDMKEGVKQYGPNSPYMRTLLDSIAHGHRLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKARKVIVELMAYENANPECQSAIKPLKGKVPAGSDVISEYVKACDGIGGAMHKAMLMAQAITGVVLGGQVRTFGGKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNWEPPQKIPTGVYGPLPEGTVGLILGRSSLNLKGVQIHTSVVDSDYKGKIQLVISSSIPWSAIPGDRIAQLLLLPYIKGGNSEIKRIGGLVSTDPTGKAAYWASQVSENRPVCKAIIQGKQFEGLVDTGADVSIIALNQWPKNWPKQKAVTGLVGVGTASEVYQSTEILHCLGPDNQESTVQPMITSIPLNLWGRDLLQQWGAEITMPAPLYSPTSQKIMTKMGYIPGKGLGKNEDGIKIPVEAKINQKREGIGYPF

SEQ ID NO: 923057 - protein, 661 aa, Homo sapiens
MNPSEMQRKAPPRRRRHRNRAPLTHKMNKMVTSEEQMKLPSTKKAEPPTWAQLKKLTQLATKYLENTKVTQTPESMLLAALMIVSMVVSLPMPAGAAAANYTYWAYVPFPPLIRAVTWMDNPIEVYVNDSVWVPGPIDDRCPAKPEEEGMMINISIGYRYPPICLGTAPGCLMPAVQNWLVEVPIVSPISRFTYHMVSGMSLRPRVNYLQDFSYQRSLKFRPKGKPCPKEIPKESKNTEVLVWEECVANSAVILQNNEFGTIIDWAPRGQFYHNCSGQTQSCPSAQVSPAVDSDLTESLDKHKHKKLQSFYPWEWGEKGISTPRPKIVSPVSGPEHPELWRLTVASHHIRIWSGNQTLETRDRKPFYTVDLNSSLTVPLQSCVKPPYMLVVGNIVIKPDSQTITCENCRLLTCIDSTFNWQHRILLVRAREGVWIPVSMDRPWEASPSIHILTEVLKGVLNRSKRFIFTLIAVIMGLIAVTATGAVAGVALHSSVQSVNFVNDWQKNSTRLWNSQSSIDQKLANQINDLRQTVIWMGDRLMSLEHRFQLQCDWNTSDFCITPQIYNESEHHWDMVRRHLQGREDNLTLDISKLKEQIFKASKAHLNLVPGTEAIAGVADGLANLNPVTWVKTIGSTTIINLILILVCLFCLLLVCRCTQQL

SEQ ID NO: 923058 - protein, 163 aa, Homo sapiens
MSTCKAAGCLFVRLQGGWLHYVASYFPFCKIPSHCKDCFHHQLPDFVFYLSTLQSLNSGHTGLLLSEDCSRDLSFSGPSFFFFTCMTCSLIFYGSLLKMSPYQRGLPLLPNVNTITHAIFQNSLSPLLGFIFLLFTYSLRYYISNYSLVFCLLPLEGSEHCIQ

SEQ ID NO: 923059 - protein, 142 aa, Homo sapiens
MPVPPLYQGVCGRRAKSPWQTTGVRPKVQKLKNLEFEGRKHPAQEKNEGRKTQQVCTFQLLLPALFYRHWQLIRCCPPTLRVKTSLHEIPQEALEHKLYCRAYFTLKQRIRAFVPTPQSDFELPGTTEADAGTMLPVQPAEP

SEQ ID NO: 923060 - protein, 379 aa, Homo sapiens
MEAKGRVHKASEPKGTRDQDESLPVVPFPSPTNGRTLIQLEPLTSDDSDNYKCIASNDHADAIYTVSLLVTEGQEKMDFKKMLKKRAPPAPKKKQKKVANEKEMLEILSKVPKKDFEKVCMEYGFTDFRGLLRKLKEMKKKVEVEAIRILKPLEDKETKVDTTVVFDCIMELKDPKCQMIWIKRVGHAPSSLGWRWGMETSGSFLLKPFISFPTCSMRQGTEPLRIQYSLGKYDVKQMGTKYMLVISNVNMNDAGIYSLSVGDKRMSAELTVLDEPLKFLGEMKPVKVTERQTAVFEIRLSKKEPNFVWKFNGKELKRDDKYEITVSEDGLTHTLKIKDARLSDSGEFSAEAGNLVQKAQLTIDQGQSDRHQLAASDMI

SEQ ID NO: 923061 - protein, 146 aa, Homo sapiens
MHFLPSQPIKTPSSARLRHSTGQPAVERSCPLQGLLSAKSWEDDPPDPLDSRTERAVTQTGLKHPSCSPHCGQHEGEKRGEKSCDPSGSPDLGVPQARGVTPSLRFRGSWHLQASRYHRVPWYPQWKPFAVEAHAGAWSCLPHCSQ

SEQ ID NO: 923062 - protein, 191 aa, Homo sapiens
MALLTEHLLKPLPADKQIETGPFLEAVSHLPPFFDCLGSPVFTPIKADISSNITKIKAVYDTNPAKFRTLQNILEVEKEMYGAERLKVGATLALMWLKRGLRFIQVFLQSICNEEPDENHLNLIRVNATKAYEMALMKYHGWIVQIFQAALYAASWAECDGGGVPGKDPPLPSQLHGDHRCHLRDVYPDER

SEQ ID NO: 923063 - protein, 152 aa, Homo sapiens
MKLSTGIIFCSLVLGVSSQGWLTFLKAAGQGMSEQSLTALDSQERGKLLAEKLEAAAPPPLALSLPVCLVRGSEWMVESPPLESREWEGGLLLTGLVINLLACLDYSDARENVQRLTGDHAEDSLAGQATNKWGQSGKDPNHFRPAGLPEKY

SEQ ID NO: 923064 - protein, 145 aa, Homo sapiens
MASRNTQKLGPGIFTPSGHGSITDTHGGQQELRCQETVSLDSDSLRWQQCGGRRVLPTPSQSWGWLVLGYWKWDKGPLPGLVTRDQLLYSDPFLALLFREALKGSTGGFWLEDWQDERHLPRRDEQGGSKAPAQAKKPWGRCRRW

SEQ ID NO: 923065 - protein, 324 aa, Homo sapiens
MLAVAVGVRPGPVTMGIAESTPDELPSDAEEHCQRRPAAGAERAAVFAAAQAVCALSRLQKLYLPEEIEELPDGLCRLPRLTRLYLGGNRLLALPADFAQLQSLRCLWIEGNFLRRFPRPLLRLVALQSLQMGDNRLRALPAELPRMTGLRGLWLYGNRFEEFPPALLRMGRLHILDLDRNRLGGFPDLHPLRALRVFSYDHNPVTGPPRVADTVFLVGEGAAALVPGLWAPPGAASAPWKPLQDWAPEPMFWLMGFSHSERRGSRKLWLAFSWCHWATGCRGRAIMSFQCFTSPGPLFQDSLIYFPGCLPPHPQAWARQASRN

SEQ ID NO: 923066 - protein, 128 aa, Homo sapiens
MTGGAPALRELGEFRWPGPLPHQGLWGSCWAPWFCQPERQNPILLYNNHQSSRQHLLSSEGLPGPGAKCITRIIPLNSHRSPVVIPLGSPRAFDGSPCLQKEQIEHPEPPNLKSKMLQNSKLFEYPHD

SEQ ID NO: 923067 - protein, 139 aa, Homo sapiens
MKCQLLGSLCWVPSKWMWSFSSLPWRSNPSNVKEKDQQREAAPQNLFQWVMFLFYVIGLSHRGQADLVVCPVEDGKVLADEDITQDPKLSRFGGDVHALEATDAAPLALEKRRIKVELGHRFSRDRRWVINIQGALVQL

SEQ ID NO: 923068 - protein, 320 aa, Homo sapiens
MRTKSGGMGTTTGVQPWQTSAPQNTTQPKLLAPHQHEKSQKKSSLLKELGAFHITIALLHLVFGGYLASIVKNLHLVVLKSWYPFWGAASKMLCLMTNLISLFCVLSGLFVISKDLFLESPFESPIWRMYPNSTVHIQRLELALLCFTVLELFLPVPTAVTAWRGDCPSAKAPVFEELLARLILPFTFPTVSPLPCSGQQFSPSERSSALPKVAQQSLLRSAWLQWVLRKLQGFVLIIVGRRKDHIHGGLCCPFGYTMLLTTLGLIATKNPARLLQEELPENNRSPTPHLWENVASRALKRGREGRREPGLLGSLIYLGV

SEQ ID NO: 923069 - protein, 142 aa, Homo sapiens
MLHSYCGMLRVPTGALPTRPVRRGPPFSRPKNGKSTDSLYNAPGKAAGTQHQPMKTAAEALPCRATGVELPKALGAHLLHLCTPDVRHGAKGDHFEALEFNNSPTGFQTCMGPVAPLFWPICPIWNGNIYLMLVPPLYLGSN

SEQ ID NO: 923070 - protein, 160 aa, Homo sapiens
MLLIVVMYWVYEQAYCLLWDQTGTSSICRNADVSCIEGVGLHSSCNPEPRGHTSYGDAVTSECSIKAFYRCTLAKLPWEKLWWCLQWWVREIKSPFMQNGERKLKQPAEFQTVHAQNAKLPNQDRNRRMWPESHILPNMTCKTGAPNFGPVARACFLLAS

SEQ ID NO: 923071 - protein, 148 aa, Homo sapiens
MRRPNRLPVMLCFSGHAPGPLSCSTLYTWLCLLDSSSIISESIKVFDLSEKSIEEIMTGLENTVTMGSWGTPDPQQVLVLFPAPVQIQPGIPTLTRGPTECDLAVNFLNLGPGSPGSPVGASSVAPLTLPRGVLTSKSGAVRETRADT

SEQ ID NO: 923072 - protein, 156 aa, Homo sapiens
MAGELEWLPPSIVPQYSQRMDMAKFPRHQHHLLNAVEMRDGETDNVNEWEIEVRIHIANEDMGSNFCNTILELLQPLDYSGLEQESQIKLPYLLLKMILNCFLRQKCTDVFLLDLSDFDIYCTLDSLHVKIKALTVDDCSRWVVNQKHDSNSSFLG

SEQ ID NO: 923073 - protein, 313 aa, Homo sapiens
MLRLDIGSNLIYGVLLVIRFPIILVMRGRENDSRRECRRSVGQHRSLSHELEDLEIRPRVSYVQREEALPQSLEDVKGLGPGRFPEQQKSRTEKVGSRHKVLKVSDMHLLYQSVTEASSLARAAAHQFMWYTATEFVQKMFVECTESWLLVEIRGAPLVENLQPKHNELSLGNGCPVTRMTNDIFEFTYALEFSGIMKYECPWGILVESFVKYQPAFLNFRTYIPVRCALERKPSSFEQNVIQNNTDKSKKIVQTQYYQAGNWGIEECYLGIPEEDIVITGDDNSLCVIAHEDLPVGQYVEREDGEIEDPDPA

SEQ ID NO: 923074 - protein, 146 aa, Homo sapiens
MGSKKKDGLIVPITQLPADSSDVQTPSARSFPVFSHCIDPPRGPATHCSDEASHRGRCLPKGTLRIHVARAGELTYMITRAACKLRSQEASPGPKISEVGKLIMRFQSLAEGLRAPGKSLVLSLRIQKLKNLESDVRGQEVSNKRI

SEQ ID NO: 923075 - protein, 186 aa, Homo sapiens
MGVEPLLRASIRAKLSGNAESEPTQRVPIRDMPSGALGVGLPLRSQNYKATSMQLQPNRAEARTESSKDMGAGKDQLYKKDEAPHTRPERSKAEEMLDSGVEHIGGGTGCPEPPRATGSLGLHSSFGSPFLSELMYKTKLHPDHLGHMFRGSPDGCVTGHGHSYLAVTVFRTFFVFYNFESSEEYW

SEQ ID NO: 923076 - protein, 208 aa, Homo sapiens
MSSRLPAFVTQAVPSSPFSVGLLQFTGGLLQTLVTLVFPVPGGITSEGYETIEDLFKEAVWLHFGRTVVLCWGIPSAADQFGLSKNCRLDQLRCIAAKVMALLALQALHPREKLKPLFTVEHWWGIAGGPSWEDLPSEEEWIRVLLKEPVWPCTEKTAVLCWGTTYASVDLDPPNPAGWNSQVAQTAKVAACPASQVLRPREKSKLCP

SEQ ID NO: 923077 - protein, 149 aa, Homo sapiens
MWSSHPPGPLRVFEHQHSEVRDGVFLMGCQRLTRKAQGLINLEPDLDEVTLCTSGLQQHHHGAGRRPRLWQMQPMAKGDSGQPGAGGFTSLTFHFGVCKLGILITTGLPAVRGMQSVPTNSQRLQSLLAHWGLMAAHAAETALVIAIYR

SEQ ID NO: 923078 - protein, 129 aa, Homo sapiens
MVMLMKDVMMMMTEMIMMMMVMIVMMMVMAIMMVMVIKTMMVDDDGGGDDSDDGDVMMMVMMIMMMMKVVMVLMMVMKAMMVDDGDDDSDAMMAGDDGDGDYDGDSDDGDDDEGGDGDHDGDGDESNDG

SEQ ID NO: 923079 - protein, 132 aa, Homo sapiens
MIDTKYNNTSKKAYEWNAEKRIQAPSKKAYEWNGEKRIQARARLMLKSCLMHKPHLLAFESLLITYMWGGKRKQQALKTLQRFQRWLFPETLLVLTCWGLVTRAVLGAPSSLKVCFLGHEVGAPQILVICGG

SEQ ID NO: 923080 - protein, 284 aa, Homo sapiens
MNQGLDSDNDSDYKRDVVEGSKERHMIGHLLPETSYGIKMQCFSEGEESEFINVVICESKVKRVPGASEYPKGLSIPLNSSGSEGNVRPATSPARSSDILTLWNVLTVKIVETTIAVSSKPTALSAVALFLWSLGWHFVLSMVWESGPQSNEDAHMPGFCIPDCGQLPHEKIKNNVEPISTQHTCCQDNRNNVSSNTQKIQKSSAEETAVSLQKWTATFYIGILLFLPPISEDCAEKTTWPPPGVPLDSPSEVLQQPQETGGCAKNQSRSDFKSVTNCTKQACE

SEQ ID NO: 923081 - protein, 322 aa, Homo sapiens
MSFKGYIFLYFCCSWELCSISHPAQTVAGPDSLCIVKVVLEELLSARGFGRHGGKKLNQLNLLPCRSESVLLHMPQPVNPELTIGPITGPVDRLNHFRDFPKRPLTAYNRFFVESWLQYSQMYPGMRSQELTKILSKKYKELPEQMKQKYIQDFQKAKQEFEEKLARFSEEHPDLVQKAKKSGVSKRTQNKVQKKVQKNIEEVRSLPKTDRFFKKVKFHGEPQKPPMNGYHKFHQDSWSSKELQHLSVRERMVEIGRRWQRIPQSQKDHFKSQAEELQKQYKVKLDLWLKTLSPENYAAYKESTYAKVYRKASRPDGGVSTL

SEQ ID NO: 923082 - protein, 300 aa, Homo sapiens
MNSGILQVFQRELICPICMNYFIDPVTIDCGHSFCRPCFYLNWKDSPFLVQCSECTKSTGQINLKTNIHFKKMASLARKVSLWLFLSSEEQMCGTHRETKKMFCEVDRSLLCLLCSSSQEHRDHRHCPIESAAEEHQEKLLQKMQSLWEKACENHRNLNVETTRTRCWKKMPAFHHEEEKHNLEMLKKKGKDIFHRLHLSKAKMAHRREILRGMYEELNEMCHKPDVELLQAKGPSYFIHQPQNFVEWSRSESVLLHMPQPLNPELSAGPITGLRDRLNQFREVTSKTFYDFTFAGKVTS

SEQ ID NO: 923083 - protein, 484 aa, Homo sapiens
MWTLHYLKLFINPDPKMTCCSFFLRNMNSGILQEFQMELTCPICMKYFIDPVTVDCGHSFCRPCFYFKWQDIPIFTQCFECMKTTWQRNLKTNIHLKKMASLARKVSLWLFLSSEEQMCGTHRETKKMFCEVDKSLLCLLCSSSQEHRYHRHRPVEWAAEEHRYSPAKGFYQAKGPSYFIHQPQNSVEWSRNMNSGILQVFQRELICPICMNYFIDPVTIDCGHSFCRPCFYLNWQDMAVLAQCSKCKKTTRQRNLKTNICLKNMASIARKASLRQFLSSEEQICGTHRETKEMFCEVDKSLLCLLCSNSQEHRNHRHCPTEWAAEERRDYVSLRIEAIRAEYHKMVAFFHEEEQRHLERLQKEGEDIFQQLNESKARMEHSRELLRGMYEDLRQMCHKAVVELFQTEGPSYFIHQQQNYVEWPRYESLLLQVSEPVNPEFSAGPIIGLMDRLKGFREWPRINLDGRVNDEISCGNGKPFFGGQ

SEQ ID NO: 923084 - protein, 139 aa, Homo sapiens
MPGRPCDTAWLGPGLTEPLPGSILERQRGNARGLVVPVAAMVLSPAASPCPLTPAAGAFPAPWPGASSRPPPPPVSPPWPPCKATWVSAGGRCPQVATVLGAALPRRPLGLEGYYEFCDRVYMPCDIQSNVFLQYYKGY

SEQ ID NO: 923085 - protein, 264 aa, Homo sapiens
MRFVKQMLEGSMLLKNTKSSIPRVPHVNLPIIFARCESLSPPYKKTFRFCSDIGIFLRVTSNIHASQISMQEDMTIGSFRLHMKGEEAYRVYALRGITYPAFLCSPLNGTVSVIPVLLRVGAQQTEQALVHFTEHFLCLSVHPTYLLLRSKELPEASFSNKGSHILQTNVSFEVSLPCCLLAYRALSKNCHVLPVEVETGPAKAVPTFYGDWVYEVVHADGTGSASGYLERFVASVRKASIFTKDIDGSILRNFFVIIAFNSQS

SEQ ID NO: 923086 - protein, 146 aa, Homo sapiens
MLVAGGLRGGPRLCLGKSVALYFPKTIQDYLIYLQVVHQIHLFYITAPLQLLPFIYLFSSHQCNHLFECMKLIKIDFKYEWDHEMQQSPQNPAISDKDVRGVCQEVELRISFPNILKAIRLRNLTHVGQKKRKIRLNSDSDSPTML

SEQ ID NO: 923087 - protein, 157 aa, Homo sapiens
MLLSSFYVKIFLFPTNASKRSQYPLADSTKRVFQNCSIKGNVQLYSTKSVSKLLYVKFLYEDIPVSTEGLQAVQISTCRFYRKSVSKLLYEKVKIFLFPPKASKNFKYPLADCTKRVFQNCSMKKCVQLRELNTIFRKKFLRMLLSSFYVKILPFRP

SEQ ID NO: 923088 - protein, 184 aa, Homo sapiens
MAYDRYVAICKPLHYLVIMRQWVCVLLLVVSWVGGFLQSVFQLSIIYGLPFCGPNVIDHFFCDMYPLLKLACTDTHVIGLLVVANGGLSCTIAFLLLLISYGVILHSLKKLSQKGRQKAHSTCSSHITVVVFFFVPCIFMCARPARTFSIDKSVSVFYTVITPMLNPLIYTLRNSEMTSAMKKL

SEQ ID NO: 923089 - protein, 146 aa, Homo sapiens
MPIMKKKISSDTNQKEAFSFETLFLYILQMEIWKLIDAIGEKANIHREKLKGIYQRNQSVMCAFPGRGHWRKSELRPLEKKRISQDKNLKEAIEKLLCDVCFHLTENERAFIAMAHLYKKKGRDVVGIKGHRVEGPAEAMAEELKL

SEQ ID NO: 923090 - protein, 682 aa, Homo sapiens
MPEETQTQDQPMEEEEVETFAFQAEIAQLMSLIINTFYSNKEIFLRELISNSSDALDKIWYESLTDPSKLDSGKELHINLIPNKQDQTLTIVDTGIGMTKADLINNLGTIAKSGTKAFMEALQAGADISMIGQFGVSFYSAYLVAEKVTVITKHNDDEQYAWESSAGGSFTVRTDTGERMGRGTKVILHLKEDQTEYLEEQRIKEIVKKHSQLIGYPITLFVEKECDKEVSDDETEEKEDKEEEKEKEEKESKDKPEIEDVGSDEEEEKKDGDKKKKKTKEKYIDQEELNKTKPIWTRNPDDITNEEYGEFCKNLTNDWEDHLAVKHFSVEGQKKKNNIKLYVRRDFIMDNCEELIPEYLNFIRGVVDSEDLPLNISREMLQQSKILKVIRKNLVKKCLELFTELAEDKENCKKFYEQFSKNIKLGIQEDSQNRKKLSELLRYYTSASGDEMVSLKDYCTRMKEKQKHIYYITGETKDQVANSAFVERLGKHGLEVIYMIEPIDEYCVQQLKEFEGKTLNLCKTMKDILEKKVEKVVVSNRLVTSPCCIVTSTYGWTENMERIMKAQALRDNSTMGYMAAKKHLEINPDDSIIETLRQKAEADKNDKSVKDLLILLYETALLSSGFSLEDPQTHANRTYRMIKLGLGIDEDDPAADDTSAAVTEEMPPLEGDDDTSCMEEVD

SEQ ID NO: 923091 - protein, 153 aa, Homo sapiens
MERIKNRRVVNGKVEYFLKWKGFTDADNTWESEENLHCPELIEAFLNSQKAGKEKVGTKRKSLSDSESDDSKSKKKREAADKPRGFARGRDPERVIGATDGSGELMFLMKWKDSDEADSVLASKEANMKYLQIIIAFYEERLTWHGCPEDEAQ

SEQ ID NO: 923092 - protein, 161 aa, Homo sapiens
MWGRLRKSREIGNNSSFGNVPQPREALTQGIFPLKLPFAYPQPSLAQQSRRTRDECRPVVMEMSVALRSASALGSPQTHFRFRRFGTDTMILLALSSHQGEPTNGVTGPGRGAIDCRDEAQRCCRRWWIALKFQTTQPFPISSFFIPVKSALFEYHSCLLM

SEQ ID NO: 923093 - protein, 149 aa, Homo sapiens
MLPSPHCSYVWTHNKFSPGECELNHLSIFWVNTEDSEAPEEGETTRQPEPVALNKSYVQCIFNASSELTPRILNFQASHTHLRQWMRNGHCPITAVGNAAQSNENVKLHDLETVVTTQLITMEFESMTFTRITKKDIPLPSLLPKIDFR

SEQ ID NO: 923094 - protein, 141 aa, Homo sapiens
MRPHAEAVPGELRVGALHGLPEDHTPLPQTLDRHTSHGELGFSRVPSPQALLPFTHFLTFRDCECSKLSLTFPCPGLGASRDSEACGVLSLEGDVGDRDLHPVLPLVLGTSEVTPGTSEVTPALLSDTTALIPRTSEKEDI

SEQ ID NO: 923095 - protein, 163 aa, Homo sapiens
MIRPWPVLTRLTRAQPGDRSARGDREAPPPSPRAASSASDGAPSGLRSGGAEQSPAGLASPVTSLLKILLAPSACLPQASVRVPVSAFPPRKSAHHWLGTEPGTKERQDPEERERRQRGKEDPGRQQHEIQPSALPAASPACAGPQHQLLQPKGLDIVSLLAA

SEQ ID NO: 923096 - protein, 173 aa, Homo sapiens
MLNQAEPQEPLYSFSRAIIPFIGQHQIEEAGNQTQEPSEENSQNDDRTSRSSTMQHNLCRPASRAKYRTGNLSKVSEGEMELAGVLCIKLCIVVKKVGPRRSYIFTLNEWDKEEVLTPVYEVPPHGQQNPDVKKESTQNERKRPLELHIPISSSQAEETSQLQTQVMYYVKGV

SEQ ID NO: 923097 - protein, 172 aa, Homo sapiens
MPQSRPSPKCHPSSRAPKQIGSVVTVLQVSFSFYSVLLPSSLFREIKVTVKNSDNWLVDGDLLWVHIHETHCASYKDGQLDIGNMCLLLGEEPGYKPREGSRISPPRLTNTRASEKILPYESNFKNLEKVTAIQDAPKSMEGHRKHEKSGKYDTIKGPKLSNNRSQSKIIPL

SEQ ID NO: 923098 - protein, 141 aa, Homo sapiens
MQVRVTEKGLSSVSSKLAAECVSSRKYRGLPIDGILGAPIFGYVCIRRNRKVTIKGDGSSEGEELELLISSSAAAEKRVKTGYCRSHVKAMMYYLDARLRAQYGAEMFQEKGGAEFEGDGRWTHGHTSGFLLNFLIPWDNC

SEQ ID NO: 923099 - protein, 147 aa, Homo sapiens
MGSMMLSNKAQLPRRTHGLAGRPGALLPCVTSGCCSHVPAASQAQLPRRTRRLAARPGHCCPVSPQDAIPTSQLLQLQLLLKLLQEDPCSSACLKMKVETRKHADWGMTYGGDQGFYPERIGKALWCDEGSRLTSPPLSSSGPGGNY

SEQ ID NO: 923100 - protein, 189 aa, Homo sapiens
MLLKAAPTDACVLLLNPRLSTLTPAAWAGDTGLTSCLLVSECLTEGQGMFLQNKEKYSFFCLPRRGVPRAPWGSTLHLGNKMLLCPHKYASCPSSYLVTSLSSQGSAENLENACATISSETKPHCYGTRVGSLRDIPDACATISSETKPHCYGTRVGSLRDIPDACATISSETMPHQGDCEQSLWTCFY

SEQ ID NO: 923101 - protein, 150 aa, Homo sapiens
MHRPEIAAALSAVIISVSEQVCGDHQSVPGTPVDMGLALCVQTWALTARLTSQWRGDRQQTVTVGPWVWAEGTADHSNEEEMTRSYRGHWFLGSLVLEEAGLDLGGGEEVSPAATRTMAALPHLPWASLPLPFPPSPPGGTQSLTSTLVL

SEQ ID NO: 923102 - protein, 156 aa, Homo sapiens
MGDAGKRVLVLCFFSTLCLCAGGEGEESRTVFEMLEGIPGSCQFHCSGALQAPAEAVTKSSNHSFTHHGVSSNGQWTHCPLLRPHGDQHRSSAWVQGASFHQGVYGRSSQARTGRESTPAGEGLCGNYTAEEDFEQLKGVSRTDSSYTCKFVSFDL

SEQ ID NO: 923103 - protein, 143 aa, Homo sapiens
MNFLNNISGTWNCIKYIDQFGHIWREAVPCKGAELLKTMGTHLLHQHDLDVRHGIKGDYFGALRFDCSTGFRTCMRALDLLGWPISAIWNGYLYPMPVPLYLGGVGDRGFRHRGNVLFFKLCDKPIGYHVIILVHVILFNITY

SEQ ID NO: 923104 - protein, 141 aa, Homo sapiens
MPARSYHRNGMEMAAEGTLLCQLRVSVYHIRGQGIILCTDWGIHFPEEDTEAQRRKFAKDDKGSLCLHWAQPLSLDVPTSAPRVPPRTCTMGNILREIAISLKRNLRLFLKTPSPLRIFLELPFAAGVDFSALGLQGSSRS

SEQ ID NO: 923105 - protein, 141 aa, Homo sapiens
MPFMGLLFCRGFPRLDRCIYSAALLGQIGAGRRNNENVIIKGPDLDRGSPIWFPVSPAFHILGPRAHDFSAPLIIMSRHLDPELSCNNLLRGERWGLVEAQREPPAVVQVWKKCQLGCGESGSLDPLRRPLSQILSPSRYW

SEQ ID NO: 923106 - protein, 160 aa, Homo sapiens
MLRMLVLNDTTLIDHFLLITISHKTRCDMKNRNITLEEVSVEFKNQRMEIFTFLLRLKTKCLFVANGAEFGDYAENLPSAAPEYGLYAMSFSLGAAESCRSGDRHGKGWDLRNNLKISPVIKPMWSRTQRPADTVESARVNIFIKCWSQELISALEESTD

SEQ ID NO: 923107 - protein, 156 aa, Homo sapiens
MDTLVAATAGSKLGHTQSSWPPTPLQYWDLPKAHNCYGLIAADVYSRPEVTVMVTEIASENNSLELEALGFFLVLYFTLAELVPVARQSPLYSVVSFSQEEAVCLSSFIAWNYRRSNAGTFVTTTAGVLLGCTPSPQSSTAPGLPQGPQSLRLGCH

SEQ ID NO: 923108 - protein, 229 aa, Homo sapiens
MGRVVSDGELGFVGRVVSDGELGFMGRVVSDGELGFVGRVVSDGELGFVGRVVSDAELGFVGRVVSDGELGFVSRVVSDGELGFMGRVVSDGELGFVGRVVSDGELGFVGRVVSDGELGFVGRVVSDGELGFVSRVVSDAELGFMGRVVSDGELGFVGRVVSDAELGFVGRVVSDGELGFVGRVVSDAELGFMGRVVSDGELGFVGRVVSDGELGFVGRVVGCPTVSLF

SEQ ID NO: 923109 - protein, 139 aa, Homo sapiens
MCLRLVLSLKRSASHVSCPAFSAPPPSWAQYSPAQEYISSKLFVKGIYSTLQGNTILSAPCIYLTPCYQPRNSCELLQECWQTDLSTSQEKNCPAPWREVLGQAQCLGSMGSGIPWWKAQLRAVSKPVQGGHGVESSQS

SEQ ID NO: 923110 - protein, 170 aa, Homo sapiens
MNGQCSGIVRIPILQMSTLRPEEFSQCSYVYRTYKLPFRLGILVPNSVSLCLPHLQAAPGNNDSVKWAAEPHTNSAGSITLDSPASGTVRNKCLLPCRDSSKAALDLDPAACQGPPCAHLPAAKPALASDLKVGGQKKLPRAAAFTLWNGDLSWEILSKLLFPDLSFQTP

SEQ ID NO: 923111 - protein, 150 aa, Homo sapiens
MLAQLLDIIDCCFFSKGTVQTESALCPGQTGRWLDPPLLRRAGDCESNEKHEKECVHPLEAKTGSLADNQLPAVQLPTNAHIPTANANIVLNSVFSLRDFGVTWIIRFAGLTLYDKRRCAGKALLRLIFSIEINPKVHLSSISKTQAKDA

SEQ ID NO: 923112 - protein, 136 aa, Homo sapiens
MGCGKHVGQQEVPAAQLWEEDTGEHNDMSDCPAWLGKGNVKLWNSVDDGCESGEALRDDVEDFHIPGGPPRAGGELLGDGSKNMWYIIDERGDSEESSEEDTAEPNGFIDCPSRGEREKLGEARMDLGVSVLGDRS

SEQ ID NO: 923113 - protein, 145 aa, Homo sapiens
MPRFQRGSVPGTQFEALANLLAHMTQLPGHFSTVPVRAPHPGAQEPLLHSVLTRRPVHLLATVTLLPAEEAPVMADITTQSILTPQLCSGNLLLAHVLATARAGTTLQQVGVPAGHTTGDMASMTLLPGSDTVDVNPSFTSVICK

SEQ ID NO: 923114 - protein, 309 aa, Homo sapiens
MASTSNVTELIFTGLFQDPAVQSVCFVVFLPVYLATVVGNGLIVLTVSISKSLDSPMYFFLSCLSLVEISYSSTIAPKFIIDLLAKIKTISLEGCLTQIFFFHFFGVAEILLIVVMAYDCYVAICKPLHYMNIISRQLCHLLVAGSWLGGFCHSIIQILVIIQLPFCGPNVIDHYFCDLQPLFKLACTDTFMEGVIVLANSGLFSVFSFLILVSSYIVILVNLRNHSAEGRHKALSTCASHITVVILFFGPAIFLYMRPSSTFTEDKLVAVFYTVITPMLNPIIYTLRNAEVKIAIRRLWSKKENPGRE

SEQ ID NO: 923115 - protein, 243 aa, Homo sapiens
MEICYSSATAPKLISDLLAERKVISWWGCMAQLFFLHFFGGTEIFLLTVMAYDHYVAICKPLSYTTIMNWQVCTVLVGIAWVGGFMHSFAQILLIFHLLFCGPNVINHYFCDLVPLLKLACSDTFLIGLLIVANGGTLSVISFGVLLASYMVILLHLRTWSSEGWCKALSTCGSHFAVVILFFGPCVFNSLRPSTTLPIDKMVAVFYTVITAILNPVIYSLRNAEMRKAMKRLWIRTLRLNEK

SEQ ID NO: 923116 - protein, 305 aa, Homo sapiens
MVATNNVTEIIFVGFSQNWSEQRVISVMFLLMYTAVVLGNGLIVVTILASKVLTSPMYFFLSYLSFVEICYCSVMAPKLIFDSFIKRKVISLKGCLTQMFSLHFFGGTEAFLLMVMAYDRYVAICKPLHYMAIMNQRMCGLLVRIAWGGGLLHSVGQTFLIFQLPFCGPNIMDHYFCDVHPVLELACADTFFISLLIITNGGSISVVSFFVLMASYLIILHFLRSHNLEGQHKALSTCASHVTVVDLFFIPCSLVYIRPCVTLPADKIVAVFYTVVTPLLNPVIYSFRNAEVKNAMRRFIGGKVI

SEQ ID NO: 923117 - protein, 230 aa, Homo sapiens
MESSLNGIEWNHHRLEWNGIIIEWKRMELSSNGIKRNHHRMESNGVIIEWNQNASSSNGLERKHHRMYLKGSIIKWNQMESSLNGSKWNHHRMESNGIIIEWNQMESSSNGTECNHHQMESNGIIIEWNRMESSSNGTECNHHQMESNGIIIEWNRMESSKNSSNGIERNHRMNSNGIIIEWNRMESSNGHDWNHHQMGLNGIIKWTRMESQLNGNERNHRMASNGIIIE

SEQ ID NO: 923118 - protein, 275 aa, Homo sapiens
MALGGGYGGASGMGGITAIMVSQNLLSPLKLEVNPNIQAVCAQEKEQIKTLYNKFASFIEKVRSLEQQNKMLETKWSLLQQQKTAQSDMDSIFESHINKLRRRSLDMDSIIPEVKAQYKEIANGSWAEAEGMHQIKMPTRSCRAGGRPAAAEQDMVQQLCHGAPGADERQAGPGHQDRHLQEAAGGRGELAGVWDTEHECPSEDHQWLLRWAELDPRAPHKPSTTGLSYSLGSSFGTGGGSSSFSRASFSRSMVVKKVETRDGKLVSKSSDVLPK

SEQ ID NO: 923119 - protein, 170 aa, Homo sapiens
MEQGAALIWEAQAMQEPKVEGREIQAWRAAGPKPCPAGRQLRPSEKSSTAAAGPGAKPLTAPGLWAVRLLRVRGRPSPCPPGTRAGLQVLRSPRSHLRLCLHTSLQAEGAGSGLGQPRKGFPQCSSGLKGSSSAARVGTKAEEAPREKGESITSREHPMGQRKLNNSLQP

SEQ ID NO: 923120 - protein, 153 aa, Homo sapiens
MKQFSIHNICEDVLYSCLKFKLLITFQIDNLVAIHFTRDAFKNISKLFANESRRDLEPAMDLLVLSHGHQTNILDIILIHQEALTQSHGEQATCGRRENRGAEADGVHYHRNRISLATSAEIHTSIQFTQARDLKSQMDHFLQQEILSFQKVT

SEQ ID NO: 923121 - protein, 210 aa, Homo sapiens
MQIRGAPKSKRQLTLPSYSERSEDTSGSCGHLTCSLSTPGAADSVNKQPWEERMLGGDATVIVVRHPSLTLRGACQSAVTVSQVTRDQMKMFIQQEFKKVQKVIADEEQKALHLVDIQEAMATAHVTEILADIQSHMDRLMTQMAQAKEQLDTSNESAEPKAEGDEEGPRQKAPAEITVNLTHTDSAIKQEACSEGVGAEGEKYSVSSGP

SEQ ID NO: 923122 - protein, 134 aa, Homo sapiens
MGVSEAIGQCQSSAAKLRRSGKSVREPWARVPGHLRVAARRVGQSDFQWCPAQMRHGLGGIPSCEHSLTQTEANREEGGMEGGSLSIVKEASPEKREGIGMGGVLAPQGEVVLATKVKDQSKRPLGDQTPLKCG

SEQ ID NO: 923123 - protein, 153 aa, Homo sapiens
MHSQGAPMGETAVMPGVMDKRENKSPSPGPFIPGSLCSELKTALGRKLSPWRQKLWLSGHIPPSMPKKQDHPTPALLAAAHFLFIPGFWSNEFVSTRDYIMNLSSGIHDVQNMQVCYIAIHVPWWFHAPINPSSPLVDLQSMISLLLLDQFSY

SEQ ID NO: 923124 - protein, 143 aa, Homo sapiens
MISVWPIGEANCCSKVFIVMCNCLIVLSMMLKDPHLVKALSWFQCIWKLYSDLCSYKEFFFNETFQFLFWTMFGMEEHSVVDVPQFLVPEFAGRALYGIFTIIMVIVLLNMLIAMITNSFQKIEDDADVEWTFARSKLYLFYF

SEQ ID NO: 923125 - protein, 234 aa, Homo sapiens
MWRLTERRRKAHRMLKLYNGLSKGEAVGLPAGPDPLDSTDLNGAHFDPELYLDKLPRECPLAQLIDSETDMVPQIRALDSDMQTLVYENYDKFIPATEIDKQCKTTSQCQVYKCVQNWWVLGLTDFKNEAADPPGVKLQTFTCGATKPTPTQNSSWQASSTRSPGSGSCLFLHTSLQAEGASSNLGQPRKGLPPCSHGLKGPSSATKVGAQAKEAPRVSEGCEGCQRAVTSHKE

SEQ ID NO: 923126 - protein, 160 aa, Homo sapiens
MAKQALSGLRFREFRDLPKVAEQSAELRFDPDLSSCGKILCDGTSSAMVRPKGHRVIQLCVAPEHQFTLPGNTACCLDHTEPDTLSFKHHTGPSPHPSVLHCTYSHSHLLTVCLLLYRSDREISAVVGKITHIELTHHPNQQLTIPLTASDMFKVKVLMT

SEQ ID NO: 923127 - protein, 153 aa, Homo sapiens
MTNCRVMRQILKHDSGCDPGVGAQAPVQMTLRLWHTEGDRTLHWDRDSSLCELKQKRRGLNCRGPSPLWQVNRYNTRVGVKDCEEKAHGQQNAQGKGTILHPHMCPQRRKPENQPDRWLLKQFKRDMMIYYNGGGEQIEITFVKILLGGQIST

SEQ ID NO: 923128 - protein, 142 aa, Homo sapiens
MTMGFRQGERMTTSLTNCVTFKPTSIKPKWQEYPSYLALSQGCCEDEMIGIVEKLSNSCSLKTSLMVLDAVTELDCLARIDIIKSLNSRGHAKLLTSRSKDPSLCPNAIHQQSLNKACATLNKGRGKGMERGSNLHNVTDST

SEQ ID NO: 923129 - protein, 151 aa, Homo sapiens
MHLAPKDMGSNGEAYECCHRNEVTISFIPEVSETTNPLGGTNNPDAPPLRVVTLTVKVCGFTPEVSETTDPPEGGNSRHVRTSEGTNSGHTIFKNCNTHREVLDLPDQMPQGNPMFHFSTKRSMICTCDQIRRQMCRYLPYPNIKLVLKCG

SEQ ID NO: 923130 - protein, 184 aa, Homo sapiens
MTSSFKAGHCSVNLKILNVICKARGSSCLNSEESACARILNNAESGRQQAPRNLRPETAGWYSRTKPPGLPWYPYSPRLLAHPSTRSAPLGSGRKPAPMVTGFTSSQYQTNPCGPTLQASPCGFTFQACSSRLSVWAYPSSPWCEASSHDQGSKFTPTDLRNKTGFMVSRITSPSIGFGHDRIM

SEQ ID NO: 923131 - protein, 144 aa, Homo sapiens
MKMSQIALAIWSYPWCNTCQKFLQGNYAALSSSRSFSPKFPQNNLDIFHTLQFHLTGPWTSCESINKSFKRKSSYNLVRGGMGKEDLERLFAFCSAEEVQEEGITHSLVLVCRKMRTPRNCWSHKYGLGHVVQKPVWAPAKTPK

SEQ ID NO: 923132 - protein, 151 aa, Homo sapiens
MLPGAALPKTMRTHLLYQFWKLPSHALFNNNNRGRCCFKIIRGSNRNLVDVGHCFGVVCGMGQRGIVFTLKEKNEYSILDDEENGCLKGLVINKVERHLEEYREPWRMSTHSCFSLQLPLNQTFWASCGFGFCLTTLWEDPPANTNWELTK

SEQ ID NO: 923133 - protein, 171 aa, Homo sapiens
MRCPAPPQDAGECPHWQEGPHQIYCKKIFKFIVHYQFPKEDEQVLHSISKCCKAFLSDKGILLTSLPQLSSSSLKHIQTVQLEHCNSESSYRDLYGDHSTRVNVHQMTTYHMAEEHMNLGYRRIVIPQKEKALFSWEHRQTQRLQKLSTPSEQFLSLLRAYNSKGVRVREP

SEQ ID NO: 923134 - protein, 146 aa, Homo sapiens
MDPLLQVYCTLLDAHFRLCLPEYHQWRLQNSKDCCVLLPLEASSQRSTSLMAAGALLYEVSVHPCWEFSPSQEAQGCDANRRCHKPDALSQGDESFVCKHVTRAAGFPAEILCPHETERKEFSCGLRHKFDGDFQGIQKLEATTEL

SEQ ID NO: 923135 - protein, 136 aa, Homo sapiens
MASVNCHGPGPPSEVVEEEEETFECRFRKPVDSEYRKKAIFYFLRKGYTRQQFCHERSFFSIGSCHSSNYNGGGDRNGKPCDGNISDNMRSYNRDTKPRFRDSEKDFSKEVTPGLTLRMSKSPPAEHSSESLEGSR

SEQ ID NO: 923136 - protein, 142 aa, Homo sapiens
MEWRPVNTGEELLHVSFQQSTKVTHCFQLIIPKPSPAAYTKLTLMASCTIYTYHLIIPGVLCGSHQQLSLSCSCVIQEGSWRWSDLPWTVHLPGLQREFDEGEESGLRPVRRKEGSLNYYKPVMFLEFSSNFIKEGETDIVT

SEQ ID NO: 923137 - protein, 147 aa, Homo sapiens
MPRPASARARCAHTLACAHCLALPSEMNPKSSVDDYCVRTDETLSFPQKPRLKVLGEEGIPACGFSFFENLYCSWSSLKGKGLNLGVKVVVRIYRHLFSHASACFLFLEKKPRVTVGDVVAESELELGLLTLTLRLLSLLRVKAFGV

SEQ ID NO: 923138 - protein, 357 aa, Homo sapiens
MQPKAATTLPRERGECEAAALAGSGPGEFAGSLALQGQRELGVHLEWPTDLAINPMDNSLYVLDNNVVLQISENHQVRIVAGRPMHCQVPGIDHFLLSKVAIHATLESATALAVSHNGVLYIAETDEKKINRIRQVTTSGEISLVAGAPSGCDCKNDANCDCFSGDDGYAKDAKLNTPSSLAVCADGELYVADLGNIRIRFIRKNKPFLNTQNMYELSSPIDQELYLFDTTGKHLYTQSLPTGDYLYNFTYTGDGDITLITDNNGNMVNVRRDSTGMPLWLVVPDGQVYWVTMGTNSALKSVTTQGHELAMMTYHGNSGLLATKSNENGWTTFYDGGLLKRCDQRTRSSAYYNPSNN

SEQ ID NO: 923139 - protein, 411 aa, Homo sapiens
MSLGQRAQQAMTVQCHACGAVEPREEAGILTGFDLVTNGGISIILRFERAPFITQEHTLWLPWDRFFVMETIIMRHEENEIPSCDLSNFARPNPVVSPSPLTSFASSCAEKGPIVPEIQSSHKASEETEIQRVHGATPSSLHSALQEEISISGCKMRLSYLSSRTPGYKSVLRISLTHPTIPFNLMKVHLMVAVEGRLFRKWFAAAPDLSYYFIWDKTDVYNQKVFGLSEAFDLSVTGQDLKECELKDLNVENPTITMRLQNQRALKSAVLAFSVGYEYESCPDLILWEKRTTVLQGYEIDASKLGGWSLDKHHALNIQSGILHKGNGENQFVSQQPPVIGSIMGNGRRRSISCPSCNGLADGNKLLAPVALTCGSDGSLYVGDFNYIRRIFPSGNVTNILELRNKDFRHR

SEQ ID NO: 923140 - protein, 145 aa, Homo sapiens
MRRQNRKQLQGIISTIAFISHIRKRGLQPAEELLMAVSVTERSRPVFLNQDTEKVGKSVDNCPSNCYGNGDCISGTCHCFLGFLGPDCGRGAECDVPTNQCIDVACSNHGTCITGTCICNPGYKGESCEEDELASHSTPELQCYL

SEQ ID NO: 923141 - protein, 124 aa, Homo sapiens
MGPIPLSPQVQDSWTSQGRASLQNLGLAARESVYCFQLSRLVEKKAHWKEVEVGVEKACIWYLLQMWPDNESPVSQVLLYSCVLRVRSPSDTSTTKRAQSDTGVLTVREKITARERESAETSKA

SEQ ID NO: 923142 - protein, 184 aa, Homo sapiens [sequence omitted]

SEQ ID NO: 923143 - protein, 139 aa, Homo sapiens
MDGERTNKVTEEINECYNLEAGAEEVSPGQVEDVEREGVTVHAEAQEPEHDCISCQPDQVNDEDQHYEDQDLHATTMRMGLLCITNWCNFCIQGWDGWIHAQKPYVDCGLKHYSVLGRKLSLRCRNSDRQRGGCDTLMI

SEQ ID NO: 923144 - protein, 146 aa, Homo sapiens
MPHPASGQTWSPKLIVDSLHEKKIISFNGCMAQAYEEHIFGATEIILLTVMACDNYVAICKPLHYTTIMSHSLCILLVVVAWIGGFLHANIQILFTVWLPFCGPNVIDHFMCDLCPLLKLVCLDTHTLGLFVAANSGFICLLNFLL

SEQ ID NO: 923145 - protein, 267 aa, Homo sapiens
MVDNLIIVVTITTSPALDSPVYFFLSFFSFIDGCSSSTMAPKMIFDLLTEKKTISFSGCMTQLFVEHFFGGVEIILLVVMAYDCYVAICKPLYYLITMNRQVCGLLVAMAWVGGFLHALIQMLLIVWLPFCGPNVIDHFICDLFPLLKLSCTDTHVFGLFVAANSGLMCMLIFSILITSYVLILCSQRKALSTCAFHITVVVLFFVPCILVYLRPMITFPIDKAVSVFYTVVTPMLNPLIYTLRNTEVKNAMKQLWSQIIWGNNLCD

SEQ ID NO: 923146 - protein, 134 aa, Homo sapiens
MSQPMCGFLMVVAGILGFVHGGIQTLFIAQLPFCGPNVINHFMCDLVPLLELACTDTHTLGPLIAANSGSLCFLIFSMLVASYVIILCFLRTHSSEGRRKALSNASKGKESTENKTAEKEITRDVEISLYHETG

SEQ ID NO: 923147 - protein, 262 aa, Homo sapiens
MLIVVTITSSPTLASPVYFFLANLSFIDTFYSSSMAPKLIADSLYEGRTISYECCMAQLFGAHFLGGVEIILLTVMAYDRYVAICKPLHNTTIMTRHLCAMLVGVAWLGGFLHSLVQLLLVLWLPFCGPNVINHFACDLYPLLEVACTNTYVIGLLVVANSGLICLLNFLMLAASYIVILYSLRSHSADGRCKALSTCGAHFIVVALFFVPCIFTYVHPFSTLPIDKNMALFYGILTPMLNPLIYTLRNEEVKNAMRKLFTW

SEQ ID NO: 923148 - protein, 240 aa, Homo sapiens
MGLRKIFAPPTAPVKSGEQERENENWLVPSSVATERLTLALAFVDCKHALAPVRCAEDLGGFLGACQDVGTELHCSAVLARAMANLVADRSKGSQGSSPKVGKCYKCRKIGRFGKEHRQTSGQKGFYNAVPPQEKKMPGLCPRTPGNRIRSPREQITLIERNKLTKIPIGIWGPLPTGYIGFISGKGHVNLEGITVILGVDFDCEGEIRVVVMSQNPWVFETGECIPQLLLIPCKLHLSL

SEQ ID NO: 923149 - protein, 137 aa, Homo sapiens
MTVYKCHGKIRKTLPWGLDWDRFLVTGPPSSRLQNGRSNSSLHPALGKATGTQLQPVKAAQGAEPCKATGQSCPRPSEPTLVPVCPGCRTQKSKEIKILWLPFWVSDLHGAYCPFLLANFSLLGCKCLPDVSTSVVS

SEQ ID NO: 923150 - protein, 150 aa, Homo sapiens
MPFFSLFLILASCLHPLCTSPRDPASALGCNIPPAKGSSENLQLVPSIGLFVPGSKCFGINAGMVNSLPHAFTASIQPPIPWWLKKGTPGLDRDNEMEIDWRFGRQVFERRRRKCEGHMLELTMLCPRNQEEASPIPFTSETPVESITTT

SEQ ID NO: 923151 - protein, 148 aa, Homo sapiens
MSYLGSIDGASALSAFLEQGSLWMPLFGSGSSEVPDKKEARWEKELTQNWCEVPFPCSESTLTALLSAGEVTLMGTQVGAEGCKRMKLAVLDFWQYLEAFLVVTTGEGATGIYCILTRQEGKFLPSEECMRPLYKGLNHTHEGGALVT

SEQ ID NO: 923152 - protein, 121 aa, Homo sapiens
MYGFYCVEDFKYRQLLNECSHYPRKQRLEDGKIQQNVEDYGVGILTPPLTFCADLTSAASSVKGLLLPPKPCWASGLAPVLPSAAVLGAEWEDDPGKLLPVKVPGSPCQGCCVIIFNSTNI

SEQ ID NO: 923153 - protein, 178 aa, Homo sapiens
MILFAFHNHMMKISTIFPFADGLPSSVLFPGHTAAPSWVRVRPRLLKTKQRTAVCLLHVALSNLPQPLSPAYFYHILPCSLGPCPWTEAQLPECAVLVHTSGPLPVQLCLYLLTHLLNSCSSSKTQLKSLLIHPLRAELIAPSFEPASHFEQLYWSTYHGVLKLFIPVSVSPRRLGTS

SEQ ID NO: 923154 - protein, 185 aa, Homo sapiens
MDLESTGVPCPGSCSLWKAAGAGMPNGLNELLGDSLSLVNAEPTLTVRPNPTANNRAALGGSGLPVPGTGSGRGGCRCGSSARSAKLLCLGGRGHWATCSRGCPQAGLPGFLTARLAGNDAALWHSEKPPTHWFSSQPAPTAHRNLQPPSLPQLSLCGPHYPTFCRAQLPYPLYRLSGAMVPMLP

SEQ ID NO: 923155 - protein, 142 aa, Homo sapiens [sequence omitted]

SEQ ID NO: 923156 - protein, 207 aa, Homo sapiens
MVCAFVSRQIGSKRGHPLLAAPWSPSRVWGPFLSTLETWGTAGRPDATDGSAAAGTLLVGVCEAHSGCPGAAPAPPSLRQQAKQTALSSGCCSPGSIRAPAAAQLGSRHSPGQEAPAGGLRGGLEDTRSEALFSDMGQQLRTVAGGSLMRLRVRKIGDANHLHREHKAHQMLPRLRGLASHWCWPTLASTRQSPGGLGRSPPRGKFP

SEQ ID NO: 923157 - protein, 129 aa, Homo sapiens
MQLFIHTFLLPQKLGEKNHRGQVSSPADVLILSALCDAWHTVGAQSTFVGSNVLEGAKSKERTCILFVPNRVQRRQWTDSIWIRAVCPGEPKQLLKTCAKAFDEFKLPALSSIKLRWDFDRGCFESGEN

SEQ ID NO: 923158 - protein, 119 aa, Homo sapiens
MCTVGGAVKQPPALAAEWIPNPHRTAKERVTGCLVKVEFQEVLLEPRVKSAPWVTHSTALNDFPLLDSPESTVGAHLHLVCFTPVSFSRSILEYKLPERRNWVYKSLCKRSEYLNGVGK

SEQ ID NO: 923159 - protein, 217 aa, Homo sapiens
MSTLHDAEVWENYANRNESQIRKIKFAFDVIKIPYQEPSNQGFFNLGTIDIWSWIIICFNVKTEVKSIEMHHEAPSEDLPGDNVGFNVKNMPVEDVHCGNVAGDSKNDPPVETAGLTAQVIILNQPGQISAHCESVLDCHTTQIACKVAELKEKIDCNSGKKLEDDPKLLNADDAAILYMTVAMGVIKAVDKARSSKVSSKQWTRRQGIAKELARYE

SEQ ID NO: 923160 - protein, 154 aa, Homo sapiens
MSPVWQPLRSYIPAWAPWRYKFTIMKTNINIRYQSRDSTLEGPQNNPVIYEDFFYPNDTQSQKLAFHCLGLQIRDRFRISAQRRGLDPLAEPVQWGPTRPTRPNLDPTNEGTMIRPSYSTIHWGPGIQKQGNHIPSFCPDLTINSAPLNHKKML

SEQ ID NO: 923161 - protein, 139 aa, Homo sapiens
MPGTMPAASQLASRIQLFTPASKWEGLLFKKNSLKKLSRKPQEKPNYPGLLNSSPSTICSPKQMPLHSASELRLCSPEEMSAGKKPAQASEDIASPVTVDLIVSVIAICPDSFHQLRQSSFAFRVNLCEGDSGSGLPVD

SEQ ID NO: 923162 - protein, 144 aa, Homo sapiens
MPEPPPNPHSGLLSRPSLPKERSSLLHGPGPIYRPKAEECQCTAQDWQAAPSVAPVQDPLGEASWAPEFTPEPARPRTHQKEETLNTCEHQKEQTPDTLLLRTVTLTAGVRGFILEVSETKKPPIPDTIVIEINHKGRAHYFYY

SEQ ID NO: 923163 - protein, 152 aa, Homo sapiens
MYYVPKEKLISYASVSGQNRAKVDSKGVTSEGSVEIAALEEAVVSTEEMLSEHAIAPDVRSRNRAGVCTLIPSLYFQPFPNASPDVFSWQLPITVAQSKWRAHCTLVHKLEMNKAVKYDDIPQQWKDSGFNPGPFHSKEVSAFAKAKKLHWL

SEQ ID NO: 923164 - protein, 143 aa, Homo sapiens
MPAVTDDDDDDDNDDDDNDDSRAPPFFNFRGCMKKSRQKPAAGAEPSWRTSTTAERKCGVGPPHRVLTEALSSGAVRRGPLFSRPWNGRFAGCFHPVPRKATSTQCKHSRAAVGAELCKATGTKLPKALGVHPLHQYALDMGH

SEQ ID NO: 923165 - protein, 154 aa, Homo sapiens
MLLNPFQSSAAYQKLTLNVNTWHTDVGKDKNNIGKYNSLTQREKRDQTNKKGCDTYWYIFVDYNNKPKKKLKINEKEKHQARKKVKHRSKRTTFRRLFVIISEKVTVIWTREVMILGSILDFESRNNRICWSIEYLDGIRERRFLRGFGSGKME

SEQ ID NO: 923166 - protein, 154 aa, Homo sapiens
MLDKPFKIMRDAHGAPPVLVFSPSTQQGHCSDLTRDWLLRFSVLLLSDLIGGRGWSPIKQRKGPREGHNWRNWLFYKGFDWNGMLTGFLKNPVLSKGPQEKRNLPNSQADLEYSCEVISDLWLLLKRNKKDGNDIPAQVSADSVLAVYLETLQR

SEQ ID NO: 923167 - protein, 138 aa, Homo sapiens
MPKTVKLRSGNVCILLRNIEPLEASNDGGRRRGNLRITWQKQEQERGEEVPHTFKRPDLMKTHYFRVYPQFGLPHDQTPVTHFRQEQHESDVMSSIHYIRSHIMSICPITDGPKCMQVPFQHSLSSFPGAAAALEQIC

SEQ ID NO: 923168 - protein, 137 aa, Homo sapiens
MAKELMPLGYSKKMGDILSSVILSHTVSQCEIQGLGGSRCSSVSWIPQEEIAWQEDCPHSTKDSATITFISAAKAFPKTTNFPATMLWYPKRGKQPQMALVSTNATRAKSRMHVEDGESDFQSIIHNIVRTKTRFIQ

SEQ ID NO: 923169 - protein, 144 aa, Homo sapiens
MACGIASLCSPLNFSGELCLEMHILSQVLSSEPSFLLPPSGSQSHLQKNSSLLALQDVERQSPPNSSRFTGGFHVGHLLLISQPVVSLTACQIPQVPWIQNQIHSLTLHQFLFRLVFSFPSLSTHSVINTYIYEERERGRLIDF

SEQ ID NO: 923170 - protein, 178 aa, Homo sapiens
MRLVVGVGEIWGRAHSCSPFCASVKAVLFSTFSEVLFLHLLGLPLLLGTGRGLRFSQGPICTAWGLLASSSRSAVASNDSFHIGTPSVCLAAIGTWITLCDKEMGALSYLAGKRQSMASNFGLAGSKVPSPSSIPNTVMIVLETGPLPKPASSSWCQEGPTPFWARQCVGPASGRPGW

SEQ ID NO: 923171 - protein, 143 aa, Homo sapiens
MQDHYHHQLSQLEPTDSQAHSQWGLSNNSIVHGLEKAHGERCPPGLAQVRDKSEATSGADPGSYPGAHEGPASCLHIYSSGALWCYQEAAGKRRRPESVPGQCFLHSCSFLTLKNGLHDPQNGLLVVTFGRAHADFLKNLLES

SEQ ID NO: 923172 - protein, 133 aa, Homo sapiens
MGRDAKASGSVAFCIHFSGFQIGGNLEADVRREGVRPAFTVQPWPTLRDEGVGSFFLTGLVPLASVGVTLEPSEQLMAAILKTADVIQQLTLLYTCTLQRHTGLRLACRLSSEEFLMSTAQKTRCSEDSCHQC

SEQ ID NO: 923173 - protein, 144 aa, Homo sapiens
MGFFGIMGQDGMSQSNEGPYRSGAQWIKLLAQRHLQCHLGGYGKTTAVIVEIGHWSLQKASWKGHSLAGGADSQGLGWSIPCPPAHNTHTQAIARPSLVDLIACLMAPPLASYESDLGGCLWSEISGSPRSHSVPKEFCLAVGI

SEQ ID NO: 923174 - protein, 228 aa, Homo sapiens
MGMIYKCQQGSLLAAAMFMNEQTSGASGKQEMQGLVGVMTPQIRMILHQNKNTVTYMRSLGDCCLVVINERFPINLGCSKQLYAWERECMRIFQRAFSLETENINGSGGKKIKVTEYGNHHFGVYENHILLTPCYAMGLSEVMRQVPECQMSALLYTYVCSCPGPPAGWQLEIGHSRSIYTTEIGKHYEVGLPPTLHRELVVKHLPACHLLQGKKKFLYALVLTAANN

SEQ ID NO: 923175 - protein, 135 aa, Homo sapiens
MTGGHPFPSPSAAREDQRVGCSLPPRRFSCCLLRFNSPCKGGPGPNICFIKGVGVLETQKLLSVAPFYGLYRSQRGRPPADSVQGHRTLRAFPFSILFLLHSSQGLESLEPKDWDLNPSSDMGQFTPQFSSIESE

SEQ ID NO: 923176 - protein, 156 aa, Homo sapiens
MGLDTEKETDGEDPENISDMVSSLRDALTLTASSYLEPEKAQGQKVLKPGPLAKQANQVTQVTLPGSCQSDGDRDPVGSSPGNRVGTPKQKRRGQSNLKTGHRQGGLLETLPKGPPTAFLCFRDRGAQQLRKQSWGSGLSQWVHQTGESRQLLKLE

SEQ ID NO: 923177 - protein, 157 aa, Homo sapiens
MVTCYAKQTQSLPLECKQRASERSHPTETRSRNKKASRCRGRRRSSICTMGRGQRPSHTHPLPDGETSQHNSNRIVTPVPSSTYPFYRAVVLNPKPQGAILLPRGYLAMSGAIFGCHNWGQGMCQWHLVGRVQGCAKCSTVHATALHNHELSGSKCQ

SEQ ID NO: 923178 - protein, 124 aa, Homo sapiens
MNIKRGKFLDHTCKVSLAHIYLGIWGSYLQRQLICMDESHGYCSLIMMVVCFTTNMCLMAVWFNTEVAHIIGEGVRFQCEGHIKDISELYSFVSNIRYFFREADNSFQILEEYLNVVCYSQCNS

SEQ ID NO: 923179 - protein, 137 aa, Homo sapiens
MLERGGILDFPLIVAGWILKKETEAIDGGNGKVARTGEKEDRFRRIKYVGEWDSGVLGAEPLQRVPTRAMPSGAPGVGPSRPQNYRATSVQYQPEKVTGIKLQLVVRGLLEANLAPLEGVRVWEEQVRSGELPHFGQ

SEQ ID NO: 923180 - protein, 116 aa, Homo sapiens
MLERGGILDFPLIVAGWILKKETEAIDGGNGKVARTGEKEDRFRRIKYVGEWDSGVLAINEEFFFTCRAFIHFNNLFMLFPLFAIILSDEFVCEQRHLKRKKGIGEKTDMLKLLFA

SEQ ID NO: 923181 - protein, 149 aa, Homo sapiens
MIVRPPQPHGTLKIAFTIFRGLYTIQQMYWVLTVSVKAHRDWHREGYQPQHEEGDHQDRKNGLPSIPCPTILPLPLSGFSWCDREKHPIHSPSIPQMTSKFPSLLPMDSDTKDASFIQRLTCFRVARWLQQFQASHLCSQKAGKSYGNG

SEQ ID NO: 923182 - protein, 123 aa, Homo sapiens
MYRSFSEGREREEASSTCLTTYYCLSSFAANEGDADLNNVNQGSTCISPTGPHLEHICKVEQTKQKSGPEPGREAASSRDVSPAPSTDKAYRGAQCKGQMLYTSLWQSSQCSFDGTINNPFIT

SEQ ID NO: 923183 - protein, 139 aa, Homo sapiens
MQTVFDAHPPLVVAAAQHVPLAKEKAHKEAELCGCLGGDSPACRKGSATIAAEHQDGPENLRRTATMPAVVTLSQSKAHVMGWQEPRALPRRLTCQKENEVEKHEKQDRQRSHREQSLAVTPTVSSSRPQEPTRHSHQM

SEQ ID NO: 923184 - protein, 140 aa, Homo sapiens
MCIIQPPQTLPQNCKQQRNIFITISYSTNDNSRFSGLWYPQLYQWPAEFSGLRPQTESSIITFLVLKHSDLDLATLLAFLVLQLADDLSMDFSIFIILSLTNTIGNDFTTVELDTTEVYVYPIKQNKTIWFYSNQAKYRL

SEQ ID NO: 923185 - protein, 178 aa, Homo sapiens
MGAHLLHHCDPDLVEFCGSETTWLPGFSPLPMGVDESPASQKFPEPEDASTPGSQSLPKQPPTCTAAKNLPSSVLETQGPGGMGLRGDFLTNWLQGSMGKVWFFMERTRKIKEVMVLHCDFQCTLLKEYGFHKSWSKEVGPDLKQRVLDLQPVYSLFARSSPSAQISRNHIPKIALLR

SEQ ID NO: 923186 - protein, 153 aa, Homo sapiens
MFKALNQNIVLLRSPPRNQRGQNPPYCKWRKLPKSPPRPPSLQALSGLKAGIHRGTWLSPVSIKATWQIAENEAGFISREEPQLTHLLDKNGCQDPFNNYCHQHTNSLSPIHSRWFSPSGNSNVSRGTGLERVSYKDLHTGGINSNMPEYVGS

SEQ ID NO: 923187 - protein, 184 aa, Homo sapiens
MAEGLRVPGKPLVKVQDSKGQKPWGLMSKGGRNGLKHPVFQAMELPQQKPPQGDKPCLFWASPVEGGIPGSWSSLWTHEPHPCQCTEGTHKSLGALVGRSIAVGNRILRDPKPVGLCGGLSSGSVHTPGSSPCGSVDQRVHEGSSMPRIAKFLGRSVSPQGHSLTHPFPTAGSPPLPRALCQYL

SEQ ID NO: 923188 - protein, 139 aa, Homo sapiens
MRKHLDNSSSSKRRSKRPSRVRLKKSASKPKELAELTASPRKWGQVNAHCQEFLLQHFQNSQEVTDETGSQNLLWLPDVTSALAVLSCHMPKIKTLPMLFLSKALWSSYFGCKRRQMQQCIYRGLRTKTLLKILFRDHK

SEQ ID NO: 923189 - protein, 138 aa, Homo sapiens
MSMFSFVTAQVRMLDAQKSKRGKRQEITKIRAELKETETQKTLQKISGSRSWFFEMINKIDRPLATLIKKKREKNQIDAIKNDKGDITTDTTKVQTTIREYYKHLYANKLENLEEKDKLLDTYTLPRKHFYVGTAKTG

SEQ ID NO: 923190 - protein, 166 aa, Homo sapiens
MQAVCGSTILGSGGQQALPTLPQGSASVKTPCGASYSVYPFGTALVEILSCGEASGDFYSWYKDLVPCVPAMAKTSQGTAQAIISEDTSPKPWQLTNSVGPVGTQKSKIEGSSEGKCEVGAPTQSPTGALPSGAVRRGPPSSRPQNFRSTDNTMHLKKPQILKASL

SEQ ID NO: 923191 - protein, 163 aa, Homo sapiens
MLNRAHRVHVCKKGGKKFFFPGARGRFTILLVIKTDSSLYQPMFYFLAMLATIDLGLSTATIPKMLGIFWFSLREIICDACLIQMFFIHNFTGMESAALVGMAYDHFVAICNPLRYSIILTKKAVSVIGLGVLEGSRRKTLTDDSDGNKTTKINNFKGRMMRA

SEQ ID NO: 923192 - protein, 324 aa, Homo sapiens
MHGTASEFHPSSFLLLGIPGLETLHIWIGFPFCAVYMIALIGNFTILLVIKTDSSLHQPMFYFLAMLATTDVGLSTATIPKMLGIFWINLRGIIFEACLTQMFFIHNFTLMESAVLVAMAYDSYVAICNPLQYSAILTNKVVSVIGLGVFVRALIFVIPSILLILRLPFCGNHVIPHTYCEHMGLAHLSCASIKINIIYGLCAICNLVFDITVIALSYVHILCAVFRLPTHEARLKSLSTCGSHVCVILAFYTPALFSFMTHCFGRNVPRYIHILLANLYVVVPPMLNPVIYGVRTKQIYKCVKKILLQEQGMEKEEYLIHTRF

SEQ ID NO: 923193 - protein, 418 aa, Homo sapiens
MLQMKTLHKASTLWKHRENNYTDCTQPILQLKGHLHTEMGKNQFIKAEQTLREPMFYFLAILSTIDLALSTTSVPRTLGIFWFDAHEINFGACVAQMFLIHAFTGMEAEVLVAMAFDLTFFLIGIPGLEDFHMWISGPFCSVYLVALLGNATILLVIKVEQTLREPMFYFLAILSTIDLALSATSVPRMLGIFWFDAHEINYGACVAQMFLIHAFTGMEAEVLLAMAFDRYVAICAPLHYATILTSLVLVGISMCIVIRPVLLTLPMVYLIYRLPFCQAHIIAHSYCEHMGIAKLSCGNIRINGIYGLFVVSFFVLNLVLIGISYVYILRAVFRLPSHDAQLKALSTCGAHVGVICVFYIPSVFSFLTHRFGHQIPGYIHILVANLYLIIPPSLNPIIYGNTPHAFTLQHLNKTSLLT

SEQ ID NO: 923194 - protein, 321 aa, Homo sapiens
MTILLNSSLQRATFFLTGFQGLEGLHGWISIPFCFIYLTVILGNLTILHVICTDATLHGPMYYFLGMLAVTDLGLCLSTLPTVLGIFWFDTREIGIPACFTQLFFIHTLSSMESSVLLSMSIDRYVAVCNPLHDSTVLTPACIVKMGLSSVLRSALLILPLPFLLKRFQYCHSHVLAHAYCLHLEIMKLACSSIIVNHIYGLFVVACTVGVDSLLIFLSYALILRTVLSIASHQERLRALNTCVSHICAVLLFYIPMIGLSLVHRFGEHLPRVVHLFMSYVYLLVPPLMNPIIYSIKTKQIRQRIIKKFQFIKSLRCFWKD

SEQ ID NO: 923195 - protein, 345 aa, Homo sapiens
MPPLLECNHQYCLNLLQDFGGHPPSPLSPHTMTLGSLGNSSSSVSATFLLSGIPGLERMHIWISIPLCFMYLVSIPGNCTILFIIKTERSLHEPMYLFLSMLALIDLGLSLCTLPTVLGIFWVGAREISHDACFAQLFFIHCFSFLESSVLLSMAFDRFVAICHPLHYVSILTNTVIGRIGLVSLGRSVALIFPLPFMLKRFPYCGSPVLSHSYCLHQEVMKLACADMKANSIYGMFVIVSTVGIDSLLILFSYALILRTVLSIASRAERFKALNTCVSHICAVLLFYTPMIGLSVIHRFGKQAPHLVQVVMGFMYLLFPPVMNPIVYSVKTKQIRDRVTHAFCY

SEQ ID NO: 923196 - protein, 637 aa, Homo sapiens
MLAATDLSLSLSSMPTMVSVHWFNWRSITFNGCLIQMFFIHTFGGVESGVLVAMAFDRFVAIRFPLHYATILTHSVISKIAAAILLRSVGAVLPVPFLIKRLPFCHSNVLSHAYCLHQDAMRLACADTGVNSIYGLLAVIFIIVLDALILLASYILILQAVLSIASQEDRLKALNTFQCLQPTMAIFNNTTSSSSNFLLTAFPGLECAHVWISIPVCCLYTIALLGNSMIFLVIITKRRLHKPMYYFLSMLAAVDLCLTITTLPTVLGVLWFHAREISFKACFIQMFFVHAFSLLESSVLVAMAFDRFVAICNPLNYATILTDRMVLVIGLVICIRPAVFLLPLLVAINTVSFHGGHELSHPFCYHPEVIKYTYSKPWISSFWGLFLQLYLNGTDVLFILFSYVLILRTVLGIVARKKQQKALSTCVCHICAVTIFYVPLISLSLAHRLFHSTPRVLCSTLANIYLLLPPVLNPIIYSLKTKTIRQAMFQLLQSKGSWGFNELTEHLVLDTMKLACSDNKTNVIYGFFIALCTMLDLALIVLSYVLILKTILSIASLAERLKALNTCVSHICAVLTFYVPIITLAAMHHFAKHKSPLVVILIADMFLLVPPLMNPIVYCVKTRQIWEKILGKLLNGL

SEQ ID NO: 923197 - protein, 697 aa, Homo sapiens
MQMFFIHVFGIVESGVLVSMAFDRFVAIRNPLHYVSILTHDVIRKTGIAVLTRAVCVVFPVPFLIKCLPFCHSNVLSHSYCLHQNMMRLACASTRINSLYGLIVVIFTLGLDVLLTLLSYVLTLKTVLGIVSRGERLKTLSTCLSHMSTVLLFYVPFMGAASMIHRFWEHLSPPELCVKSSPSLLVDTLPQRGPEPQGSGVAGPPYFLATKIAVLTDRAPNHGSCLTSAPSWWTLPLIAVYLLSALGNGTILWIIALQPALHRPMHFFLFLLSVSDIGLVTALMPTLLGIALAGAHTVPASACLLQMVFIHVFSVMESSVLLAMSIDRALAICRPLHYPALLTNGVISKISLAISFRCLGLHLPLPFLLAYMPYCLPQVLTHSYCLHPDVARLACPEAWGAAYSLFVVLSAMGLDPLLIFFSYGLIGKVLQGVESREDRWKAGQTCAAHLSAVLLFYIPMILLALINHPELPITQHTHTLLSYVHFLLPPLINPILYSVKMKEIRKRILNRLQPRKVGGAQPWGSTICSWQSQPGLCPFLQEEVYLVFYYTAAELALTSQDTDLPTLPPLFKGKGPSSCSHLPLLAMRSTARKPQMFLSVGSPLAQGSSRNAIQESNPGMGDPKNLLYTPVVVLVPTVQEKVLLLFPQAEGVSPHSQHSWTALSLMHQNFISDTSVSALPSPSTQRHSLHHTAIAIA

SEQ ID NO: 923198 - protein, 210 aa, Homo sapiens [sequence omitted]

SEQ ID NO: 923199 - protein, 138 aa, Homo sapiens
MHASLMCRLALSRTVLLIRPPSPSTGKNDLTNSRGKPIWLWIAQVFPFLRKSQLNIRVFPNFTLSALATSFCIISRVIRPLWGDQRSQGYAGVPKAVLQHRQTFLQQFTPTQLQIAEDSVPLRVLGSFIFLHFYNKRR

SEQ ID NO: 923200 - protein, 136 aa, Homo sapiens
MGTIGEVLVQWEGLACNVNYMEEVTLTTQCSLEKGWDQNEETEQKKHHFYSFSPVLPHADAAEEDLPTCTTQRKKKFAREKGKERSSCGMNVDDVAMDGLMRRHGIHVALLSIHGQAAEINHPSYSPYIAKCAHGS

SEQ ID NO: 923201 - protein, 146 aa, Homo sapiens
MGKKQSRKTGNSKKQSTSPPPKEHSSSPATEQSWRENDFDELREEGFRRSNNSELQEEIQTNGKEVRNLEKKLDEWITRITNAERATPRHIIVRFTKVEMKEKMLRAAREKGRVTHKGKSIRLTADLLAETLQARREWGPTFNILK

SEQ ID NO: 923202 - protein, 231 aa, Homo sapiens
MGTCLKCYQGYGQAASSALMLTALMRLQQMKYKCKRKSVKAGPLSDCIEVGRPNRGIMSDRREEMTVVAFSDPVEKASTHPVKVSTRTNRPGGTAINKPNVIRARNREEGNMGKWGECQVDQRDTVIGVRCGIQNNVGGRIEVRARNNGNCGRLNKEAMAATARRHDGQPKTVRSSCLDKKATGRGPSPCVRIPTAQPCTSAVCNEKGWDESGRASVGAVSKAVFKERKEE

SEQ ID NO: 923203 - protein, 174 aa, Homo sapiens
MGECMLSDYFSPSEKKPDAAGSPSYACNYAEECSTHLGVTSPRRAVLLLNKIVLCLPHSSRQCDLILLGRGTRTRHPLSVGTKKAVTSWLSALRWWGQLPHTMEAGHGHPCLGVTAFPLPGHESPPREWLATRLVQPQALHGACLCECTWNGGLDPTLTYSHIPSHRELSRLLQ

SEQ ID NO: 923204 - protein, 163 aa, Homo sapiens
MNSDISIFHFIVCIFQENRCVIFPTLCPGISRISSFQWVLGLADFKNETTDPHASLLTGSSILDCCASSEQGSVGVGPTEPGTGYNLLVCHLLRPLEKRSIMAGVSRFSRASGSQPWPRAFGSQVKNQTTEGSRRTKKGEISVKSPYGQDARQGVRALELGGV

SEQ ID NO: 923205 - protein, 155 aa, Homo sapiens
MVELPRQPLSSTMVELPRQPLSSTMVELIYSPTNSVKAQAPLLQVCWCLLEVHSRPYLPGYHQWRLQNSKDCCLLLPLEASPQRGTRQIPARVRLYEQSLSAVLGDPLLSSQLAAKMPFPERRNLESQSGYSDFAALWWAPPSVNFWQLCLHCEG

SEQ ID NO: 923206 - protein, 136 aa, Homo sapiens
MGIHLLHQHDLDVRGEVKGDCLLNGFDQNANNVIHNEIQVEVFSDGDEELVGIWSKEITKQQSVQEMTWVLLKSLSFKREKEHKSLENLQPDDATEKKNPFSEEKFKPAAEICIRNEDPNVNHQDNGENVSRAFYC

SEQ ID NO: 923207 - protein, 143 aa, Homo sapiens
MDSFSHLLGLEVEKQNGLGGQRLGGWSSGPGAGSCGEGGWEGEGEVVAGHGGPLCAILWNINLSISAEPHSKGFKWISMYGEWDVICLSALKLGKVDPAAVQAFKKQSPIQLSTSLLLPRARSCVGYLAFQGPVYGVLLSRNV

SEQ ID NO: 923208 - protein, 142 aa, Homo sapiens
MVWLCPHSNLILNSHESWEEPDCVYHQMILTKSKSHQVSIGNSYKGQALTITRNSSCLIYVWKRYVTYCLSKAPSGKHPVHSDAIYISANVSKSTYFGRTNVTFPFITVLRGVVQSYRLSHGALIGMGPRLNTLFQRRQIVN

SEQ ID NO: 923209 - protein, 164 aa, Homo sapiens
MEFNGEIANVTRQKVVRSYSLRKNIWEYFEAYGEKAINFSTYLTGSSLAEYFLEDCIRMTHFVPPPKDKKKKDKDDDGGEDDYIPPEQQRKVLDPVPVGVTKVNIKHYNDGIGSDVDIKQMLQVFKELPKKLHHKQTLSSGKGELAEYVPDSAFTSAAKLVLTA

SEQ ID NO: 923210 - protein, 132 aa, Homo sapiens
MKTRKKLSEKLLCVVGINLTEKLRRDIWKHIESYPEKEISSDKNRKKLSEKLLYKNRKKLSEKLLHDVSIHLTELNISLDSSVWKHCFCSVYELTFQFGNTVVYNLERVISDCIEVYGEKRSIFSQKLEENF

SEQ ID NO: 923211 - protein, 155 aa, Homo sapiens
MPSKATAMERDFCKIVEAGAGEGRGHVVAATNAAPSDLHLLVFTLLGSPLPPGTSDTFSGCDTQGESLHDTEKVPHISGGAECKEQYLKLGPCGAVDAPERDLLMGKENSYLAAGSLGDRTLTHLSERSPASDKHPLFFNGKPSGKPGHHQKIAW

SEQ ID NO: 923212 - protein, 134 aa, Homo sapiens
MTQANPRPRASLQCLGPVSPLVAPSDCGGHYTDEYGRIFNYAGPKTECVWIIELNPGEIVTVAIPDLKGFACGKEYVEVLDGPPGSESLDRICKAFSTFYYSSSNIITIKYSREPSHPPTFFEIYYFVDAWSTH

SEQ ID NO: 923213 - protein, 156 aa, Homo sapiens
MSILLLTDMRLQVRPFTSVNHDFLIYELEIETEKGATSPQSCVPGEWEPLLNTWSPRELRGCSILGVRDESLEGTGKNCSVERIQNLDHLPNTGSSDSEKGLAAQETKMEKQGEKEVENFQPTIHILCGMHITIVTQKVGGEGENLLILPFSVEAS

SEQ ID NO: 923214 - protein, 434 aa, Homo sapiens
MEWNNPWTGRQSSSNGIEWNHRMDSNGIIIERNRMESSSDGNEWNHHRMEMKGMEMNGIVIEWNRMDSLNGIRWNHRMDWNGIIEWTRKGSLLNGIEWNHRMVSIGIIIKWNRMESPNRIEWNNHRMDSNGIILQWNRMELSNAIKWNYRMQSNRIIEWTRMESSNGMEWNKTNGIIIEWNRMVSTPNGKKRNYRMESKRIFERTRMESSNGMEWSNPWTRMQSSSNGIEWNHRMDSNGIIIERNRMEASSDGNEWNHHRMEMKGGIEWNQSNGIIIKWNRMESTSNGKKRNYRMESKRIIEWTRMESSNRMEWNNPWTRMQSSSNGIEWNHRMDSNGIIIERNRMESSSDGNEWNHHRMEMKGNRMELSSNGIEWNQYQTEKNGIIEWNRRESSNGPEWNHLMEWNGIIHGLECNHHRMESNGIIECTRMNNH

SEQ ID NO: 923215 - protein, 350 aa, Homo sapiens
MESKRIFERTRMESSNGMEWSNPWTRMQSSSNGIEWNHRMDSNGIIIERNRMESSSDGNEWNHHRMEMKGMEMNGIVIEWNRMDSFNGIRWNHRMDWNGIIEWTRKGSLLNGIEWNHRMVSIGIIIKWNRMESPNRIEWNNHRMDSNGIILQWYRMELSNAIEWNYRMQSNRIIEWTRMESSNGMEWNKTNGIIIEWNRMVSTPNGKKRNYRMESKRIFERTRMESSNGMEWNNPWTRMQSSSNGIEWNHRMDSNGIIIERNRMESSSDGNEWKHHRMEMKGNRMELSSNGIEWNQHQTEKNGIIEWNRRESSNGPEWNHLMEWNGIIDGLECNHHRMESNGIIEWTRME

SEQ ID NO: 923216 - protein, 289 aa, Homo sapiens
MESKRIFERTRMESSNGMEWNNPWTRMQSSSNGIEWNHRMDSNGIIIERNQMESSSDGNEWNHHRMEMKGRIIEWTRMESSNGMEWNNPWTRMQSSSNGIEWNHRMDSNGIIIERNRMESSSDGNERKSNGIIIEWNRMESTPNGKKRNYRMESKRIFERTRMESSNGMEWNNPWTRMQSSSNGIEWNHRMDSNGIIIERNRMESSSDGNEWNHHRMEIKRNRMELSSNGIEWNQHQTEQNGIIEWNRRESSNGPEWNHLMDWNGIIHGLECNHHRMESNGIIKWTRME

SEQ ID NO: 923217 - protein, 169 aa, Homo sapiens
MESKRIFERTRMESSNGMEWNNPWTRIQSSSNGIEWNHRMDSNGIIIERNRMESSLDGNEWNHHRMEMKGESSSNELNAIIEWSRMESSSNGMEWNRRIESNGIIIEWNRMVSTSKGKKRNYRMESKRIIEWTRMESSNGMEWNGIIHGLECNHHRMESNGIIEWTRME

SEQ ID NO: 923218 - protein, 418 aa, Homo sapiens
MEWNNPWTRMQSSSNGIEWNHRMDSNGIIIEQSNGIIIEWNRMESTSNGKKRNYRMESKRIIEWTRMESSNGMEWNNPIEWNNHRMDSNGIILQWNRMELSNAIEWNYRMQSNRIIEWTRMESSNGMEWNKSNGIIIEWNRMVSTPNGKKRNYRMESKRIFERTRMESSNGMEWNNPWTRMQSSSNGIEWNHRMGSNGIIIERNRMESSSDGNEWNHHRMEMKGRIIEWTRMESSNGMEWNNPWTRMQSSSNGIEWNHQMDSNGIIIERNRMESSSDGNERIEWNYHRMESNGINIKRKKTELSNGIEENHRMDRMESSNGMEWNNPWTRMQSSSNGIEWNHRMDSNGIIIERNEWNHHRMEMNGIIIEWNRTELWNEIQCDHHRMDPNGIIIQRKLMESTSNESNGNTIELKRMELP

SEQ ID NO: 923219 - protein, 230 aa, Homo sapiens
MEWNNPWTRMQSSSNGIEWNHRMDSNGIIIERNRMESSSDGNEWNHHRMEMKGNRMELSSNGIQWYQHQTEKNGIIEWNRRESSNGPEWNHLMEWNGIIHGLEGNHHRMESNGIIEWTRMESSSNGKEWNHRIESNGIIIEWNRMVSTPNGKKRNYRMESKRIFERTRMESSNGMEWNNPWTRMQSSSNGIEWNHRMDSNGIIIERNRMESSSDGNEWNHHRMEMKGVII

SEQ ID NO: 923220 - protein, 956 aa, Homo sapiens
MESKRIIEWTRMESSNGMEWNNPWTRMQSSSYKIEWNHRMDSNGIIIERNRMESSSDGNEWNHQRMEMKGMEMNGIVIEWNRMDSLNGIRWNHRMDWNGIIEWTRKGSLLNGIEWNHRMNNHRMDPNGIILQWNRMELSNAIEWNYRMQSNRIIEWTRMESSNGMEWNKSNGIIIEWIRKVSTSNGKKRNYRMESKRIFERTRMESSNGMEWNNPWTGRQSSSNGIEWNHRMDSNGIIIERNRMESSSDGNEWNHHRMEMKGRIIERTRMESSNGMEWNNPWTRMQSSSNGIEWNHRMDSNGIIIERNRMESSSDGNEWNHHRMEMKGRIIEWTRMQSSNGMEWNNQWTRMQSSSNGIEWNHRMNSNGIIIERNRMESSSDGNEWNHHRMEMKGRIIEWTRMQSSNGMEWNNPWTRMQSSSNGIEWNHRMDSNGIIIERNRMESSSDGNEWNHHRMEMKGNHRMDSNGIIEWNGMEQSMNSNGIIIEWNRMESSRMESSHRIEWNYHRMESNESTSNGKKRNYRMESKRIIERTRMESSNGMEWNNPRTRMQSSSSGIEWNHRMDSNGIIIERNRMESSSDGNECNHHRMEMKGMEMNGIVIEWNRMDSLNGIRWYHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNKSNGIIIEWNRMVSTPNGKKRNYRMESKRIFERTRMESSNGMEWNNPWTRMQSSSNGIEWNHGMDSNGIIIEWNRMESSSDGNEWNHHRMEMKGNHRMDSNGIIEWNGMEQSMNSNGIIIEWNRMESSSGIEWNYDQMESNEWNHRIESNGIIIEWNRMVSTPNGKKRNFRMETKRIFERTRMELSNGMEWNNPWTRMQSSSNGIEWNHRMDSNGIIIERNRMESSSDGNEWNHHRMEMKGVII

SEQ ID NO: 923221 - protein, 204 aa, Homo sapiens
MESKIIIEWTRMESSNGMEWNNPWTRMQSSSNGIEWNHRMDSNGIIIERNRMESSSDGNEWNHHRMEMKGRIIERTRMESSNGMEWNNPWTRMQSSSNGIEWNHRMDPNGIIIERNRMESSSDGNEWNHHRMEMKGNRMELSSNGIEWNQHQTEKNGIIVWNRRESSNGPEWNHLMEWNGIIHGLECNHHRMESNGIIEWTRME

SEQ ID NO: 923222 - protein, 403 aa, Homo sapiens
MEWNNPWTRMQSSSNGIEWNHRMDSNGIIIERNRMQSSSDGNEWNHHRMEMKGRIIEWTRMESSNGMEWNNPWTRMQSSSNGIEWNHRMDSNGIIIERKRMESSSDGNERKSNGIIIEWNRMESTSNGKKRNYRMESKRIIEWTRMESSNGMEWNNPWTRMQSSSNGIEWNHRMDSNGIIIERNRMESSSDGNEWNQSNGTIIEWTQMELSSNGIEWNYRMQSNRIIEWTRMESSNGMEWNKSNGIIIEWNRMVSTPNEKKRNYRMESKRIFERNRMESSNGMEWNNPWTRMQSSSNGIEWNHRMDSNGIIIERNRMESSSDGNEWNHHRMEMKGNRMELSSNGIEWNQHQTEKNGIIEWNRRESSNGPEWNHLMEWNGIIHGLECNHHRMESNGNIEWTRME

SEQ ID NO: 923223 - protein, 248 aa, Homo sapiens
MEWNNPWTRMQSSSNGIEWNHRMDSNGIIIERNRMESSLDGNEWNHHRMEMKGRIIEWTRMESSNGMEWNNPWTRMQSSSNGIEWNHRMDSNGIIIERNRMESSSDGNERKSNGIIIEWNRMESTSNGKKRNYRMESKRIIEWTRMESSNGMEWNNPWTRMQSSSNGIEWNHRMDSNGIIIERNEWNHHQMEMNGMIIEWNRIELWNEIQCDHHRMDPNGIIIQRKLMESTSNESNGNTIELKRMELP

SEQ ID NO: 923224 - protein, 1639 aa, Homo sapiens
MKLKWMDSSSNGFEWNHRIKLIEIIIEWNRMISLNGIEWNHHQMEMNGINHRMDSNGIIEWNGMEQSMNSNGIIIEWNRMESSSGIEWNYDQMESNMEMNGIVTEWNRMDSLNGIRWNHRMDWNGIIEWTRKGSLLNGIEWNHRMVSIGIIIKWNRMESPNRIEWNNHRMDSNGIILQWNRMELSNAIEWNFRMQSNRIIEWTRMESSNGMEWNKSKGIIIEWNRMVSTPNGEKRNYRMESKRIFERTRMESSNGMEWNNPWTGRQSSSNGIEWNHRMDSNGIIIERNRMESSSDGNEWNHHRMEMKGNRMELSSNGIEWNQHQTEKNGIIEWNRRESSNGPEWNHLMEWNGINHGLECNHHRMESNGIIENHRIKLIEIIIEWNRMVSLNGIEWNHHQMEMNGIVIEWNRMDSLNGIRWNHRMDWNGIIEWTRKGSLLNGIEWNHRMVSIGIIIKWNRMESPNRIEWNNHRMDSNGIILQWNRMELSNAIEWNYRMQSNRIIEWTRMESSNGMEWNKSNGIIIEWNRMVSTPNGEKRNYRMESKRIFERTRMESSNGMEWNNPWTGRQSSSNGIEWNHRMDSNGIIIERNRIIIEWTRMESSNGMEWNNPWTRMQSSSNGIEWNHRMDSNGIIIERNRMESSSDGNEWNHHRMEMKGNRMELSSNGIEWNQHQTEKNGIIVWNRRQSSNGPEWNHLMDWNGIIHGLECNHHRMESNGIIEIEWNNHQMDSNGIILKWNRMELSNAIEWNYRMQSNRIIEWTRMESSNGMEWNKSNGIIIEWNRMVSTPNGKKRNYRMESKRIFERTRMESSNGMEWNNPRTRMQSSSNGIEWNHRMDSNGIIIERNRMESSSDGNEWNHHRMEMKGNHRMDSNGIIEWNGMEQSMNSNGIIIEWNRMESTSGIEWNYDQMESNMEINGIVIEWNRMDSLNGIRWNHRMDWNGIIEWTRKGSLLNGIEWNHRMVSIGIIIKWNRMESPNRIEWNNHRMDSNGIILQWNRMELSNAIEWNYRMQSNRIIEWTRMESSNGMEWNKSNGIIIEWNRMVSTPNGKKRNYRMESKRIFERTRMESSNGMEWNNPRTRMQSSSNGIEWNHRMDSNGIIIERNRMESSSDGNERNHHRMEMKGNRMELSSNGIEWNQHQTEKKGIIEWNRRESSNGPEWNHLMEWNGIIHGLECNHHRMESNGIIEWNHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNKSKGIIIEWNRMVSTPNGKKRNYRMESKRIFERTRMESSNGMEWNNPWTGRQSSSNGIEWNHRMDSNGIIIERNRMESSSDGNEWNHQRMEMKGNRMELSSNGIEWNQHQTEKNGIIEWNRRESSNGPEWNHLMEWNGINHGLECNHHRMESNGIIEWNHRMDWNGIIEWTRKGSLLNGIEWNHRMVSIGIIIKWNRMESPNRIEWNNHRMDSNGIILQWNRMELSNAIEWNYRMQSNRIIEWTRMESSNGMEWNKSNGIIIEWNRMESTSNGKKRNYRMESKRIFERTRMESSNGMEWNNPWTRMQSSTNGIQWNHRMDSNGIIIERNRMESSSDGNEWNHHRMEMKGIII

SEQ ID NO: 923225 - protein, 272 aa, Homo sapiens
MESKRIFERTRMESSNGMEWNNPWTRMQSSSNGIEWNHRMDSNGIIIERNRMESSLDGNEWNHHRMEMKGRIIEWTRMESSNGMEWNNPWTRMQSSSNGIEWNHRMDSNGIIIERNRMESSSNHRMDSNGIIEWNGMEQSMNSNGIIIEWNRMESSSGIEWNYDQMESNEWNHRIESNGIIIEWNRMVSTPNGKKRNYRMESKRIFERTRMESSNGMEWNNPWTRMQSSSNGIEWNHRMDSNGIIIERNRMESSLDGNEWNHHRMEMKGVII

SEQ ID NO: 923226 - protein, 826 aa, Homo sapiens
MESKRIFERTRMESSNGMEWNNPWTRMQSSSNGIEWNHRMDSNGIIIERNRMESSLDGNEWNHHRMEMKGRIIEWTRMESSNGMEWNNPWTRMQSSSNGIEWNHRMDSNGIIIERNRMESSSDGNEWNHHRMEMKGRIIEWTRMESSNGMEWNNPWTRMQSSSNGIEWNHRMDSNGIIIERNRMESSSDGNEWNHHRMESNRIIIEWNNHRMDSNGIILKWNRMELSNAIEWNYRMQSNRIIEWTRMESSNGMEWNKSNGIIIEWNRMVSTPNGKKRNYRMESKRIFERTRMESSNGVEWNNPWTGRQSSSIGIEWNHRMDSNGIIIEPNRMESSSDGNEWNHHRMEMKGNRMELSSNGIEWNQHQTEKNGIIEWNRRESSNGPEWNHLMEWNGIIHGLECNHHRMESNGIIEWNHRMDWNGIIEWTRKGSLLNGIEWNHRMNRMEQSSNGLKWNYPPMESNGIIEWNGMEQSMNSNGIIIEWNRMESSSGIEWNYDQMESNNRMELSSNGIEWYQHQTEKNGIIEWNRRESSNGPEWNHLMEWNGIIHGLEGNHHRMESNGIIEWTRMESSSNGKEWNHRIESNGIIIEWNRMVSTPNGKKRNYRMESKRIFERTRMESSNGMEWNNPWTRMQSSSNGIEWNHRMDSNGIIIERNRMESSSDGNEWNHHRMEMKGNHRMDSNGIIEWNGMEQSMNSNGIIIEWNRMESSSGIEWNYDQMESNEWNHRIESNGIIIEWNRMVSTPNGKKRNYRMESKRIFERTRMESSNGMEWNNPWTRMQSSSNGIEWNHRMDSNGIIIERNRMESSSDGNEWNHHRMESNRIME

SEQ ID NO: 923227 - protein, 250 aa, Homo sapiens
MKLKWMDSSSNGFEWNHRIKLIEIIFEWNRKVSLNGIEWNHHQMEMNGIVIEWNRMDSLNGIRWNHRMDWNGIIEWTRKGSLLNGIEWNHRMNHRMDSNGIIEWNGMEQSMNSNGIIIEWNRMESSSGIEWNYDQMESNEWNHRIESNGIIIEWNRMVSTPNGKKRNYRMESKRIFERTRMESSNGMEWNNPWTRIQSSSNGIELNHRMDSNGIIIERNQMESSSDGNEWNHHRMEMKGVIIKWNCMESS

SEQ ID NO: 923228 - protein, 138 aa, Homo sapiens
MESKRIFERTRMESSNGMEWNNPWTRMQSSSNGIKWNHRMDSNGIIIERNRMESSSDGNEWNHHRIEMKGNRMELSSNGIEWNQHQTEKNGIIEWNRRESSNGPEWNHLMEWNGIIHGLECNHHRMESNGIIEWTRME

SEQ ID NO: 923229 - protein, 138 aa, Homo sapiens
MESKRIFERTRMESSNGMEWNNPRTRMQSSSNGIEWNHRMDSNGIIIERNRMESSSDGNERNHHRMEMKGNRMELSSNGIEWNQHQTEKNGIIEWNRRESSNGPEWNHLMEWNGIIHGLECNHHRMESNGIIEWTRME

SEQ ID NO: 923230 - protein, 726 aa, Homo sapiens
MESKRIFERTRKESSNGMEWNNPWTRMQSSSNGIKWNHRMDSNGIIIERNRMESSLDGNEWNHHRMEMKGSNGIIIEWNRMESTSNGKKRNYRMESKRIIEWTRMESSNGMEWNNPWTRMQSSSNGIEWNHRMDSNGIIIERNRMESSSDGNERKSNGIIIEWNRMESTSNGKKRNYRMESKRIIEWTRMESSNGMEWNNPWTRMQSSSNGIEWNHRMDSNGIIIERNEWNHHRMEMNGMIIEWNRIELWNEIQWNHRMDWNGIIEWTRKGSLLNGIEWNHRMVSIGIIIKWNRMESPNRIEWNNHRMDSNGIILQWNRMELSNAIEWNYRMQSNRIIEWTRMESSNGMEWNKSNGIIIEWNRMVSTPNGKKRNYRMESKRIFERTRMESSNGMEWNNPWTRMQSSSNGIEWNHRMDSNGIIIERNRMESSSDGNEWNHHRMEMKGRIIEWTRMESSNGLEWNNPWTRMQSSSNGIEWNHQMDSNGIIIERNRMESSSDGNERKSNGIIIEWNRMESTSNGKKRNYRMESKRIIEWTRMESSNGMEWNNPWTRMQSSSNGIEWNHRMDSNGIIIERNRMESSSDGNERKSNGIIIEWNRMESTSNGKKRNYRMESKRIIEWTRMESSNGMEWNNPWTRMQSSSNGIEWNHRMDSNGIIIERNEWNHHRMEMNGMIIEWNRIELWNEIQCDHHRMDPNGIIIQRKLMESTSNESNGNTIELKRMELP

SEQ ID NO: 923231 - protein, 1014 aa, Homo sapiens
MEWNNPWTRMQSSSNGIEWNHRMDSNGIIIERNRMESSLDGNEWNHHRMEMKGNHRMDSNGIIEWNGMEQSMNSNGIIIEWNRMESSSGIEWNYDQMESNEWNHRIESNGIIIEWNRMVSTPNGKKRNYRMESKRIFERTRMESSNGMEWNNPWTRMQSSSNGIKWNHRMDSNGIIIERNRMESSSDGNEWNHHRMEMKGMEMNGIVIECNRMDSLNGIRWNHRMDWNGIIEWTRKGSLLNGIEWNHRMVSIGIIIKWNRMESPNRIEWNNHRMDSNGIILKWNRMELSNAMEWNYRMQSNRIIEWTRMKSSNGMEWNKSNGIIIEWNRMVSTPNGKKRNYRMESKRIFERTRMESSNGMEWNNPWTRMQSSSNGIEWNHRMDSNGIIIERNRMESSSDGNEWNHHRMEMKGMEMNGIVIEWNRMDSLNGIRWNHRMDWNGIIEWTRKGSLLNGIEWNHRMVSIGIIIKWNRMESPNRIEWNNHRMDSNGIILQWNRMELSNAIEWNYRMQSNRIIEWTRMESSNGMEWNKSNGIIIEWNRMVSTPNGKKRNYRMESKRIYKRTRMESSNGMEWNNPWTRMQSSSNGIEWNHRMDSNGIIIERNRMESSSDGNEWNHHRMEMKGMEMNGIVIEWNRMDSLNGIRWNHRMDWNGIIEWTRKGSLLNGIEWNHRMVLIGIIIKWNRMESPNRIEWNNHRMDPNGIILQWNRMELSNAIEWNYRMQSNRIIEWTRMESSNGMEWNKWNRMDSFNGIRWNHRMDWNGIIEWTRKGSLLNGIEWNHRMVSIGIIIKWNRMESPNRIEWNNHRMDSNGIILQWNRMELSNAIEWNYRMQSNRIIEWTRMESSNGMEWNKSNGIIIEWNRMVSTPNGKKRNYRMESKRIFERTRMESSNGMEWNNPWTRMQSSSNGIEWNHRMDSNGIIIERNRMESSLDGNEWNHHRMEMKGNRMELSSNGIEWNQHQTEKNGIIEWNRRESSNGPEWNHLMEWNGIIRGLECNHHRMESNGIIEWTRME

SEQ ID NO: 923232 - protein, 266 aa, Homo sapiens
MESKRIFERTRMESSNGMEWNNPWTRMQSSSNGIEWNHRMDSNGIIIERNRMESSSDGNEWNHHRMEMKGRIIEWTRMESSNGMEWNNPWTRMQSSSNGIEWNHRMDSNGIIIERNEWNHHWMEMNGIIIKGNRIELWNEIQCDHHKMDPNGINIKWNQMESLNGIEWNQSNGIIIEWNRMESTSNGKKRNYRMESKRIIEWTRMESSNGMEWNNPWTRMQSSSNGIEWNHRMDSNGIIIGRNRMESSSDGNERNHHRMESNRIME

SEQ ID NO: 923233 - protein, 272 aa, Homo sapiens
MESKRIFERTRMESSNGMEWNNPWTRMQSSSNGIEWNHRMDSNGIIIERNRMESSLDGNEWNHHRMEMKGRIIEWTRMESSNGMEWNNPWTRMQSSSNGIEWNHRMDSNGIIIERNRMESSSNHRMDSIGIIEWNGMEQSMNSNGIIIEWNRMESSSGIEWNYDQMESNEWNHRIESNGIIIEWNRMVSTPNGKKRNYRMESKRIFERTRMESSNGMEWNNPWTRMQSSSNGIKWNHRMDSNGIIIERNRMESSSDGNEWNHHRMEMKGVII

SEQ ID NO: 923234 - protein, 185 aa, Homo sapiens
MESKRIIEWTRMESSNGMEWNNPWTRMQSSSNGIEWNHRMDSNGIIIERNRMESSSDGNEWNHHRMEMNGIVIEWNRMDSLNGIRWNHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNSQ

SEQ ID NO: 923235 - protein, 193 aa, Homo sapiens
MKLKWMDSSSNGFEWNHRIKLIEIIIKWNRMVSLNGIEWNHHQMEMNGIVIEWNRMDSLNGIRWNHRMDWNGIIEWTLKGSLLNGIEWNHRMVSIGIIIKWNRMESPNRIEWNNHRMDSNGIILKWNRMELSNAIEWNYRMQSNRIIEWTGMEKSMNSNGIIIEWNRMESSSGIECNYDQMESNVIIIKWNQK

SEQ ID NO: 923236 - protein, 137 aa, Homo sapiens
MEADRSQDLQASRNDTQSHTADQDLKEPAAPVTIRRPSLHLHLLAPELSRFCCGLHQQNKMLCETNEMPPLSQRDSVPNQYHELTIAFSGCSNKMSNGHHQEILLPISSIIQEKVSNNRLNINLNLYERTSFHHAPC

SEQ ID NO: 923237 - protein, 143 aa, Homo sapiens
MGSISSYFPFCLGPRDTVLHILAVSVPAIAYSGQGIAWAATPKSASHKSWWLILGVKPASVPNVRVKEAWQLPTRFQRIYEKDCCRGGAPTEILYQGSAEKKEAISEEIMAKNFQKTDEKHQSTELLPKKAQGSEVDNVISDS

SEQ ID NO: 923238 - protein, 132 aa, Homo sapiens
MPQIRNTASLKDWGTQKITTLKSPSAQGAKTAASFPRICKEKSVARLKIISISTKLSGEEKTIGSGDTQRREADNVTTVAEIRVMGPQAKDYLEPSEAERCKEVFFPRASWRDHSPADTLISDFQTPELLKL

SEQ ID NO: 923239 - protein, 141 aa, Homo sapiens
MTFIFSMKPVRTSAEVSNLGKLFLKLGSVTQWKICAPFTAGHSWVLLLAFYSDHGLGFPHAQCPPYPWEVSTRSAFRKLYAYPTEAFFPSPVECTCVDSCGFDSCGWSGDCLLPGAQALAAKLLFLESSVIIVKPSPDTPS

SEQ ID NO: 923240 - protein, 157 aa, Homo sapiens
MFSSLCPCILIVQLPLMSLLVFAGGPFQTLFAWVSPAEAAEQQRLLPVPSSGTCQMPARALLYEVSVDPCLEVSPLIEGTGVRNPLEAICPLAELEHCARRSIALFRAGRDALPIEEESRETVWLQWLCGPAVDSAQSKLPGSFVYTVRENRLLRPQ

SEQ ID NO: 923241 - protein, 162 aa, Homo sapiens
MFEIQNKDSSDIGALSCSESAPPQRNTEPLPGGTAAAAMVEGLWAASGFSSLEKCRSASKCSDGGTEAVVKSQCGHASTPSQWALSCEMQCRAAVANAGMPKDPRLPGLHVCLSGSCTQTPRSSLCQSRGPGGEVHRGSAEPGLQRSMAEVWIPRDSHHFPA

SEQ ID NO: 923242 - protein, 173 aa, Homo sapiens
MWVGTDKRIKAGCLSQQWQLAQVPFHTVEAFFTPEASETTNPLGGMNDPRRNTLRAITLTAKVCSFTPEPARPQTHHKEETPNTSKHQKEQTLDMPPLRTVTLTARVRGFILEVSETKNPPILDTEGSRSNICCSAASTGDTQENRVCSGPQQKGHLQQNSICRSPTSKTKGR

SEQ ID NO: 923243 - protein, 179 aa, Homo sapiens
MRQRRREFAGTIMIPSQLILSYSKEIYPGAAWQGTAGTPSAGTTWASWVPWTADKRQQEVTGSRGLGNGLRPGAWATSSVDPSENLRCLFQGCPWPPRDQSAHTPSPLKPIKIPVLSQTRADNSTTCLQRSCPLWVSSKVFCHSIKHLFTLLTLHPPLVRVPHSSWMQDKNSVPAKWHG

SEQ ID NO: 923244 - protein, 182 aa, Homo sapiens
MLRCACFSFPEAFKSCFLLSLQNCPSSARLLQFAGGPLQTLARGQERLSSLNLSLHRPLPIGSLSQGVESSFCKPLTGAAGFPAEMPHPVRRNLEKQSGHTVRGKPPTKATVMAVSPPLTKPVPGWTPDCCADSGNCKPVVPSFLGSMGVGSTEQDHLAPWLSPLSGGVYRSPVSLEYQAPL

SEQ ID NO: 923245 - protein, 150 aa, Homo sapiens
MYPTKSRPTAFSSMYPPLTVTFTPEISIPIMVPPNLLMPPDKNQKRQRSREAAPLISAAASPKVIFQTSAFHQCPHACKQLPLGNNDFILVFQNSFKCLSLTELTQNYTGKRFLEKKFQMIALSRRSEDAAELIRDNPAHGPIFIHSTGS

SEQ ID NO: 923246 - protein, 134 aa, Homo sapiens
MKETQDLTSPHRYKTFLPTRVPTSFSVIPGQAYGKNLSIFPPQVLDNGRKGFTCDHAVGIILLPLGAKGQKPGERLPQTLLGDWWSQMLGFCGMNDKKHQFEGQRKENCQKVEKRKLIIRGVTLSLSSYVILWK

SEQ ID NO: 923247 - protein, 143 aa, Homo sapiens
MSTVTVERIADCTKHPKKWHNATFTEVKEWSRPCNLAYAARHVGIARCLWQVDFTAKELEETFHWHSYIVEKIEVLRDQYNKAAYSTVVNSLDSGTVKLIISGFNFKSFPKVHCIILMPLCSSHKSVRTYNVWFSIPELLHLE

SEQ ID NO: 923248 - protein, 254 aa, Homo sapiens
MGPAVYLVSPNAITWIPQLKVQNSLPVFTPPCDSCRLQLLLIGYLIWHPLRYFAFRYNFQEGGRGQSCEMSEKVEDNEEYRKSEKDSNKSLGGADAAGSWLIILRNGAISRARCWSLLLANWTLSSGHNQAAQPWPRAVSQKESTYLQKMAEPCSKILEASAVIHLWGPAEGSKQHPYLPLTSQAPLDLLGHMAQMAEQLVQQPGPVAEPSPVLEHTQNRQSLNKWAGVTHLNEECVASKIQVHPLGIVPPSWL

SEQ ID NO: 923249 - protein, 154 aa, Homo sapiens
MLQDMLEPGSPQWALKMGTRRWLNLRASIPTMGPPVVRGDLAEKAEPYSNAPSHPQPETNGEHERLCGDLWGKGQRMKRAMECESCHRYFPQERSTGSVLHPLQQPVKGQVINICPGSLYSGLFKGCSPAIMPLAHTNMQTYSGISSLKIFFMP

SEQ ID NO: 923250 - protein, 140 aa, Homo sapiens
MVPRPAASTAPRSLLELQNLKTYPRPAFNKTLRLYKHVGSQDKWKAKLLTPVSQVVKAKEKFLKEIKSAAPVNTQMMRKQNNLITDMKKILVIWIENQTSHNIPLSQSLIQYNALTLFSSMKAEKDEETAKQFIQMICDY

SEQ ID NO: 923251 - protein, 245 aa, Homo sapiens
MVPPEAPPAWVTEYETATSSDSCLLDANVCRLDFFPHLASKVIPTRQDQDSLFRSLEFLEWHLEDPCSWCPPGFRQVSPFDGHFEGPVPYHSVWSPTSGQFKDSGQQAHGRGKGRFHPADLKQIKADLGKFSDDPYNYTDVLQGLGQSSDLAWKDIMLLLDQTLSPIENEAALAAAQQFGHLWYLSQRTKALWARSTQPDDSATGLRVARASASSCHHPHRAPGCLQNTHFIYRNTRRLKDTPCN

SEQ ID NO: 923252 - protein, 284 aa, Homo sapiens
MGGRAPVSRGRDSYGGPPRREPLPSHRDIYLSPRDDVYSTKDSYSSKDYPSSRDTRDYTPPPQDYTYRDYGHSSSRDDYPSRGYGDREGYGRDLDYSDHPNGGSYRDSYESYGNSSSAGHTRGPLPAYGGSSRYDDYSSSRDGYGGSQTCVLNNYGILKKSLANQKGRRRREEEEEEAEAEEGEEEGGGGGEGGEGEGGGEGGEGGGNCFVSRPSLESLSLGPMQWLSRELNAGAGFDLVNIDTIATWGQLILCYGGAVLCIVRCLASSLVCIRDVAGTPPPQL

SEQ ID NO: 923253 - protein, 135 aa, Homo sapiens
MSKPAHNACQPRAEIPTDIRMCKKSTFTTDEQIKTRSGNETTGPGLNLSSDNAYVSQTLGNFGKVPLTKPWLCYSFSQPCPSHTEIKDGGYGYSGIAKYSLKVKMVQKVSTEGSRDLPFLAIFLEWVRRRWNVET

SEQ ID NO: 923254 - protein, 140 aa, Homo sapiens
MTQSSGLLGSAWINLKPGWGLTWSSSPGVEWASCPLFKEKAEMVDGKNSSRALIGAFYNPLASFRALIGAFLQSTDGAFYNPLSSYGVPIGAFYNPSYRVLIGAFYYPLVRQRSSPSPNLIQAHQRVSGLVQGSLVEVVS

SEQ ID NO: 923255 - protein, 141 aa, Homo sapiens [sequence omitted]

SEQ ID NO: 923256 - protein, 141 aa, Homo sapiens
MKDLCTRDPQLLTCGFCGLVSHLGPEPVLRNEAVKSLTPTFQLWPTREEIESPIIEKEQNQHIDRVKETEVTVAASLGILRQAQSHKHSSCLKLNGQSKSQGLSNWRGFPSFRSNVCRYSKRIGVVNYNQFTTSNYMAIYS

SEQ ID NO: 923257 - protein, 164 aa, Homo sapiens
MGRYLEKKAVLSFTKRGFPKCNEERVISRWKNAHTIKAGIKCELGLLKLADKNIKDESQDPQLQVCWSLLEVHSRPCFAWVSAAEAAEERILVNSKCCCLIIHLEVLSQRSTRPCSYSKHFVYPGSHNARSLCASQISLEPGTRQLETAGDCKIVLTIQTTGSL

SEQ ID NO: 923258 - protein, 200 aa, Homo sapiens
MGVFKKIVESEQLENGSHFLVRAEEPHPGATATPVHEEYCQSTNEFFLVAQGLLCQLVVNAAWPGPQPSGQWAVFWLTAGPEMLDKSLVLELGTPRADLVLCSDVAQMISEASTSRDSPKALSGQRALQLTGDECCQDWVLSLKAAVSLLAQDVSRNVIWELGPGTGASCLCLMPYPAMADLISRMQVKVLPTLPFPLLC

SEQ ID NO: 923259 - protein, 137 aa, Homo sapiens
MKKMRKVQGLIIGVGRGKIMYECISGGQNKCDLCESKLKTKISMQSVDNEYDYDNNNDKSCLELAEALTSAGSGETKIKFGTRKGASIESATLAKSNGEESASVGNRKVSEEDLRLAFYLKMTIFIRKYKNICNVIP

SEQ ID NO: 923260 - protein, 187 aa, Homo sapiens
MDIFKHKHKERKKKERKFQIKEVSKDISRLTGRLAISPEMPVRLEKKQQWSQFALISPGIYVLVKGLALGKMDNLKTEKDEDRVKKSVFWKSSLPLKGGGLCLPWKAVVFGRKRLVGVGVVGCKAVLVWWRAGKAQDAMMDERCICYGRDPMDFHTREWLGVFEQNILTAGPIFNKRSQNYIYNIYI

SEQ ID NO: 923261 - protein, 125 aa, Homo sapiens
MGLVNKSDEASIGISKSHEFNRNATSMFGLVLFLCQKKYIRNLEIRCQDPQHKICIFLVSYRIKTPGTITLCSSSLKSYQTLQASLGDDGIILGEAFTFSRGQFLESDAAGGPQLTMASGGMTID

SEQ ID NO: 923262 - protein, 212 aa, Homo sapiens
MTAAHGETRVKFVLEIPTLLFPGSISSRLDLETIRNAFTKEEKPEGLGPEPQILHWQHTGTQQLDWQQQGLKQLDWQQLDWQQQGLQQLDWQQLDWQQQGLEQLDWQQNDPQPEEEQQGLQQLDWEQPQEPHPPLELPQEPQPPLEPPQEPQLEQEQAGTQQHTGLQQQMGTQQLEPQPPQPEPQPPLPEPQPPQPEPQPPEQPQQPMILAD

SEQ ID NO: 923263 - protein, 290 aa, Homo sapiens
MYLVTVLRNLLIILAVSSVSPLHTPMYFFLSNLCWADIGFTSATVPKMIVDMQSHSRAISHAGCLTQMSFLFLFACIEGMLLTVMAYDCFVAICRPLHYPVIVNPHFCVFFVLVSFFLSLLDSQLHSWIVLQFTIFKNVEISNFVCDPSQLLKLACSDGLDLWRRQLSLGLAQDVDLGTPQKGRSGRLTERRRKAHRMLKLYKGLSEGEALGLPAGPDPLDPTDLNGAHFDPEVYLDKLPRECPLAQLIDSETDMVQQIRALDSDMQTLVYENYDKFIPATEIDKQHKTV

SEQ ID NO: 923264 - protein, 144 aa, Homo sapiens
MLSVSTLLLFPHIANLPKPQDKRAPIFSGLIALRVLGQESGLMGTLGTGHRGHSCSPSHSGRLWLYDVHKLQKLPEFLGLVGALQDCQCREVSSLQKRVCAQRPLRARHRVHGGEIAPGHAKPIFSSEFLLICRGPSIIHIAQF

SEQ ID NO: 923265 - protein, 318 aa, Homo sapiens
MSQEDMLQSTLLGGETGDQAAFAGKDWGVELLGRVESCVPQWRRDKPCSREWLRVGPPLQRRMRAPLAPLPCLLLFPSLFLVIFILEGGGGAVSLWFERFDLSISNVPKVVMLLGAAPAETVVDTEAQRERGPCCGSRPLSPLDLPGWQQQSCTLQRCRNGHSVFRFLLLFLCLHLGSLLLSLCLPLGSLLLSLCLRLGSLLLSLCLRLGSLLLSLCLRLGSLLLFLCLHLLFRPGYPVREWGRNLSYHSKDSWWQQRPRALQSSRSLTLTKSIHGNCWNPLTTWIDCIHPGNKIVFSMLISINPSISAKDGLIILEQ

SEQ ID NO: 923266 - protein, 201 aa, Homo sapiens
MGYCSGATWSTCTGIHDLPEPCELFQKWPLRGFSKVPARCDGLDDVDSDDDDNDNDDYDNDYDDNNDNDNDDDNDDCDNDDDGCDNDYDNDDDYDNDDDYDNGDDDDIMMTIMMMTTTMMTTLTVMTIMINDNDDENDNNDNYDDDYDDDGNDDIDDDDNDNDDDDNDDIDDDDDSDNDDDNDNDNNDNNDSDDNDDDGLS

SEQ ID NO: 923267 - protein, 211 aa, Homo sapiens
MVSSFTQGGRVRPTLATETSYKDCDDDDDGDNEGDDNISSISSILSHLLMVPNWWKWILIKFFILVIFMLSGVMVNTECQLDWIEGCKVLILGHPESHHGQLALAVIWYKSQQGDGVTGLFVEILTHQQSGPRATGESRPCAEALFQPLLVSRLLLALSKASHVAKFKFKGVETEDSKATMKSSMHSETEGVWPLCTLPHGFQARLDPGTQ

SEQ ID NO: 923268 - protein, 147 aa, Homo sapiens
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTGVASALSSRYH

SEQ ID NO: 923269 - protein, 147 aa, Homo sapiens
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTAVASALSSRYH

SEQ ID NO: 923270 - protein, 285 aa, Homo sapiens
MAIRSGNTIIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAITIRAIIAITPLSWMVSHLPFCGSNVVVHSYCEHIALARLACADPVPSSLYSLIGSSLMVGSDVAFIAASYILILKAVFGLSSKTAQLKALSTCGSHVGVMALYYLPGMASIYAAWLGQDVVPLHTQVLLADLYVIIPATLNPIIYGMRTKQLRERIWSYLMHVLFDHSNLGS

SEQ ID NO: 923271 - protein, 282 aa, Homo sapiens [sequence omitted]

SEQ ID NO: 923272 - protein, 326 aa, Homo sapiens
MSAFSEGEGAYEDQQGEFPRVMSASSITSTHPTSFLLMGIPGLEHLHIWISIPFSAYTLALLGNCTLLLIIQADAALHEPIYLFLAMLAAIDLVLSSSALPKMLAIFWFRDREINFFACLVQMFFLHSFSIMESAVLLAMAFDRYVAICKPLHYTTVLTGSLITKIGMAAVARAVTLMTPLPFLLRCFHYCRGPVIARCYCEHMAVAVLQLSSQEARYKAFGTCVSHIGAILAFYTPSVISSVMHRVARCAAPHVHILLANFYLLFPPMVNPIIYGVKTKQIRDSLGSIPEKGCVNREKMAMYKPRRVASVATNSAWVLDFYLLEL

SEQ ID NO: 923273 - protein, 408 aa, Homo sapiens
MESPCTFRGDKVFLLLFADILAVKAGNKQKTTTCKDRTKHSYQTGSRVLGRRPDKQSQMVNGIRGAMSASNITLTHPTAFLLVGIPGLEHLHIWISIPFCLAYTLALLGNCTLLLIIQADAALHEPMYLFLAMLAAIDLVLSSSALPKMLAIFWFRDREINFFACLAQMFFLHSFSIMESAVLLAMAFDRYVAICKPLHYTKVLTGSLITKIGMAAVARAVTLMTPLPFLLRCFHYCRGPVIAHCYCEHMAVVRLACGDTSFNNIYGIAVAMFIVVLDLLLVILSYIFILQAVLLLASQEAHYKAFGTCVSHIGAILAFYTTVVISSVMHRVARHAAPHVHILLANFYLLFPPMVNPIIYGVKTKQIRESILGVFPRKDMTHGSVSSGSLWIECADCAVFSQCPHPYQ

SEQ ID NO: 923274 - protein, 194 aa, Homo sapiens
MLSSTLRVAVVCVSNVNRSMEAHSILRRKGLSVRSFGTESHVRLPGPRPNRPVVYDFATTYKEMYNDLLRKDRERYTRNGILHILGRNERIKPGPERFQECTDSFDVIFTCEESVYDTVVEDLCSREQQTFQPVHVINMEIQDTLEDATLGAFLICEICQCLQQSDDMEDNLEELLLQMEEKAGKSFLHTVCFY

SEQ ID NO: 923275 - protein, 134 aa, Homo sapiens
MVRVIKNLTTRSKSETALANLTDEESSQGGIFQGILDVHVDHVHRLKGLLFSGTQIFHHCVIDTLLTGEDDIKGISALLKSFWTGLDSLISSQDVNSQNFSPIQKKSHSQKHICLWYFKSYSTQHFLHLILLES

SEQ ID NO: 923276 - protein, 228 aa, Homo sapiens
MLSSTLRVAVVCVSNVNRSMEAHSILRRKGLSVRSFGTESHVRLPGPRPNRPVVYDFATTYKEMYNDLLRKDRERYTRNGILHILGRNERIKPGPERFQECTDFFDVIFTCEESVYDTVVEDLCSREQQTFQPVHVINMDIQDTLEDATLGAFLICEICQCLQQSDDMEDNLEELLLQMEEKAGKSFLHTSGFIVRSICKDLPLSTVCVTFVHITWKETITKKIFYGK

SEQ ID NO: 923277 - protein, 136 aa, Homo sapiens [sequence omitted]

SEQ ID NO: 923278 - protein, 224 aa, Homo sapiens
MYTCSSFGRPGYRWSSPRLRDPAAAEVPVSLWFPVAAIMLSSTLRVAVVCVSNVNRSMEAHSILRRKGLSVRSFGTESHVRLPGPRPNRPVVYDFATTYKEMYNDLLRKDRERYTRNGILHILGRNERIKPGPERFQECTDSFDVIFTCEESVYDTVVEDLCSREQQTFQPVHVINMEIQDTLEDATLGAFLICEISDLSACARDQHGHPRYPGRCHPGSFPHL

SEQ ID NO: 923279 - protein, 346 aa, Homo sapiens
MLSWKFAIQPKTTGKQLFDHVVKIVGLREVWFLGLQYVDSRGYSTWLQLNKKVTQQDVKKEKDPLQFKFRAKFFPEDVSEELIQEITQRLFFLQVKEAILKDEIYCPTETAVLLASYAVQAKYGDYNKEIHNPGYLANDRLLPQPKEAAEWLEKERRAAEEAKSAIAKQAADQKNQEQLAAKLAQFTAKIVLLEEAKKKKEEEATEWQHKAFAAQKTWKRPKKKNEHDEHDEINAKAGAELSNEGVMNHRSKEEHVTETQKNERVKKLLQALSSELAQARDESKETQKDVLQAKNVKTGHGLYCAVYKWHKHRNPFPCSWPVDLSVRHGVAGENNNDNALSGSLFS

SEQ ID NO: 923280 - protein, 176 aa, Homo sapiens
MEAHSILRKKGLSVRSFGTESHVRLPGPRPNRPVVYDFATTYKEMYNDLLRKDRECYTRNGILHILGRNERIKPGPERFQECTDSFDVIFTCEESVYDTVVEDLCSREQQTFQPVHVINMDIQDTLEDATLGAFLICEICQCLQQSDDMEDNLEELLLQMEEKAGKSFLHTMSKPS

SEQ ID NO: 923281 - protein, 170 aa, Homo sapiens [sequence omitted]

SEQ ID NO: 923282 - protein, 142 aa, Homo sapiens
MARYSSETKLPEERSSSNICCSPISAVLQPPPLIPRQTGSRVDLQQTPTDLQLRVLTVRRKTNRKDIHIKTPSVRHHHQRPKNASPPPKECSSSPATEQSWMENDFDELREEGFGRSNYSKLKEEVRTHGKEVKNLEKELDE

SEQ ID NO: 923283 - protein, 316 aa, Homo sapiens
MPQKPYKASISGPWAFSSRSYTSGPGAHISSLSFSQVGSSSSFWSGLGTSMSLGGGYGGAVLDLDPNIQAVHTQEKEQIKTLNKFASFIDKVQFLEQQNKCWRLSGASCSSRRQLGATWTACLRATSTALGSSWTLGQEKLKVEADLGNTQGLLEDFNDKYQDEINERTEMGNEFAFIEKDVDGAYMNKAVLESHLEGLTDKINFPRELCEEEIWKLQSQISDTHSLDVDGIIAEVNAQYEEIAHCGQARLRVCTSSFSRTSSSRTMVGKLVSESSDVLPKRTTMAVPPSLPPLAAAPELVGEAAVQESAGNRRPT

SEQ ID NO: 923284 - protein, 324 aa, Homo sapiens
MQGYLIGSVLRKPYKASISGPWAFSSRSYTSGPGAHISSLSFSQVGSSSSFWSGLGTSMSLGGGYGGAVLDLDPNIQAVHTQEKEQIKTLNKFASFIDKVQFLEQQNKCWRLSGASCSSRRQLGATWTACLRATSTALGSSWTLGQEKLKVEADLGNTQGLLEDFNDKYQDEINEWTEMGNEFAFIEKDVDGAYMNKAVLESHLEGLTDKINFPRELCEEEIWKLQSQISDTHSLDVDGIIAEVNAQYEEIAHCGQARLRVCTSSFSRTSSSRTMVGKLVSESSDVLPKRTTMAVPPSLPPLAAAPELVGEAAVQESAGNRRPT

SEQ ID NO: 923285 - protein, 812 aa, Homo sapiens
MEPPKPEPELQRFYHRLLRPLSLFPTRTTSPEPQKRPPQEGRILQSFPLAKLTVASLCSQVAKLLAGSGIAAGVPPEARLRLIKVILDELKCSWREPPAELSLSHKNNQKLRKRLEAYVLLSSEQLFLRYLHLLVTMSTPRGVFTESATLTRLAASLARDCTLFLTSPNVYRGLLADFQALLRAEQASGDVDKLHPVCPAGTFKLCPIPWPHSTGFAQVQCSNLNLNYLIQLSRPPEFLNEPGRMDPVKELKSIPRLKRKKPFHWLPSIGKKREIDISSSQMVSLPSYPVAPTSRASPSPFCPELRRGQSMPSLREGWRLADELGLPPLPSRPLTPLVLATESKPELTGLIVAEDLKQLIKKMKLEGTRYPPLDSGLPPLLGVVTRHPAAGHRLEELEKMLRNLQEEEASGQWDPQPPKSFPLHPQPVTITLKLRNEVVVQAAAVRVSDRNFLDSFHIEGAGALYNHLAGELDPKAIEKMDIDNFVGSTTREVYKELMSHVSSDHLHFDQGPLVEPAADKDWSTFLSSAFLRQEKQPQIINPELVGLYSQRANTLQSNTKKMPSLPSLQATKSWEKWSNKASLMNSWKTTLSVDDYFKYLTNHETDFLHVIFQMHEEEVPVEIVAPARESLEIQHPPPLLEDEEPDFVPGEWDWNTVLEHRLGAGKTPHLGEPHKILSLQKHLEQLWSVLEVPDKDQLREALLARLEWFEGQASNPNRFFKKTNLSSSHFLEENQVRSHLHRKLNLMESSLVSLLEEIELIFGEPVIFKGRPYLDKMKSDKVEMLYWLQQQRRVRHLVSALKDPHHIPITLH

SEQ ID NO: 923286 - protein, 151 aa, Homo sapiens
MDKGSSAVSLQGKGPAWQPNGRMGPWGSDGMKELHSSFNAQFTHYYLLVPPDRIHCSRWRSRNTFYMFNFSIYSLPHKYLSSTYFMSESFQTAREQQEPRARGPRDPLYTGGKRGLEEPCLHLSAPQASESDEDAAAIFAGVVLATGPALA

SEQ ID NO: 923287 - protein, 514 aa, Homo sapiens
MSKGAATPLCVSLFLSQSPQKSVIELLPGATGRGGNSTARILSTNHTGPEDAFNFNNWVTLLSQLPLLLFTLLNSFLYQCVPETVRILGSLLAILLLFALTAALVKVDMSPGPFFSITMASVCFINCLLVNSPTDQWLHLRRGLNSGCCPRVLRVPREAHTCATLSRVPCVSCRHLLQGASESCLVEQQPPSLSSTAFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDENGIPSSPQKVALTLDLDLEKEPESEPDEPQKPGKPSVFTVFQKIWLTALCLVLVFTVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 923288 - protein, 153 aa, Homo sapiens
MARHNGLGQAMWLAAQTERPLDRQTTLHSHGSECGMCKLTVDLGVVCPGLPMSKSSWEAVVAVLMCLCLNLGMTTLVCAYEEQVESSSKIVCGRNPQGRPVGGDHEHPHFPAEETASGEPRPTAHGGTAKQRRKQEWTSEPALLCPLAALGRA

SEQ ID NO: 923289 - protein, 330 aa, Homo sapiens
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASANTEALMYPLYNSFTELAQFRLSQDDVNGIQSLYGNEFWAIRGNEVQAGYPRGIHTLGFPPTIRKIDAAVSDKEKKKTYFFAADKYWRFDENSQSMEQGFPRLIADDFPGVEPKVDAVLQAFG

SEQ ID NO: 923290 - protein, 499 aa, Homo sapiens
MRGLLSWDIGAARGWEAITYLALRKKTKASMHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 923291 - protein, 168 aa, Homo sapiens
MWNYESIKSLSFLNYLVSEIFSEDYSQNPSENSILKATQLELLFVFFHGFKAQLEVISPHQVPQCLLLLSSSSALLSTLDEADLIIVDKVFNVLLDLVCQYFIEDFRIDVCWSLLEVHSRPCLPSYHQQRLQNSKDCCLLLPLEASSQRGTCQMPAGALLYEVSVDPC

SEQ ID NO: 923292 - protein, 168 aa, Homo sapiens
MGAAHQHVTCIHMEQNMHIVHIFPSNRQDPQLQVSWSLLEVHSRPVCLDNSSGGCRTVDFCELQMLLSDRSSGTFVSEEYPAESLAECWENDCSLQICQTGTLKSAEVTAVFLFVCALPPEVEPTEEGRSPCAVVVSTQLELPGCFVYLSKPGQWHASLPQPRCCLEV

SEQ ID NO: 923293 - protein, 604 aa, Homo sapiens
MTEHFVQLTSRQGLSLEERRHTEAICEHEALLSRLICRMINLLQSGAASGLELQVPLPSEDSRGDVRYGQRAQLSGQPDPVPQLSDCEAAFVNRDLSIRGIDISVFYQSSFQDYNAYQKDKYHKDKNTLVVWEEVLKAESASHVVMAMAMTLQAGGTAHVKPSRCEGLGVIGKGGPMARGFINLGTSENKLCMDLMTERVRMFWAVLGPTPSRLSPPSVLLSYGRYRVRKGARKPQGLSGSVYSLREEVARFLTYYCRAPTRLDPENVVVLNGCCSVFCALAMVLCDPGEAFLVPAPFYGGFAFSSRLYAKVELIPVHLESEGKKVRGLVLINPQNPLGDIYSPDSLMKYLEFAKRYNLHVIIDEIYMLSVFDESITFHSILSMKSLPDSNRTHVIWGTSKDFGISGFRFGALYTHNKEVASAVSAFGYLHSISGITQHKLCQLLQNTEWIDKVYLPTNCYRLREAHKYITAELKALEIPFHNRSSGLYVWINLKKYLDPCTFEEERLLYCRFLDNKLLLSRGKTYMCKEPGWFRLIFADELPRLKLVSSHVAEEEGDYGEGLRRISNPSVHWENKMEPREAVAMLSGEEPGLFNFCVVAWDSM

SEQ ID NO: 923294 - protein, 187 aa, Homo sapiens [sequence omitted]

SEQ ID NO: 923295 - protein, 153 aa, Homo sapiens
MSGYRNSANGWKCSSLCGIRLLRCRSPEECQGPVNTVKVVGDRPEGTCLSVQLSRIPIYLCRKGQWLEVWGSFTERVASKLAFEEWEGVGQTLEMEDSIPGGGNSMFEGTVGGGLGAGGRVRNLARGGEAENRATTKSFAGKAGRSHLMIGWG

SEQ ID NO: 923296 - protein, 134 aa, Homo sapiens
MGDAAKSQFKEYEFREDGKSVANFVIYHSLLFDHNYSHCSHRKNMLTTIPRPPNTSCNYVIRLEDQDLVVHIRFVCDIMDVVLLNPDTDELKTRSWLFLQFAIPPQRPPSSQSGRPSFPSKFYLYVTYVHIKNI

SEQ ID NO: 923297 - protein, 145 aa, Homo sapiens
MDTIKKQKISVTTDVKKLELSCVAGMYLKEWNDSCTPMVIAALFTIVKRWKQTQMSVKRMAKQNMEYAFNKIFSHKMEQNFDTHYNMDGLESIMLNEISQTQNKYCPSPPCPCPTPPLLLLWCGTKKALVWKSGGLSSSPDCAKV

SEQ ID NO: 923298 - protein, 222 aa, Homo sapiens
MTVNQRCPLPFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRKGEEDVGAPNPCVAAQTDLLSVQQTVLFLSWKFLANGSLL

SEQ ID NO: 923299 - protein, 382 aa, Homo sapiens
MSIRVTQKSYKVSTSEPRAFSSHFYTSGPMGSSSFRGGLGRGYGGASGIGGITTVTVNQSLLSPLNLEVDPNIQAVRTQEKEQIKTLNNKFASFTDKIRFLEQQNKMLETKWSLLQQQKMAQSNMDNMFGSYINNLTQQLETLGQEKLKLEVELGNMQGLVEDFKNKYEDEIHKLTEMENEFVLIKKEVDEAYMNKVELGSRLEGLTDEINFLRQLHICGAVHGQQPSLDMDSIIAEVKVQYEEITNHSQAEAESMYQIKYEELQTLVGKHGNDLRRTKTEISEMNRNISRLQAEAEGLKGQRTSLEAAIADAQQRGELAVKDANAELSELEAAQERAKQDMARPLQQTESRFPFCSTNYPFNSHWCIFAARSAVLFLSTSR

SEQ ID NO: 923300 - protein, 145 aa, Homo sapiens
MQAEGMAVAGTGHCGAVGRKLVSLDQAPKVMAVFVVRLEKQGPEGTGQTVEKIQGEEESEGAQFELPTCACVRVRVHKCVLVVSGGKAGNKRCLCLQEDVVGGGGKWPLEDESGTPGVRRAQASPSSDLREGVQGQKSLQLSSAL

SEQ ID NO: 923301 - protein, 145 aa, Homo sapiens
MDEPQGMRFRKAGTLAAPKPPLFLLPSHHHCSPPATSLGKKVSDQSSRTKAERGTLQGKTVASSTQTPRADTRLAAIQTRQQVCSGAFRSTEWRAAHGDRTEAATELLLLLDQTPALDQTTTALAVQVQLLTQLGAHPETGSPHS

SEQ ID NO: 923302 - protein, 151 aa, Homo sapiens
MEAWEQVDLGHKEPFNNRLLPVTDEMDVCSLQARAAGACGAPSMETVLEEQHRTRKGFSCRLLSEVSRSIQPPAAAQRVACQRVPPTPALQQTFLQPGRLGCTISNKVWVSALGVGVAGRRFQVSSCLRCSASALEVEVFLSGRSPVTVTG

SEQ ID NO: 923303 - protein, 309 aa, Homo sapiens
MKNRTMFGEFILLGLTNQPELQVMIFIFLFLTYMLSILGNLTIITLTLLDPHLQTPMYFFLRNFSFLEISFTSIFIPRFLTSMTTGNKVISFAGCLTQYFFAIFLGATEFYLLASMSYDRYVAICKPLHYLTIMSSRVCIQLVFCSWLGGFLAILPPIILMTQVDFCVSNILNHYYCDYGPLVELACSDTSLLELMVILLAVVTLMVTLVLVTLSYTYIIRTILRIPSAQQRTKAFSTCSSHMIVISLSYGSCMFMYINPSAKEGGAFNKGIAVLITSVTPLLNPFIYTLRNQQVKQAFKDSVKKIVKL

SEQ ID NO: 923304 - protein, 156 aa, Homo sapiens
MTQLVDVSQPSPASPVLIQGITIKMSMAEGMKVRHRLTDNGSPHQGWSGYAMAEFAILRTLGSLWRDSHEEEPKPASNHASQDTVHISKTEDNLMLGGMIDGDYIIDIGLSYNGSRKVLTLKPKRENIVILTKPQTNQAKPTPKGLSGVLVAGENQ

SEQ ID NO: 923305 - protein, 120 aa, Homo sapiens
MISHLVSSGQLFSVYCCLQAAQEQFHKRILIVCPKGQGLAPKSVIHLLDLPQAPVPLTLSLLQSAGQLGGPVAELQRGPLGEHLLPLAFRTSDKWVEAANPKGLYVASQIQITTRGLFLL

SEQ ID NO: 923306 - protein, 145 aa, Homo sapiens
MSHNRGAVMAMKEKSCLAIAADRRFGIQAQMVTTDFQIFPMGDRLYIHLARLVTDIETVVQCLKFRLNLCELKEDFMVSGTCAEQIYEMCESLWECNMDPEQLFETIFQAMLNAVDRDAVSGMGVIVHITEKDKITTRTLKALMD

SEQ ID NO: 923307 - protein, 128 aa, Homo sapiens
MMTMAVLIEFTLSIETQNSASWAKPSIKQQALPELDGFPRTGEQIQQTQNDYRRRKQAKTNVTPSGFKPNKPSNPNQGKGELPFHRTHLTGFSTCFPTSTLETHFNPKMKTMGQARWLMPVIPALVGG

SEQ ID NO: 923308 - protein, 134 aa, Homo sapiens
MLSFFYSCPWTSDSRFLGLWTVELAPAVSRGTSGLRPQTGGFTVGFPGFEAFGLGLRHTTGFSLSPACRRPILGLLVIVVGTQAGEGQLEERKRQVSLVFTVVREWDRDEEGEKLLQKDKSSKQRGLLKTRRKI

SEQ ID NO: 923309 - protein, 192 aa, Homo sapiens
MTLAHSIRKIEAVRRCGIQVILQVDILFGYGLRCIGCKNIHIGIQVILQVDILFGYGLRCIGCKNIHIAPFSIWLSECFIKWNVRILDSKTYSTKQTLLVGCILDVYPGTNYLTKSDSCGQDTKSDTCKVEMKKTWLSNKEKTELQTSHNPRDRYLGKMPVAPLQNCDSQVSPNIVRCLLGGIIIPSGEALI

SEQ ID NO: 923310 - protein, 149 aa, Homo sapiens
MGVYLALGFMGVYLALGSTWPTGVGLVLVSEMTCSKAVSHYNVPEGKQWQLEKPFSKSVSSVKGNSAVVCTNTKSPVQIQDHFNYLLELANSYQQLKHDISFKTSGDHECGGAGKNQPKTQEAPETQEAHNYASHSSPAAEMPLITVYF

SEQ ID NO: 923311 - protein, 124 aa, Homo sapiens
MSLVVTFLSHKIVVGENYAIIPSRKQTLKTSVEELILETGPTDFIVSWFRSCTLDCETMAYICKGINASIQKSQELNAGIKSDLYSQVSTLIDWQWLFGELDCTEKDLKGFGVGKYAINWPHSE

SEQ ID NO: 923312 - protein, 134 aa, Homo sapiens
MLSANSNSLISSLLDSQTCDTALASPKTSILREDAAASLKPQKSTNSAIFYWSTRSRSAQFQRKGIHIPPLTGEECQRNCGQAYSITGPFQKPPLAHCTCLLVTFKLNCKLRSLSQYCDLQSQHSMIDEYLFNG

SEQ ID NO: 923313 - protein, 150 aa, Homo sapiens
MMLAFKEHPWEREYAPRGRSIDGPPVIDLRNEIDSNTIIVGDFNTPPTALHKSSRQKVNKETMDLKYTVEQMDLTDVYRTFHSTSTEYTFYSTAHGTYSKIDHMIGQKANLYKFKKIKIISSTLSDHSGIKLEINSKRKLQNHANTLEIK

SEQ ID NO: 923314 - protein, 181 aa, Homo sapiens
MTPGFSPGPLAIDIHRFHIYTAYDPKRRWCAILQQEQLMDGASHRDRVDPIYNLPRNMQWINETGVKNTSGLPGVKALKSRASGRTFASACFSLTPMSLPRAGCRSDLGENPEQEPSSYAFCLFSSISSSRRKEPIDSALQHLSGTATAQKEGFCYNLKFSPAPCAQEQLQQFPQPLGTIR

SEQ ID NO: 923315 - protein, 137 aa, Homo sapiens
MAKTSYPQPLCQQAVKATWLFSAGAGSTLKAAPWSRPQHALPHRKVLQKAIAILNSGSVLGLLSVTPGARTGICLSRVLTLLCSQTTRGFWVLKGGVLSRRDLEGAVWASKRVVEEEQRAMLRAGSVSSKELQCKWL

SEQ ID NO: 923316 - protein, 361 aa, Homo sapiens
MQALYAGAGGSGSRISVSRSTSFQGGMGLGAWLRGWLGNEKETMQSLNNHLASYLDRVRRLETESRKLESKIWEHLEKKGPQVRDWSHYFKTIEDLRAQIFTNTVDNAHIILQIDNARLAADDFRVKYETELAMHQSVESDIHKLRRVIDDTNVTRLQLETEIEALKEELLFMKKNHEEEVKGLQAQTASSGLTVEPDAPRSQDLTKIMADILAQYDKLAQKNLEELDKYSSQQIEESTTVVTTQSTEVGAAEMTLMELRCTVQSLEIDLDSMRNLKASLENSLREVEAHYALQMEQLNRILLHLESELAQTWAEGQRQAKEYEALLNIKVKLEVEVTTTTTCWKTARTSILVMPWTSATP

SEQ ID NO: 923317 - protein, 149 aa, Homo sapiens
MARESATCFTDKWSKATVRPQEGREGTWRINPLTVPSPTPDLLLVTTISSTHQKPANKVVWVFLSIKVASQTSEQDTEGQRMDLGAKVEEPGHTQESREKGTHHPTPTITNIFPFLFHLSLIFFLEYFKANPRNHIVSPKISLVCIYNK

SEQ ID NO: 923318 - protein, 167 aa, Homo sapiens
MRTENDSQLWFCQMVFLFTEEYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMLLVFVADLKLRCHFRWFLVNLIQYLADYVPDAIASAVGNQGRVVK

SEQ ID NO: 923319 - protein, 145 aa, Homo sapiens
MSPAVSGLSRAHLLPSVTLSTHRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENHFHGTGDKECKIIS

SEQ ID NO: 923320 - protein, 152 aa, Homo sapiens
MRSLSKHNVLTLKQVRPVAARPSKTQCSTVELAIHNGPIESGSRHFPLWAAQIEELGLDPRDWWTLDFQTQVTCPWPQKNWWQICFLSVALSTAHMATCVQQLVTRPALSWQQHSKYRLLWTSSNAVIWMIEPTLCYAHYLHQLSNFKIQSL

SEQ ID NO: 923321 - protein, 156 aa, Homo sapiens
MKLLPYACCSPRRRHNHKRSESAHFFPCGTVCFGCLARKLGLYLPIILILSWGVIGIELLVWKFLLRTQRIEECLEAELWKDSSLRPLGIWLLFLGAVAGAPGTCLSRKSSTQFCCLHVPDDHRSLLRRVESPVAWGSQESCRGKTFSSKIRTKDG

SEQ ID NO: 923322 - protein, 130 aa, Homo sapiens
MRAHGAGLAGSSTCSPGAGSTRDCKYTNQHPVFSSRFVSAPIDTLYLAALVRTCSRFVSAPIDTLYLAALVRTWRVFMSSSRIVNTPIGTLYLPQGWLVIGLSQSLCTGLSKISKQCNLRQLSGRRYWNL

SEQ ID NO: 923323 - protein, 154 aa, Homo sapiens
MVPLNEKRLRIAAAGLFALLVSPPQTSIEPLAAPVNITVVPRGASTAPSCRLQPSSPQLLLHAGGGAAGSLASCGRVGRSGSLLTCPSLSFVLDLFPLNLAADEDGAPAEALYSIQTNSGSCTDSPPQGWSCQGSEATTTQNSGPHYTRVLASS

SEQ ID NO: 923324 - protein, 150 aa, Homo sapiens
MWASHGILLSLSKLFFPTGMLLIPNCCLPKFKLLLGLQGPDEIIFLANPLPPRQLGATLTSASICTLPGWLPVLCLPTWGCGGSIPHKSADVDLGFCENQHPVPAISPGSFHRREVAGRNAALTLKGTRGILPVRVHTAVGLFTSAPPQV

SEQ ID NO: 923325 - protein, 296 aa, Homo sapiens
MSACWVLEMQQGTRQTRSCLSITFNSKEREVDTVKIKPNRQQIKTGSTSPPSKPEPDLGINVNEHGHAELLRSHSLPSDTHFLSILQYAYNVPGCELSGILEVRECEMMMMGMVVIMIVMIVVVVVVVAMMRVMLMVMVMGDNGDDSDDDGYGGDDADGDDDGYGGDDADGDDGGDSDGEDADRDDDGYGGDDDGYGGNDADSNDDGYGSDDADGNDDGYGSDDADGDDDGGSDGDDADGDDGGDGNDDYIMMIVVMVMMMFIIVMMVVMVVVVMMMMMVVMIMIMVMRVRIAKIY

SEQ ID NO: 923326 - protein, 167 aa, Homo sapiens
MINDRVVAQLHTHGPSGETPLDSRLKASRKSGEAQGHRSNLQSFGLRKVMLEILSCFCNAGSCVKEHLRQQPSHLAAFRSAWKEATASFHSCSPSKRWKAMRLLNAFFQRISGPPLPPPSLAYSKVQDPFPQCYSFSIAIVDFYLKGPIATVNSFRVELFGVLLWKS

SEQ ID NO: 923327 - protein, 145 aa, Homo sapiens
MAKGQQDSARMAADSLVAAPLRNFSTLTLPCLCRSASKCYSLFQDSLDKQERRSLSKKAAKPGRQPSPEPNYAGPLMSDLQPLNDEKQIPVVYKPPSLWYFVIEAQRKEAWIHYSFLEVAPEMQILVNKYTIGTICQLVKYEQTL

SEQ ID NO: 923328 - protein, 171 aa, Homo sapiens
MKMKTFMVIHFHLMNKILPLFPRSLLSKDSKEAFLLESSGATYLCHSAPWGPTWRLKRKQTNKTQQAALQPQYSLLRVYPACSWTGFALDTQNIPPGACLDQSWYLDHFQSRGPICSPVVGHCTLLYTTAASHRTAELNCPHVASPSVFFTVHWLKKIAELSPILHQADST

SEQ ID NO: 923329 - protein, 135 aa, Homo sapiens
MENNHCPASSESHPKPSSPRQESTRVIQLMPSPIMHPLILNPRHSVDFKQSRLSEDGLHREGKPINLSHREDLAYMNHIMVSVSPPEEHAMPIGRIAAFIEHLLSARVIKRCRSKAEGRCVLTGGTKQGFAGERA

SEQ ID NO: 923330 - protein, 182 aa, Homo sapiens
MGKQGGSWAACVSWVEFQVGMMAKSWKWLVVTAAQQCKCANATELWNGKVMVGIGGAILGCATEPVKYCRVKRQRQAGPAIASQRAAKPTWAFVGGRNTLRSAAALDSHSSANPIVNCACEGSRLCAPYENLMSDDLKWNSFIPKLSPPDHPIRRKIVPWKLSLVPKKVGDQQFTVAISLWR

SEQ ID NO: 923331 - protein, 189 aa, Homo sapiens
MIKLRSTGIRPTALFSSLSRPAGMQSARVEAWEPPPRFQKTYSKAWISRQEPAPGEEPSQRTSTRVLQSENLGLEPPHRVSTGALPSGAVRRWSLSSRPQNSRSAGSLNSGSARPVSTQHQCQPMRAAMGAKLYSLRGRATQVFGRPLLTLAYFGEWPKSRTLSTKYWRRCGATGTLMAGENANDTVTL

SEQ ID NO: 923332 - protein, 132 aa, Homo sapiens
MKEASQGKRTYLERTVFNLLTVGIWPCNQATPSLRAERSCWEDTGRVTQFPCWKEELGCLLRTLSSLPRSGSYQFPSLENEDDNISSLIGLSGLISAFNISMSIVNFFTYRFVMGTKRLQTNKALRAVSETW

SEQ ID NO: 923333 - protein, 149 aa, Homo sapiens
MFLSHSSKNGFVLGSGAGHRWIGAEKAACGFTLECHYPGCGATSQAGKLELGSQTSAVVQADTGYHRSATSRCVSLPRLSCSPANRSVGNSQDYGCDKESCYKLSRMWLLVNTCTHFYGAYQEWNSWVTGNCPTIFQSNCTILHPACTV

SEQ ID NO: 923334 - protein, 196 aa, Homo sapiens
MSASSSSTSSRYPSSASATSQIFFGPNAAKGSLCSPWMVGLGNQPPCCKEAQAAAWRGHVALLKRLRRSGLCPAKLWNATLLWNGPMQNTHHPTETPTPGGGQKSVVFSDFLTQASGMVKLLGPTAEDSTREIVNAPRTAGSTLKLSSHFEPNCVCFQKYFFLLKTRGTGLFEGHFSSGFSLPGKSFRQAAGDRGK

SEQ ID NO: 923335 - protein, 191 aa, Homo sapiens
MIIVMIFSITIITITIITITIIITIMITITIIIITITTTIIITITITTIITNTITTIIITITIITTIMTTITIIITSSPSSHHHHHHHHHHHIHHHHHHHHHHTITIITITITIITITIITTIMITITIIITPSPSSHHHHHHHHHHHHNHHYHHDHHHHHHTITINIITPSPSSPLPSPSPSPSSSSLPS

SEQ ID NO: 923336 - protein, 133 aa, Homo sapiens
MCSYHLCRVVPSGSVLGLMEVWVPNRQEASGRQTPPQEEGAPAFHLRTLRAGGAMPIQCQLCTFYSKDTGSGRSCFWGRRAHFHLDTFTNKHPMYPTFLELSNFGLECPDFPFEINCHGTCRGQCSPCTAGII

SEQ ID NO: 923337 - protein, 459 aa, Homo sapiens
MIPAENIENVVKHVVLVHQSVDHYSQQFLQKLRRSNYVTPKNYLDFINTYSKLLDEKTQCNIAQCKRLDGGLDKLKEATIQLDELNQKLAEQKIVLAEKSAACEALLEEIAVNTAVEGGSGWARVSVGRGDERQKEEIAGSRSPLGLKPTFEDCTLLRAGAASASPLSPSFTHPLSYPAAEEKKKLAEEKAMEIEEQNKVIAMEKAEAETTLAEVMPILEAAKLELQKLDKSDVTEIRRRSVFLAPHTGLAAERLRSWVSNGLPFWAPAGAVHVPCASYFSASVLPVKAEQRSLSKSFAKPPKQVQTVCECILIMKGYKELNWKTAKGVMSDPNFLRSLMEIDFDSITQSQVKNIKDGIGWNRQLMVTRGKQQPHDVTQGEWLGMRGGSRLLKTLNTTTEEMEAVSKAGLGMLKFVEAVMGYCDVFREIKPKREKMYMYMTASEYTAFCNLEIQYCRND

SEQ ID NO: 923338 - protein, 173 aa, Homo sapiens
MPCREGRFHTPSASSSLRASRTETVPFKKGSSVSHHIVTLVSEENADQRNVHKDRDSYYSIERDEKMGARCITISPGLAVEVEPPGRMLSDVTGLGYQGAAAPAQNPYRALAARDPGNMVVGFCCSGRRTRKSGRHMQQAQPGVSHSALQRAASMLSLVHCGTPGPTENVFVE

SEQ ID NO: 923339 - protein, 224 aa, Homo sapiens
MGEYKLGLEVASLQIRETRQNKTGTPKWDNCEDFYEEPIQRHVSGTKKNQLGAVWDPEELGEIMVIRAQLDQQDKTTADSTVASSEDCSHCQPTPMRKEMGRHPVLTFLCLLISCQCLPWAESPRNQTAKESMLCSMQAQGRVNQTARQSMLCSMQVSLSGTGQSGEGIWRHKWGVPSRCLWEAAVIPSGDVELSSSLRFLELKEQYPWPQSPSTCKVSQVSVG

SEQ ID NO: 923340 - protein, 336 aa, Homo sapiens
MGGQAETLLTSQMGLSVSVLCKAMWLYLAVFVGLYYLLHWYRERQVLSHLRDKYVFITGCDSGFGKLLARQLDARGLRVLAACLTEKGAEQLRGQTSDRLETVTLDVTKTESVAAAAQWVKECVRDKGLWGLVNNAGISLPTAPNELLTKQDFVTILDVNLLGVIDVTLSLLPLVRRARGRVVNVSSVMGRVSLFGGGYCISKYGVEAFSDSLRRELSYFGVKVAMIEPGYFKTAVTSKERFLKSFLEIWDRSSPEVKEAYGEKFVADSEQMEQKCTQDLSLVTNCMEHALIACHPRTRYSAGWDAKLLYLPMSYMPTFLVDAIMYWVSPSPAKAL

SEQ ID NO: 923341 - protein, 134 aa, Homo sapiens
MVAPMLLPNSYLAHLYCGSMPGPSPQDQRVHLSPLHSKEVDYKPSSAAKSTVSVHMCSNLTFSSVMVDELPSYSVSRQRLLKTCPGKHQWAATEDAATEHESIFSKHHGMPGILDGDQRQFLAKHLSWETPGSG

SEQ ID NO: 923342 - protein, 124 aa, Homo sapiens
MSPLRANGRSKAVFQKESSYLQRMAGDSPKGAYQRLYTHPYLPLTFQTPLDLLNHMAQVAEKLAQQLGPLAKLSFVLGPTQNKQLLRLLGQLIQKREREQGGCHNAFYYLVLPITDCPSATFRS

SEQ ID NO: 923343 - protein, 136 aa, Homo sapiens
MAVATPDRPPLASKNQMHLFRCGNETTRWDRLPRKTPTSQRSRVEPQSFELFAAGRSLALPLAVWNPEFQWLEIIANRRKKWKNPLKAQNEQFLLRILHPDNTTPKIKTELIPCKQTLLEFVASRFTLQEILKELL

SEQ ID NO: 923344 - protein, 139 aa, Homo sapiens
MVVRNLLKGFDQNADSDRDNEVQADVVLDGDEELLGTGEEASLAMSGCPPRILVQGQSPPGEPLLGQCRREMWGRIPPHRSPTGAMPSGADFVIYLGSPEIPYEWMKFCSVPKLECSGAILVHCNLCLPGSSDSPVSAS

SEQ ID NO: 923345 - protein, 173 aa, Homo sapiens
MVPCILAASAPAFARCQSTTQAQSIALEGASPKPLQLTCGLGPAGTQKSRIENGRSTYNLHQAPGKATNTQHQPMKAAKMGLVPCKATGVQLPKAVGTYLLHQHDLDGMVVAGLRQDPVAVLASGLTQHNHSSDDHRGACVTPLSALGGSEWSGRLCHCYTYVDKLYGIPQFS

SEQ ID NO: 923346 - protein, 152 aa, Homo sapiens
MALNMNFLGSTLTNNLLLKGPTSQCYHIRTSAYKFGGNTSIHSMVHPFCLWNQGVGSKCKCMNPYKMAKEAVEGDLTVHNRGEGKVKRDSNMLALKIELCPGKTLSLDQLNYSPLCLSSTELLITARQNSHRLLGRYCKFTMDTCTDFSVAT

SEQ ID NO: 923347 - protein, 176 aa, Homo sapiens
MGVQVVPKSFDREPTCSMQIHREKENQDLKDKYEQKSGESHPAWLLSSEHRYAVVPLLNWVGFLAVVVVRYRLTDLQPLSDTHGHQMWTQVDQSSGPGLCAYMPTVMVVGPSQVLRIRNITFTWVPTVVVAGPKWDSPCSVPLAVLYKEFPISSGLTAIVRSRQSSVSGLIMDWLV

SEQ ID NO: 923348 - protein, 199 aa, Homo sapiens
MELPKALGAHPFHQCDLDGTALCPLVEGMCFTGGKPTSLGCPDSSELPGGKAKSAGPHRLQPPLPLGAQAKGDPGSVPEPLAGVIEVPSGTPHPAVVSPSAGCCPSLKEFKGPRQHAAAAVVLVDTPHDCLEIYPVACNSQGSTTGAQESGVLQGTGDLLGLTKAVSQCAAPHSRSRRERCLISGRKPPPAQAAPLDIL

SEQ ID NO: 923349 - protein, 163 aa, Homo sapiens
MGPCSSPLLLENRQSYPAQPQPHNLVLPPSPASTISRLQLKSYISPKIQWRGVGVLSWQSKQLSNVNLSQVPFISLHGHPPQNGFFLRLVVPCWWGIEKEHFLPFLSPSTVYGPYAHTDPHGNPPTVCTPPFPAAQTDQHAETDAHNDAKLRFQPRIKKDEKF

SEQ ID NO: 923350 - protein, 135 aa, Homo sapiens
MQCTDQEHTGQQMSGVPHGNLGSGLRTEFRGRVTINSWPVKPLSSRPNLPHMTPRYDQVGDHRFPRLVKTFSIPPKPGQPKQNTDSFDPESPGDGKHSLHSHLFTVAHSGSPQSVWARRCPRKPTTANPHPSQGN

SEQ ID NO: 923351 - protein, 168 aa, Homo sapiens
MQMLRRVTDWLFKKKSEIIYQNGNKTEKAWQRPLLAAHSALTSLGYTHMLSRRAQRVQEPTVPGIIAMQRPWLLGLSEKLLKKRTLCWLLGSDGLCQLHYLQRKEKDETNKNKSKGTFSTWLYSQQEKSPLECSPCSSPVTFQEHDHIFPTRLLLFFLASTLISCLYF

SEQ ID NO: 923352 - protein, 133 aa, Homo sapiens
MAAASKKVMILRISTQDQWSVQQERDKGGMGQAPPSPLGTIPQTPSSGMRLAWGCLRGLYNAQLQTRPSFAFGKAVRFKILTLSNPDKMKPGKTMRGAPYAYLPDNENHLRRPPETTALHQGHCNLRHNIDTL

SEQ ID NO: 923353 - protein, 155 aa, Homo sapiens
MSCRQNPSDTRLKKEEALFSREVGRLASQELSSLKKEFLALLKAYNPEGEPRGWQGILHRKLIPEQDAQRGGKFPESHPEDRRPTVLDSPARLQSKGDVSTSHTVKFVELLSCFMNGSGDFKMIHMLEVKPAVLDVAFITEQAHWDWKADSEDET

SEQ ID NO: 923354 - protein, 136 aa, Homo sapiens
MTEQDRISKGEGGRGRGGGGEGEGEEGEGEEKQNKNHFLEQTLLQQDYVKAVETSGQQPSRKTQDEKGTDFCYDNVRVSCGHQGQGISHPSLKDKLEPTLLFLLLSDREKLCFSVHVSANDHQLSQAYIPSFQEES

SEQ ID NO: 923355 - protein, 146 aa, Homo sapiens
MLGFHQIINSQSLLGHQEDLEEDYSKQRAAIAEPCCASISSSIMAPRKNRWTWKVTSDHARDKIKDIGARLDVNSGEHKGIRDNPQDSGLYSGTYGDAIQGDHMGVQTLPADSELRQGAEPDQGLEDLCGLQQKRPGAQPGRFGRA

SEQ ID NO: 923356 - protein, 137 aa, Homo sapiens
MQKRLKPPVRGGQSVKAVSVDICEIGEGWGSIQGKHTKQEDGFSIQSVLSPLSDSILAEKTVIVLDDRVAIVELGVQLVAGMSLSLQPHRADKRAIVSTAAALDVLLSPQQVSIPGALRPWFAMKKRVKFTSYTSIL

SEQ ID NO: 923357 - protein, 134 aa, Homo sapiens
MDSWMADPSCVYYISWVICAGLEFVRITPGPRRDGRVTLNVVLSFVPVSARKTLNECQMEKRLCFPGKDQNCILRFEFLSQVMSSSSLAGLFLGASGVKESRFIKNHQLQIIWMETLPNHRDVCYHPHTKQLGN

SEQ ID NO: 923358 - protein, 173 aa, Homo sapiens [sequence omitted]

SEQ ID NO: 923359 - protein, 142 aa, Homo sapiens
MGSLSRFQLLGKAQSAHASDNRSDSFPLIESLHRAPPPRIPANIMHFTVCLAMLPAGNLHSWCASPGLCLALELATGLALPTRPGGLCLAPVTSLNFTPTVAQCSARGWARCAEICFHLGAGVWRRGKWWHPKTQRCQQLAW

SEQ ID NO: 923360 - protein, 358 aa, Homo sapiens
MPTGEMLRLESPAWHWSNDRVPVEKSLHPHKGAGRHQDVSLQVMRPQQAEAEPSTLGLGGVVVMVVVMVEVMLLLEMVVVVLAIVEVLDDGGGDYSKGADVDGGDGVGDDVAGGASGSDDGGGVMMLLVVLVEVNDVGGGDGDGVGSDSERIDSRGDSGGDNGGVSDNGGGGVVEMMIVEVMVVERMVVVFILEVVMETVKVMMMVVVMIVEVMVMEVVLIVKVVIIVEVTVQVMMVVVVIVEVMIVLEMIVEVMVVVVIVVMMVVILEVMMVVVVIVVMMMVVVIMEVMVVIVEVMMMVVVVIVVMMMVVVIMEVMMVVVVIVVMMAVVIVEVMMVVVVVILKVMMMLEVIIQASLL

SEQ ID NO: 923361 - protein, 165 aa, Homo sapiens
MTWLSPKSNFSAINTMESRLEKIPMQRHILKIDPITRSIHQACFNGVHVSLLLASSTPEKVMNYIPPAARLVTTQFRNLELHTPSVPTAPAVLKGISQPEEKPKQNKHGKAGRKVGGLLRSSGRSWSGKSSSPTNLPSLIPDFTFHYITYLPTLYTQVSYPGVKN

SEQ ID NO: 923362 - protein, 159 aa, Homo sapiens
MPSYQRTLYLACISLESAVSGRITCTTALENLRWEEVKIMTPEQPVQISPTNGVPLMTPFMRKETPSAVLSTQKDRPNLHWLQLCSTLMNTVMEDGCKDKISAPVSCAPAKLASELSLGDTRSKNLSFSHSYYLGQENVWNFVFWQMFLSCLCSDKIVG

SEQ ID NO: 923363 - protein, 148 aa, Homo sapiens
MVITFVLERGDNSSRVFSASRVPSCPCREYDVNMAEIVGAYLFLSNTVLELTSEMTLLPFMGEGLGGDKMAITGVSAKEDEAQVTFIMAELQVTCGAEKVAGSDVQALLQCCVEQTDMAVSLWACALAQSLPRQLPPHGHLASLHFTF

SEQ ID NO: 923364 - protein, 141 aa, Homo sapiens
MAAASKKVMILRISTQDQWSVQQERDKGGMGQAPPSPLGTIPQTPSSGMRLAWGCLRGLYNAQLQTRPSFAFGKAVRFKILTLSNPDKMKPGKTMRGAPYAYLPDNENHLRRPPETTALHQGHCNLRHNACFALQGPAIPD

SEQ ID NO: 923365 - protein, 143 aa, Homo sapiens
MCYYKEDALHSRPQWMRIANVYSQALRNTTNNAIRSKQGYRPGAATDAVVTGGLFCTGGKDKEELDREKPEMTGRAGAPRQAAMCYNLCGPFASSRGAAALHQQGQTTSVTALFGDPNTCPVPKKNEVMQMNRKMVNMENFLE

SEQ ID NO: 923366 - protein, 170 aa, Homo sapiens
MGVTSRGLRDFEIGMYALLYVFFPAILVFLINCVAFSWKYRHKRFAVSQQGNVPHSHNWVWLGNEVGLLENRVDITLPSEECTTMIDRGLQFEERNFLLNGSFQKTFHSQLFRLVDYVYEKEIKNEPMNSSGPKRKRVKFTSYITILPEDGSPYTNSILFDSDNIKCDVY

SEQ ID NO: 923367 - protein, 211 aa, Homo sapiens
MVFPFSHFHALTPQLGYLDAEHPLKQQDCMSLPARHLTVIKICKEQDVEPPLLVQHEHFVVGAAKMTQTQSPPQVTHSLVQYTKAVKAKGQTIGPSRESGRRGSIYLNSCDATSLKKGEETMMPSWRRTLAGSENCFITHPLFTTLVYPKQPMEQRIGQNAQTKQEGMKGFIENESTLHSVGVGLSRGAQRPHCRILGSLNIPKNLNNLCR

SEQ ID NO: 923368 - protein, 144 aa, Homo sapiens
MVEEALRGRLQAEKPGSQSKSQNLKNWEADSAAFSLRPKAREPLANHGSTLAADWMVPIQIEGGSASPSPLTQMSASFGDTLTDTPRNNTLRPSVQSSSHSVFTIRHCGWGLQKSWESGDLGPSSLGSMMRNLHGVIPTAQKEF

SEQ ID NO: 923369 - protein, 143 aa, Homo sapiens
MLEQVLLFQPLNALLSPPNFHHPTPCSPILMLGLLQIQHGSWNREAADITRICGGKCWLPKNTLYLLMAMKLSLANEIIEAHCGSHGAEIKESSGLYSFLEAPGRTRFPFLLQLPEVPEMKMWTSLRRRRDHSTYDKQPTLSR

SEQ ID NO: 923370 - protein, 141 aa, Homo sapiens
MAVLLGSNTRTIARAVEEQAAANTHGPFLCIWETPYCPKGQHQAKTPSSDCTGQPRCQTHCPNPPTFVQCTAAARGLQLGVESGILTDSGADTCKYDSETFFPQIKRGTLKEHSSLSSSFLFWTWLGEKALPGAAAAFLRP

SEQ ID NO: 923371 - protein, 135 aa, Homo sapiens
MGLKEAGRASPDQLEGFTWQQVCAGPQLSEQYCRVDAPWDSPRPVTNRSGRTCALLPHPSGDSSELCPAPSHGRAQRDWVPVAHSSKWLINILYVIVNLCPKWTLDAQGLASASISRGSQPKMLLSKRLIKFPKS

SEQ ID NO: 923372 - protein, 179 aa, Homo sapiens
MTLHLGTEKTFQPTIRFDISVWDGMPSNCLETSILCVLRGFIPLDNCLNYRMRMKAVGSLVDTPLPLAPVDTEVLNTAILTGKPVSVPVKVVRVQEDGSVVYVSESVECKSANEDVIKSVEFSLMSVQEMPSNPQGGYSTDSKDLMELLQEKCGLRKFCGLGYREGRKCEFGKMKTVVI

SEQ ID NO: 923373 - protein, 388 aa, Homo sapiens
MNRHHLQDHFLEIDKKNCCVFRDDFIVKVLPPVLGLEFIFGLLGNGLALWIFCFHLKSWKSSRIFLFNLAVADFLLIICLPFLMDNYVRRWDWKFGDIPCRLMLFMLAMNRQGSIIFLTVVAVDRYFRVVHPHHALNKISNRTAAIISCLLWGITIGLTVHLLKKKMPIQNGGANLCSSFSICHTFQWHEAMFLLEFFLPLGIILFCSARIIWSLRQRQMDRHAKIKRAITFIMVVAIVFVICFLPSVVVRIRIFWLLHTSGTQNCEVYRSVDLAFFITLSFTYMNSMLDPVVYYFSSPSFPNFFSTLINRCLQRKMTGEPDNNRSTSVELTGDPNKTRGAPEALMANSGCILRFGVNIAVGNQNSTDYSEEQCGQHDERGACHIVRL

SEQ ID NO: 923374 - protein, 156 aa, Homo sapiens
MRTSTCCSVCPKYAARFDLTLLLACTITFVVSAQRVGRKSYAQDSLTIHFAKTSPSLGDEQRRERQRWLCGLQPHLPSCPRSTGNWLWENGRTSTCSLRSFFPGSQPAYQQPGCPEEPSEDGKTLSNFTEQMQARKEGPGLSQLSCELITKGKLRN

SEQ ID NO: 923375 - protein, 170 aa, Homo sapiens
MPAPVLVEVAGEENVLCCHGSGEKLAVTGLTKLPHNPKGWFHSHCGPPPTTAPSLFSGSGRTGLRTCPRLPTYQLQNQVGRLFFPGLWSLHTEFISFSKSWPGDFSISSNCYKVQLEVSCSLWPFSSASDCPPPQGPCEAGQKWLARGPSESTGLFPLLPLPCILFGSLN

SEQ ID NO: 923376 - protein, 152 aa, Homo sapiens
MQHNNIQKRMALSFFVSQRMAKPVPKAPSKLSSHKSYVTKRHLSQSLNKVVRKDLNEKVAFQHRAEGGEGADHELSQERAFQAGRTAGAKALRLLQCACPWREQGKGEPGRLFKGATRLEKEEPLKTVESAGAKNLNIYIRVSQCAHSELPV

SEQ ID NO: 923377 - protein, 142 aa, Homo sapiens
MATTYQALSWETYIVSLSSHNNPLASIHPLMFVPVSLVLDRKDALLMLAMLVEPLWSFSDMHRVGKNIESPGIHVQLRLNQQSWNQGTTGNHILTLQMITHTPHGRSGKSSDAPAFQDNMMLLYIPWTMTSISVVEVGGLMA

SEQ ID NO: 923378 - protein, 177 aa, Homo sapiens
MVLCLVPVGAAGSLLEMEALSPACPPLSCTSSPEQGEREESDALAREEGIFCNLLCIPVVVEELKCYVTNSRGAASHHCFKNGNETLKNSGCHNGGNQLSDCRIPAYFTRKRDSTMEYMFNAADSSNTYGICIALKCEPPSLVPTIVNKSNKGKIQEDVNLYYVNIKFQKRWSKKPI

SEQ ID NO: 923379 - protein, 184 aa, Homo sapiens
MGLDKLGRGSSCFRSQENKWFLQVIKLFSLQKVHCNWESDYSKMVEWEFPMLFLSQKHQSEQPFTYKNTFTRAKEFRTVVTADGWNTEIRKDTLKRSAPENPSARLKPVAPGSRPTPIPSQSPQLQALDSPHRPRFQDISNNPGARLASVDPGTRPTCPLTHAPSHSPRIPAACAYGCKDSSTS

SEQ ID NO: 923380 - protein, 134 aa, Homo sapiens [sequence omitted]

SEQ ID NO: 923381 - protein, 167 aa, Homo sapiens
MRSGGSERTAASTSGHCALGWSLLWGKMIACFSFSVAPFPLHLLFGCSIKKSSSSDSNSSDSNSSRNDEIHQRRRQLQEQQGSDSANWGMISVTRRKLFSWKIPLSLLPSAVFSIKGLGVQITLTLNQADPCVRESKRYMQEKRWKGSGGESLEGSTEKPSLEGFST

SEQ ID NO: 923382 - protein, 186 aa, Homo sapiens
MLPGYLLTHNKSDLCSSSHPPHSSNLCSLTSSKVTSTFSEIKAGPQGPNPGQGRKTVDLALRGHTVSRVGSFQQAFGLADFKNEAADLHKKFSKSRLDPEIQLASPLNTLDSSSQCCKNKRLFSNLHKGGALSSSRKGSCIHSSTYGIGTTVFWVKTSRREVDSKPKAGILPGTKVKFIGWQGQCF

SEQ ID NO: 923383 - protein, 269 aa, Homo sapiens
MILIIPFAILHSEREDKSLTGLSNNPQVQALLFVLFLVIYLLTLLGNLLMVLVISTDSHLCTPMYFFLRQLSFLDAFYSSIIVPKLLENLLSKGETISFLECFTQISLVIFSGATEACLLSVMAYDRFQAMCHPLLYVVIINRRVCAGLVGASWAIGMGTGLINTLLLAQQHFCGPNVIHSFACELPPVLLLTCSDPCASIVSILTTMSVLGLGTLVLLLGSYSCIIMTALRINSATGRSKIFSTCSSHFLVVTIFYTSGVLRYVILYP

SEQ ID NO: 923384 - protein, 140 aa, Homo sapiens
MSTSFLATMTLLKKEFINGNPVLLRYQHLSGYRIQGQGWQFLIKPNIHLLCYPAMNGSSDCWNCGLSPLGESELEAPEDPENLDTLPTCGLIVSSMDVLQRKNDINLMRSTECGLKPSPNSILSLLAGILEVSILKIQEG

SEQ ID NO: 923385 - protein, 266 aa, Homo sapiens
MMFSSKYWARRGFSLDSAVPEEHQLLGSSTLMNDMYGKNLITEDSGTLTNILFYYASTFLKLNKPNSGKNDDKGNKGSSKREAATESGKTAVVFSLKNEVGGLMLVFPQEKRVNMVHIESRKSRRRSSEVEIFVDCECGKTEFNELIQLLKFQTTIVTLNPPENIWTEEEGKGGLSLSELEDVPWFPRKISELDKCSHRVLMYGSELDADHPGFKDNVYRQRRKYFVDVAMGYKYTTPASPMSQCFLIKLPREDSDGLSSHFHLRP

SEQ ID NO: 923386 - protein, 244 aa, Homo sapiens
MIFFSNVKFQSPKKMVEYTEEETKTWGVVFRELSKLYPTHACREYLKNFPLLTKYCGYREDNVPQLEDVSMFLKERSGFTVRPVAGYLSPRDFLAGLAYRVFHCTQYIRHGSDPLYTPEPDTCHELLGHVPLLADPKFAQFSQEIGLASLGASDEDVQKLATYLPHVRQDDREQEFNNNNNNNNNNNNNKSQTLFLIPGSSGSGGEDRQEDWQFLCGFVWATLGKGGGPPNLPDGHESDEGARQ

SEQ ID NO: 923387 - protein, 168 aa, Homo sapiens
MLGALHPLSYTHCPTFPNFWYKKFMTTLGVVAGYILKFSSSSRKNRYNFTDLPLSTPAESKTCQDKHSVQRSYHPGGERIPKVYRKGRPQKKENQQKPGFYMSKDALLSLTSQIDPVQGRKCRKRVKRRYTSFPILLKQGKCPVLWAKAGVWGWREAYFLHIVLEPVL

SEQ ID NO: 923388 - protein, 198 aa, Homo sapiens
MSHCWKCLSTVAGAGAVLSISDHSAAPSITVPHFSAWALLGLCHLGVYVQVTGDAMAWLGLRGLTVHPIHDLLASDGKHMAFGFLNNYPSTSWLRTVPSAFSNQWMVALLNSFLKSQRSFTIFGKIQWISDSTLAVKSENEGRLYNIVSWDLKLVMISWKLGIQRTSGDLFFLVLQPKVNSSELCRNPDTVTGKVIHS

SEQ ID NO: 923389 - protein, 154 aa, Homo sapiens
MDFRIVTGQVYCKRLEKYHRLDAIKNISDSWEELKVSTLTAVWKKVIPALMDDFEEFRVLNGERKNCHSHPNLQQPPPCSVNSPTINIKHFSFLLPCEEGRVCFPFCRDCKFPEAFPALWNYEVYIFVADMVFLCPYPNLILNCNANNSHMSWG

SEQ ID NO: 923390 - protein, 202 aa, Homo sapiens
MDLSHGTEVHYQLDTAPCISAAPAPVVAKQTLDMFQVAALEVENHKHLWPPHGVKPVGVQRARRNSWEAPPRFQRTYGSTRISRQKPAAGAEPSWRTSTRAVWRGNMRLEVPHRVPTRILPSGAMRIGLRFSKPQNGRSTDSLHSAPEKAAGTHCKPLRAVMGGEPCRATGVELPVLGAHPLQQCGLDKHVSKGKIFKLNKR

SEQ ID NO: 923391 - protein, 153 aa, Homo sapiens
MGQSTQLLMFHQVGPLLDKKGPQWLTDSRLLKYQVLLLKNLQASNLRAARVCSFAPEGGSSALQGTPEGHDETAQENSLADQKTKEATVPKFTFLGALLPSLPTELPPLQYTQEEIDLDHPTGISKRNQWMVQPGGTFPSAKGLPVEGHPESA

SEQ ID NO: 923392 - protein, 172 aa, Homo sapiens
MAHTWIQRLWLTYVAVLSGTSQMQCLESKSVQVATTKYHRLGGLNLEIYFIADLRTGSPRLRCQQDQYLAKAFSSDCRQPPTLCPQIAERENADISSYKDTIPIRLGPSPFDLINLYHLLTGSISRGENKNFFWKSKTLDGEKQYFTEQIELYVKSTQQTSSVISNISNIKT

SEQ ID NO: 923393 - protein, 216 aa, Homo sapiens
MLCCSVCGGEDVTKVYNTKGRVTMSQELTKEQKVFYKMVQQLLKAIQCTVESEALHKLMLLIWQECPWLHDQGTLDLKLWEQVRCCLKRGLEQGHFANVTVLTTWSWLHSALYPFDMPDCDESHHPFSSPEGNSEDLKGKGTQEPEQQRGAPRPTSLPSVGHKEDTLVKVLVSAAEYTVSGSGSGGQQLISSMLAASHTSMEEDTRGTIPGFLCDG

SEQ ID NO: 923394 - protein, 150 aa, Homo sapiens
MGRNQSRKAENSKNQSASSPPKECSSLPAMEQSWTENDFDKLREDGFRRLVITNFSELKEDVRTHRKEVKNLEQRLDEWLTRITSVEKTLNDLMERKTMARELCDPCTSFSSRFDQVEERVSVIEDQMNEMKKYRECHKDTPREEQLQDT

SEQ ID NO: 923395 - protein, 189 aa, Homo sapiens
MLKQKSAAGIGLSWRISTRAVWRENVGLSPHSVLTVTLPSGTVTLPSGTVRRGSLSCRPQNGRSTDSLHCGLGKVIGTQYQPVKAASTDSNVNLLWQHPHRHTQEQYLAFFKPTKLALNVNHHNVRHGTKGDDFGAFRITAALLNLDLHRAYSPFVLANFSFLEWEPLSNASTPIVSWKDICTRSYASN

SEQ ID NO: 923396 - protein, 134 aa, Homo sapiens
MRSEKTFKQRRTFQRRAEDVRLILAQHPTKIPGIIEGYKGEKQLPVLNKRFLVPDQVNMSEHIKIITKRLHLNATQAFLLLVNGHSMVSVSTPISEAYEKNLKASTNELLELMNENSVNCSTKSTYKNRLCFLH

SEQ ID NO: 923397 - protein, 116 aa, Homo sapiens
MRGRCEGGFGLGRRVAMIYGCSQGIIREADNLVKMSWPNKGTGQGASEAIGQCQSSAAKPRRSGKESAKEHWVWAPGALGAAVMVGEQRLKKSWSLIQPGGERPEEEQSGEKVIER

SEQ ID NO: 923398 - protein, 157 aa, Homo sapiens
MCLTTARSNRATKTPGKIDRHLLLTVFEQALQVFNRFTGIAAGGSLRFQVRGFRGAPGCQNELDISMIKQKLEPKTGTHQQTCQHPQYFHNLLVPGELLTLTKIKGNNPRQLSLPPAGSPKRYWMESLYRLSMFLAHQSIEQNVQIKQKNGKTVQIY

SEQ ID NO: 923399 - protein, 276 aa, Homo sapiens
MVRVGTNYQAIIPECKPESLARYSNKKLKGVLVWSPNHCVSDAKLDKYIVMATEKHGYNIEQTLGMLWNKHHVEKSLADLANFTPFPEEWTVEDKVLLEQAFGFHDNLVKYHYSWKKTHSRTSMTDRQARRLRGCKDKEDSDEFEESRGGLSEGEPDAGHPKRERSSFWLPKPSGGMADFGAIAEVIGNKTLTQVKTFFVSYWHCFNLEEVLQEWEAEQDGARGATVPVEEARRGAPLLAPAQEEDHEVQITSISMSVSRSVPPCTTPVPPPTSLP

SEQ ID NO: 923400 - protein, 165 aa, Homo sapiens
MCAGHGSWEQCLPITRQRLVPDSSLQVYTTLQCTQPNSHRAVPGKGELPSSPFPCLRFIPGTGASEWNRGVIASYLLQSDQAQLEEPRVRAAEALQHAGSFYPQPLPTGDLVRGRSLKLFLNCPLGHWPLTMSVPASNHCFLPLIRTADGNQFEDPNRGTESAVL

SEQ ID NO: 923401 - protein, 240 aa, Homo sapiens
MDLQNPRWEGQMHLFVPLAVLDEGQALSLGLVEGPVRFLAAPTTHPGNQGLIVLAGLMAARVLIAGVFDVLVVYRSSKPTLYLFAVQKLDTTPTGAIPVRQSATPQPVDNNDQKRAFERVNSIVQCHTAFRKQMASSSGLGTGRRSQHGCSRPRHGHYLLGLQLHHPHDVVEDKLRVMVVLVCILSGSIMVLTSVLGGRHGGAAVAAHLGLLSLAPRPLGGYVAPSRPLFPPPRDLNLDP

SEQ ID NO: 923402 - protein, 305 aa, Homo sapiens
MSNCSRSKSLIIKGKTLKKRSKLVPEEWGVAENIPENVEAHLELGNRQRLEQLEGSEEDRKMWESLELPRDLLNGFDQKPDSDMDNKVQAEVVSDGDEELVGNWSKGDSWYLAAEISKQQSIQEVTWVLLKAFSFIREVEHKSSENLQPDNVIEKKNQFSKEKSKSAAEICISKQEPNVNPQDNGENVSRACQRPLWQPLSSQAPRPRRKWFRGLGPGFPCCVQPRDLVPCVPATPAVAERGQCRAQAMASEGANLKLWQLPHSDEPVSAQKSRIGVWEAPLRFQKMYGNAWMPRQKFAAGAGCS

SEQ ID NO: 923403 - protein, 230 aa, Homo sapiens
MFDKKLIVSIVRHSLKAVSTCCSSYTLEMPLRSATWDPLGKCDMCDRGKTVATWLLDICTTTWYLSKYVTPKVLVGGWSFLRGARSGILVKKLLVYCLPRLPKAYVALGNTGKVLDENIERNVLLFPLVKKKSQSPLGNITSGSKSDTLIDVCTDVHTHNKRESYLKRSKVVEQHFQQFPRAQFTVLLPSSQDDKVSNSHENLKCPYLNLLGTVKREADPRYIQNSFHKS

SEQ ID NO: 923404 - protein, 160 aa, Homo sapiens
MTEFPAYPTPIHVLFERTKLSISKLLLNNIASPPQFLSKMLCYLDAYLGPCPDTPSPMHWISSHLIWALTHYSQQQLPPPHPILPRADFLFTTLDSNTVHWASWINFSSFLSSTSHIYPFLLPLPPQQMPSSFSPFGLCYSMLGICCHHYPLRNTCLAWS

SEQ ID NO: 923405 - protein, 161 aa, Homo sapiens
MREEHIKPRVSVRGSWIHRACSASAIPHGWEASGNLQLWQNAKEKQGTSCMAAGKRAAGETAACKPSDLASPPSLSREQHGGNRPHDPPNSPQSPPIRTLPPHVGITIQDEIQAPESAVSPSTHRLQAGKADTSATENATRCPLPKMWGEHGFAMKMSALT

SEQ ID NO: 923406 - protein, 152 aa, Homo sapiens
MDAYTASTGMGTGRGASSQSHPYPKPRRVLPDYCPCSLKAQGLLNQLVVNAAWPVTHPSGQWAPLWPRAGPKMPAKGQVLESGTLRACLVLYPSDVSRNVLHERGPGTGASQLCLVPYPAVAELVSKMQDSLPYSFLSSLQAEEGVSFGAPN

SEQ ID NO: 923407 - protein, 146 aa, Homo sapiens
MGRNQRKNAENSKNQNASSPPKNHNSSRTREQTWMENEFDELTEVGFRRWVITNSSELKEHVITQCKEAKNLEERLEELLTRMTSLEKNINDLMELKNTAQELCEASTSINSRIDQAEERISEIEDQLNERKNMGLCEKTKSMFGL

SEQ ID NO: 923408 - protein, 237 aa, Homo sapiens
MGLRFTNEDHLAVHKHKHEMTLKFGPARTDSVIIAGICCPKSHGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 923409 - protein, 413 aa, Homo sapiens
MLTAACSKFGGSSPLRDSTTLGKAGTKKPYSVGSDLSASKTMGDAYPAPFTSTNGLLSPAGSPPAPTSGYANDYPPFSHSFPGPTGTQDPGLLVPKGHSSSDCLPSVYTSLDMTHPYGSWYKAGIHAGISPGPGNTPTPWWDMHPGGNWLGGGQGQGDGLQGTLPTGPAQPPLNPQLPTYPSDFAPLNPAPYPAPHLLQPGPQHVLPQDVYKPKAVGNSGQLEGSGGAKPPRGASTGGSGGYGGSGAGRSSCDCPNCQELERLGAAAAGLRKKPIHSCHIPGCGKVYGKASHLKAHLRWHTGERPFVCNWLFCGKRFTRSDELERHVRTHTREKKFTCLLCSKRFTRSDHLSKHQRTHGEPGPGPPPSGPKELGEGRSTGEEEASQTPRPSASPATPEKAPGGSPEQSNLLEI

SEQ ID NO: 923410 - protein, 135 aa, Homo sapiens
MSMHLCICMCAGERVHMCMCACGVPWGSWKTQLLVLLLWLPLGKLTALGCCAGAPGALGVVWAAAGSPSVILNLGFSPHLTACSPTSSPFIRRAGVLPERFSFPGSFGVGSPQVGKGSWRSWPGASALQVPAPSL

SEQ ID NO: 923411 - protein, 151 aa, Homo sapiens
MKTDEEKHLKYVRNLSLKSGCLGVEMEKKVEMIRAVINVEASRKVTESPGGLFKPPIAGSTPKVSDAVDLGLLSSRESQRIPSSKVCAPGPIEVESLCSLLQACRDSAGFCSRTSTYNGMQSRLTSWRDLSTGPMGMGIAGDIGPLLGLQH

SEQ ID NO: 923412 - protein, 148 aa, Homo sapiens
MTGASAAILQPKGNLTGKCLWLPLLSVSHHTWQESTHFYPFFLQDKDLLPLPLLCFCSQPGSWWQRLGSFSKAKASKPNLFTMRTNPLGLHCNSIMVQASPLNGCWSFLIPPLLNRCSWEFSLVNLLHANLHLRGYVKVTAYNSGLRQ

SEQ ID NO: 923413 - protein, 151 aa, Homo sapiens
MHFNNDQVMLQQAQRTKKQLQQETAELGSEIPALTKKDALLLIKGMKTSGRGSRCVAAPLKILVKYKSLLPFLKQLQQLFSPENERKICDDFSRRSTLRITVGPTYSSGLVLRKAISYTPGPGFVVCPPQMMSPCYCYSSGYLTNVCQVSR

SEQ ID NO: 923414 - protein, 166 aa, Homo sapiens
MHLLRLPGMIKLSVRAGFKPEPDFKAIFHCALLPSPEMMPNTCATYWHLQFIRLLASSQGSSQGVKAAEVISPVKRSRNRKQKSDGGVDSVLLPRGPFLNDRKGLQGCECSSYIRGLPWYPWDLLEADLCILIRTSPFEAIDSSELAVFIIWGCSFFSSVVSLMLV

SEQ ID NO: 923415 - protein, 250 aa, Homo sapiens
MRPINQLLTDNSRCGLAIVPNAWSTLSAESKDCLAERSFVSVLTFLRGTDYLFLTESHGHLDKENKRIVHFTSNIYSLHSCLHGLEVSTCSFSRYKVQAAGGFTILGPGGHQPSSHSFTRQCPIGDSVWGSKPTFSRHMAVVEVERAVLVPLLHSVLTWEQPVGRMVSVQTQEWISVKGSWGPYQFQCSQRKGTRNSAAPEGVEAGSSVTYIMRFLQDFAVHLNANVQFWHILRMKVLKQAATLEISEHC

SEQ ID NO: 923416 - protein, 178 aa, Homo sapiens
MNILNVIFIYSSYTIKGEIGKLEFKPNNFEIDDGDDGKDSDGYDYDDDGNGDDDGHGDEDGDGDNDRDDGDGSDDDGGDDDGDDGGNGDEDGNGNDDDGDDDDSDDVNDDDGGDDSDDAPNLLLVAALTITECFRHLLFRLHTHSSDPQDNEDNSDLIYPPIGQSLNPEAIESTILVE

SEQ ID NO: 923417 - protein, 147 aa, Homo sapiens
MGDDLHSVRPVTVVPDFSRQLRFLRAGSDGLMLGHSSWEGIRLAGGVSRQGGRPIRGPAERNSRGKPRPSEHAPVFVSTLLFQWEVGSRNDPAIEPYTMMEPWVPKKKLGGCYQEEIDADLPRMTSVPSAILSTRLDRLSMAFLVLY

SEQ ID NO: 923418 - protein, 149 aa, Homo sapiens
MAGCRSQALPRGKAAKARREIERSAATGPGAKSLIARGQQGWLAAPSAGPTKPTPTRNSSWPASATRSPGSRSCFFLHTSLQAEGVGSGLGQPRKGLPQCSGGLKGSSNATKVGAQAGEVPRASEGSEDCQHAVTSHKLGFPNLSTMDM

SEQ ID NO: 923419 - protein, 150 aa, Homo sapiens
MHPSIHPSIRASIHPSILPSVCLPIHPFIHHSILLSTHPSIYPSIISSIHSSFHPSAYSFNKCQRPHAFSEHRAQQELFLSVVRTQDSNCLLSTNNAPHTVLGTGKNLPFVGEIGEHVNYTEKHKVSTVGVLWRMGRVSLDADNLAVDLE

SEQ ID NO: 923420 - protein, 115 aa, Homo sapiens
MCRAGVLHPLTRHLTLGISPNATLPTPPTPQQAPVCDVPFPVSMCSHCSVPTYECELQQMKFSVCVRKSSDLKEIPSNDCSAQKRLQQVFQVIRKPLGAGFCDHYDVTLEHFRHC

SEQ ID NO: 923421 - protein, 153 aa, Homo sapiens
MPAALDTVQQVPEGAYVYRVRGEADQQTEGSDSSPNHETSKDTDVTFQRDDGGEFSEGTIVKGGGNMRLVAVKPDATPTPAGSGEPSLQEPRGSTVRCSQPMEALQGRSQWKEYNSLSTPALRLLPECLTGWIPNPTKDNETYECIYKTSPKT

SEQ ID NO: 923422 - protein, 153 aa, Homo sapiens
MEDWALELLFPIYYFSDPKNFTNPPFLLHLGSRGYKNLQPPAKGWELRFIIISLTIITIITTIIIINIVTIIIITIIIITITIFVTITTIITIIITTIVITTITIITIVIAITIFITMTIIITITIIIIIITITIFTIITIITEAEKGENLEA

SEQ ID NO: 923423 - protein, 116 aa, Homo sapiens
MAHCSLNFLGSGDNSKPQNEVGVVFSSEVEVMIFGAADIPGGLFHAWERRVETPCNRLPMRTQGRALQGASCTLFPSFDQPDSGSFRVLPMTAPTCQKRKIQSDQIQFQIEFGFLF

SEQ ID NO: 923424 - protein, 137 aa, Homo sapiens
MTPGMQAFTHSLVHSVPTECLPSTVYCVSTACLLSASCVPTVYYVSSECLLHAYCVPTAYCMPTGCLPSIYCVPTDARDGSHQRTTQPQMLTAWRPRHGESDAGKGAGREGQGSHRGRSEELGFELSPRRGEAASFP

SEQ ID NO: 923425 - protein, 169 aa, Homo sapiens
MGSRRSWAAEACSGELQPRWRSHSPQQLKLQGRDGPHPRPGQEGQGGTRALEAHSLPVLQSPLLPSGGREEERGLEETTGERPTLKPLSDLLSAEDGPPVDARTSSSSVLPPPPSTPTTPNMDRGIQKYPLKLKSPRLWFYFCIPPKYRSFNFFVHLLKQRICSIHDEM

SEQ ID NO: 923426 - protein, 187 aa, Homo sapiens
MDVVFLTFPDSWAIITQKQLQLSIPLAEPQAHFPPQDKIKHQRNAYEEEINSRQIKAECGNLPITRSSQLSSHEIARRGVHSLGPLPVAMAILSPKFMEGGREVIRLHEHAGQHQSYLGGQHSGKAAAMRISPFPSSAPSADALLGSRKTQVTQSSGPDSLKPPAQQKRQDPFPRHRRKSLMAADWF

SEQ ID NO: 923427 - protein, 155 aa, Homo sapiens
MYTHVCICLHMYEFVGVCMSFVCACVYEFERQKYNHPNYEPILCSLKWIKLKDESHFDNSPHHCQTKYPNFVSEFHITALSLAKYNMKMLHVGPAGRGTEDRSSESRPRSRRRESRWCGMSGQISQPVGSTPLPALLEAQAHHQSIWENVSTIGE

SEQ ID NO: 923428 - protein, 146 aa, Homo sapiens
MAFKVPSALISHYLLEGVCFPSLHHLLLQATLFLHPPGTAIQRLYKQLPLPGPCSSSYLCVLSLTAFQCGDDDQRRRHKAPARSNLGATCKAPGTQHSPCDLRCMILHSTDILRFMETKCRGEPHLNSDVADSEGCVEIFEICNKL

SEQ ID NO: 923429 - protein, 185 aa, Homo sapiens
MSGCGRASLAAHEEELETLVPCNSQANPDLSFSPSVYQHASIQESHNRCKRGLMKAMDTGPSHLDSRLDEAAASPRASPLRFLSPPLLSPTLQPSKFSLPESEPRSPPRPQSLPGFRSPSDGCTLCPGSLRPRLNASSQFLNRPDAPAWTSLPLLFPLPGPHPLPSGKNAAALSPPAPAQMLPPQ

SEQ ID NO: 923430 - protein, 174 aa, Homo sapiens
MTITTITSSPLHHHHHHLHHYYYIITIMTITSPSPSPHHHHHHYHHYIITITTITSSSPRPSPPSPHHRFIIIITFITNITSSLSQPLSHHHHQHIITITTITSPSPHHHHRHHLITTTPITSSPPPPSPHHHHRHHLITTTAITSSPRPPSLHHHYHHYNIITMTITPITSSP

SEQ ID NO: 923431 - protein, 134 aa, Homo sapiens
MKGPDFLGAPADMQTDKGPNQRSQAPQKSPPWGESRSDRRVLPAVLSTLAGDSPCVAGPLMINSFFAVAPAVLIGSSRTAGKKNPQPVIPTQDALEAPICDWHLKCGAVLWAESLTCGVWTNSSMWMTTPSLFA

SEQ ID NO: 923432 - protein, 161 aa, Homo sapiens
MWDRPESWGTGARLRWRIQAPRGVPTSDPWGQACPQDDSPGFDLIAAPMRLPVFCRLRPQPAPPRPASHPGHAGCPPLAAYPRARESVPLPRFCAWSCPLHHRILSALFPKGCLDFTHISLPHSHLHFPGPSRHHSWLDVLKGVSARLPGLLPSTPGTEDL

SEQ ID NO: 923433 - protein, 169 aa, Homo sapiens
MSLQPLTLRQPIRIRSCLGLHPPHCAYAIPTQQPQPPHLGSAEGSPAWPFLGPTTNSSHRPASLATPYHTQFRDLLGGVGHNDTANCCHCSVRHPETQREPAKCLLHIPEDAAGYPWLVRREGARAQSGCLLSADCVPRLEGRVPVPSGHEAPTAYLSYRQGTSARSDR

SEQ ID NO: 923434 - protein, 194 aa, Homo sapiens
MEKGTELLVSPSQSGPGGDQPLLVKHREDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLVSGGAFTLVAAFDLVSH

SEQ ID NO: 923435 - protein, 141 aa, Homo sapiens
MTALLMACFSLKESRCLSVTELSLALPQHWGLCTQCAEWKAEGAGSAGASSASDTVNPAADGTVGGQPRTIFEITIVIVIIIIIINEILSQDIRFWEGLRELQSWQKVEGTRHVLHGQIKRDTSQAEFTVGLHSYENQTPG

SEQ ID NO: 923436 - protein, 157 aa, Homo sapiens [sequence omitted]

SEQ ID NO: 923437 - protein, 137 aa, Homo sapiens
MRRDSSILGDDRKTRPSAEAASFQSLLWLGGGLQAAPQPPQIPPGRGGLRRALEVDLLLCGDSVRETSGGCCVIQTRKQHSEATNSSNRVFVYCAFLDFRYPLHRGEQLASTAHLPNVWGISHHRCDHNSPLDVSPP

SEQ ID NO: 923438 - protein, 214 aa, Homo sapiens
MLRKAVLSRRVHSRPQGSSSRGGSTGGHQELLVNIGILIAVTRVISQISADNYKIHGDPSAFKLTAKAAAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPLGQEQPLCPPRRPVSRVSREAANHGRLRSEHTPPNRMKCSTFAHGPSPC

SEQ ID NO: 923439 - protein, 373 aa, Homo sapiens
MLAANPGKTPISLLQEYGTRIGKTPVYDLLKAEGQAHQPNFTFRVTVGDTSCTGQGPSKKAAKHKAAEVALKHLKGGSMLEPALEDSSSCYPSSICSPNQSLDPSWSGMRKSENKQNGIVGNQNLKKSQQLELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARAPAMLVSLSDSPLGLKQEGLAPARSLHCLEQDFTPKRDNTADADGGNGGQQPPTLIPAR

SEQ ID NO: 923440 - protein, 147 aa, Homo sapiens
MRRKGYIKRRMTKIISGVQEIDPWILGTAIWFGSMEEVMLHLPLRKYKPLISSSLLTYRNITSLEDLLLLHWTELQRLLCLPSPPVLAIAGEVCGPWLQDLSGGPHEAHGPAPGSVFLGHQGLKPLCGPHLERGLLQGTLPHPPCLL

SEQ ID NO: 923441 - protein, 138 aa, Homo sapiens
MGELRLLRQVGSVSLQPLSQEDLGRSQSESLGPEFQGLWEWLPDFQHLKQDTGGGGPEEMPDCCGLGVLKFLCAGDVAGVSLTAAASNCNSSVLLYTLKTRLIKTCVGFKGQNLIFGALFNVGNELRNKMHIENKTAF

SEQ ID NO: 923442 - protein, 147 aa, Homo sapiens
MRTCGIWFSVPVLNWNKTRMSTLITPIHHGTGSATQSSQVKKEMQGIRKEIEVKLYLFIDDMILYLEKPRESAKSLLELINNFSKVSEYRISVQKSVAFLYTNNIQAESQIQNAISFLVATHKTKIPRNTSNQGSERSLQRELKNTA

SEQ ID NO: 923443 - protein, 413 aa, Homo sapiens
MLCAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGK

SEQ ID NO: 923444 - protein, 202 aa, Homo sapiens
MASWKSNGITITIIHQPHSSPCFFPVSAPSGTQSASAFALSYRGQANKNECYVGGIRGVPLYEKLLLPQTIFYCPLLLPHYPPPNIPGFLLWSCNGRDLSTIYPIGNNLGHMCLIFSESGIFSVLVTSVSWAQVQGLLHICSQKILVKGINQSVQAEYKHLFENGCHRFMIRLEGHEGTASFTKPKFFFYYYYCYYYYYYYL

SEQ ID NO: 923445 - protein, 320 aa, Homo sapiens
MLAATKALWPWDPPSQAWEGISWSAGCKDHGKSTWAGGYCSSRYSHSQLPLARKGKSPDPLCFPDGDEKFIGNWSKGHSSYALAKRLAAFCLFPRELWNIELEKDDLGYLAEEISKQKSIEDVTWLFLKVYTYMCEERDGLKLEFIFKREAEYKSLENLQPNHAVEKKNPLSGEKFKLGADICISSEELNVNTQDKGENISRAFQRSSWQPLPSQAQRPRRKKWFCGPGSEPCCSIQARDMAPCISATSALAMATRGQGTVWAIASEGASPNSWWLPCGVGPVGAQKARVEVWGPLPRFQRMYGNAWMSRQTSTAGVEPS

SEQ ID NO: 923446 - protein, 157 aa, Homo sapiens
MVDWVLGGQKSEGVAVSQPWSSSNGKSLCTCLTPSHQQINGGLSRAPFSTKSIDYTTGNNQGVSCSINICKVNAQKLLGTFEGASLTPISDQFVLRGCLLISIFEKITHNKKSVLLLIRCAEVRAIRGELPLKSMWTWTKEKLQRLMASQGIRVNIR

SEQ ID NO: 923447 - protein, 155 aa, Homo sapiens
MIGLLQATEQGSQSESQNLKRRKADIAYFSLWLKAQEPLAKHWCPSTACLLEFAGGLLQILFAWVSPVEAAEQPRLLPIPSLEAFLFGASSNQAINSSRIDSTLGNLLKVATLVFYNRDQEETQEIKKKTQERDRGSSSCFQACKFQYLQDASAS

SEQ ID NO: 923448 - protein, 166 aa, Homo sapiens
MNLAAAHSLGWHCLYELYHSPQRSAASLLSQRDHEPTGRNEHIQTSEGTNSRHAAFKNSNTHREDHPEGTNPAKTLTLAQYKGFQTYSLHKELFGYEHDLSFKKGKSDPKGNSEIIKDTTPKACRASSSLVSKSGVFKSLQFLEGQNAPIQCLRVEMSFQRALGRR

SEQ ID NO: 923449 - protein, 240 aa, Homo sapiens
MSHEKDFHKSYPKLSIRDGLGASQVIGQCQSLAAKPRRSQSDSLGPEFQGLWEWLPEVRHRNNGLEHRDKRLGHRNKGLERRDKRLGHGNKGLGCRDKRLGHGNKGLEHRDKRLGHGNKGLERRDKRLGHGNKGLERRDKRTKAGIPVWSDTFETWVNNQRGTPAMIKHQGKADFPVHDRRQSFGSTDKTCLLCLYQKMKGIEIKRRERLKCGTKIERRKRLRDSVGGWRRESKEAAYWI

SEQ ID NO: 923450 - protein, 158 aa, Homo sapiens
MHELVLVHNLGQDGWGAGRGGWNGNVVFLRSWAAQLPDSSLTAPGRTPLGIQMSLLFFLSLPCRSAVAGLPVCWCLLVCSSASLNLQLLASVPAKALGLYGNRMGGMVGQSSLGKCNIWARKQECLFSLRSVGTGLRVEPSPGTLSFFTQYFPGPHPV

SEQ ID NO: 923451 - protein, 214 aa, Homo sapiens
MPCIPAVAKMGQCTAQAIASEGAKPKPWQLLHGVEPAGARKSRIEVWEPPPRFQRMYGNAWISRQGCASGVIPLWRNSARAMWKGNVGWEPPNRVPTGALPSGAVGRGPPSSRPQNCRSTDSLHCRGRKTTDTQCKPMKAARRGAVHYKATGAELSRAVGSHLLHQHDQDVRHGVQGNHFGTGIFWAHAWKAVPKWTAATALGKSSQKARQDAE

SEQ ID NO: 923452 - protein, 135 aa, Homo sapiens
MGQTDGLATIDHFPVQRLIIFLSLASAGLFPPILISIPSSPHRKPSILQLKVSSPSPFVEVKNNNAHTSHILDFVRTLATCTHSHQQQQGSRVHNPTYVQGWGSSSKARSMHAGKVVRKGDGKVHISRNPSVEAL

SEQ ID NO: 923453 - protein, 131 aa, Homo sapiens
MKAQAPVTPFLFPLCKSYFSVWITATDSNTKHDDDDDDDDDDNEANIYRPHVSGSVLSASHVLTHLLFATTLEGRQYNCPILQPMTAEVVKSDISYIPIRDSRCPRNKTCSSALGTGVSLNLQETFKALNV

SEQ ID NO: 923454 - protein, 144 aa, Homo sapiens
MLSEKTFKQCCTFKQRVDGEKELPVLDKTKFLVPDHVNMSELTKIIKRCLRLNANQAFFLLVNGPSTVSVSTPTSEVYEGEKDEDGFLYTVYASQEISDFSVQLETCLPVASILTLHNFTVRETARVTLSGSLLKKILEHGFNN

SEQ ID NO: 923455 - protein, 135 aa, Homo sapiens
MRTCPTSVDPDTLSCHRVFVKVFVFSARGYRASSPLGLAPLNPEDGLQSLNPEDGLQSFLHRTFGICKSDTSAMEERHPVKPSLVHNGQMTVSFQSQFAVTLLSVFLVSQESHVFGFHVGFVPTDPAVNEVCLHH

SEQ ID NO: 923456 - protein, 143 aa, Homo sapiens
MPQIEVKGAESSHPCINCTHAYHWIWAPLPKVISRGPGITGVCKVELEKASMELSDLQGLGQLVSCRLGLHARPKDAPASLLVHLVPCCLRPRAGEGRVILWLAIILSLFPSSFRKGACPQFGLDSWHGWGKPGRRRCENLGV

SEQ ID NO: 923457 - protein, 152 aa, Homo sapiens
MASSGTFNQIPEKSPCKERIQGPPVSVKIPDTSWVHSSEASPGYQRRWVRGPRWGFSATRESTSYLVAIIIIIIISSSSSSSSSSINIVTCLRTLAKNTFIELQSISIKNKLPNAKAQSLLKENDKFAVYREPTAKRSLHSSFGSFLLPTRF

SEQ ID NO: 923458 - protein, 161 aa, Homo sapiens
MLASVGTHSPCSWTTLLPAPINSLADTLRTKEVHGGALVPVGLLISCHDPLRDWDCGRNQTHCTDGEVEVQKIQPPTQGHTVIRGPLTPGPLHPSIGGWPDLVGEIEVPPLPLKASPLAPYLPLSSCGRRDKSNSYGRFTTGDGQPRPPPAAFPWSGQIKG

SEQ ID NO: 923459 - protein, 188 aa, Homo sapiens
MSLAQSGHLGGSCPELEENRPQCLLLLLERQVPLKWRARLALSASDRARPNNIYYEDEMRRFTVLESTRPPRGQRPHANVQVTSRGRGAEQMALCLQSHVLMTGIPALRMMWGHPTSLHPWPHGLLCNDPHVLACVLHYSPLDGAWLPTAILDPAALGQDNCPRWGCLYWIIIPAGNLWEVSGDLAVS

SEQ ID NO: 923460 - protein, 136 aa, Homo sapiens
MVREGNAPCISLALASIQIEEIEESLMKGKVYQYVCRVWESTVLRATHSKEQDPNMLPSLQSHFGDPLWPNQTGSQRAQWNLQDPFQAISHSTEQHGEGGGLGLTTQIPVSLKLARSAHLPLLTGCDSSSPWSLLV

SEQ ID NO: 923461 - protein, 140 aa, Homo sapiens
MVYLAFREEMEMKGPRGCSAGGPKKTQNKMVRGMDPAARTPGLNSSAPSYYDSCASELTESSNQLFAFRSLALKGPGWAVLRRKLKSSSLEELLLDSADEDPRPLTQAHRQRGKALAGEVLIGVIPDTRQKRSGNGGGCF

SEQ ID NO: 923462 - protein, 134 aa, Homo sapiens
MAHVCDIRAGCDQCHKDTERGGGVWAETQIKIPSLGKVGPSTEALGLGSVRGLGGDEATWGRVPGRGSSTEVLVRYFEDSLNFGFSGVLLTIRMGLWVFGRNTTEAKGPSHHTLLEGMILTSLITDEVNPNSLV

SEQ ID NO: 923463 - protein, 143 aa, Homo sapiens
MEALEDAQWMGIWVIPTSQTPKVTTEGDGIIESQGWEESQRPYQMQNNFSILEKWSMSACHCTPKWKNPCVQSNSRGEKIKQSFPCYHSAGAHLSPHKMLKLFKVAGGAQAPSGVTPGTGQSGILGAIWLSHPLMNPHQSPLH

SEQ ID NO: 923464 - protein, 139 aa, Homo sapiens
MASNPSLPSRSSQGAVAPRCKGAGPGRGRGLADLRGGGALCRQTRERPHSSPRPRPGSWTPLDLSASSPLSWKCACRTRNVQSPTVEGKHKSPPEIITCSGLLSAFFLNIKYTYTYFNTIVALLYVLFCAAFFSLSPSA

SEQ ID NO: 923465 - protein, 400 aa, Homo sapiens
MASQSCHISSGCGVKNFSSRSATVPKPGYHSCVSAMAHHGVSPGGLGSRRLGGFGSQSLCTVGSPRIAVSCRWPLHSRGRFGYWAGGLCRPSPPRITSVTINESLLMPLNLEIDPNAQCVKHEEKEHIRCLNKFAAFIDKVRFLEQQNKLLETKLQFYQNRECCESNLEPLLQGYMATLRREAECVEADSGRLALELNCTQEALEGYKKKYEEELALRATAENEFMMLKKDVGYTYLHETDLEANCEEVKATVTQQGENLRRTKDELNELNCMIQRLTAEVENDKQQRCKLEAAVAQSEQQGEAALSNAHCKLAELEDALQKAKQDMACMLKQYQEVMNSKLGLDVEIATYRKLLEGEEIRLCEGVGSVNIFLTVCQILLERSQLEGVEYVGTSLRFALG

SEQ ID NO: 923466 - protein, 134 aa, Homo sapiens
MGTQLHDAGESLVGVLEGVPWSLCSHPGLSLSPNTKVGRFLGLEQPSVRWGGQSPWNLFADYRAEGHSGSRHVDVHPRNHTHRPQPCAACPAGSCDAPAWSLLLASCPDSPVGLQDSGLPAPPPGSFQSLRTKP

SEQ ID NO: 923467 - protein, 613 aa, Homo sapiens
MAGDFLRVRSTWLLWGGHTLSLGSCKNADQLSCPPMNGKPNPRIKLLTAHPQAPVPSTYKGTCQSSLQPAEPFGILPSSLLHLSFVSTSNMSRQFTCKSGAAAKGGFSGCSAVLSGGSSSSFRAGSKGLSGGFGSRSLYSLGGVRSLNVASGSGKSGGYGFGRGRASGFAGSMFGSVALGPVCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRNVRDVVEDYKKRYEEEINKRTAAENEFVLLKKDVDAAYANKVELQAKVESMDQEIKFFRCLFEAEITQIQSHISDMSVILSMDNNRNLDLDSIIDEVRTQYEEIALKSKAEAEALYQTKFQELQLAAGRHGDDLKNTKNEISELTRLIQRIRSEIENVKKQASNLETAIADAEQRGDNALKDARAKLDELEGALHQAKEELARMLREYQELMSLKLALDMEIATYRKLLESEECRMSGEFPSPVSISIISSTSGGSVYGFRPSMVSGGYVANSSNCISGVCSVRGGEGRSRGSANDYKDTLGKGSSLSAPSKKTSR

SEQ ID NO: 923468 - protein, 468 aa, Homo sapiens
MSRQLNIKSSGDKGNFSVHSAVVPRKAVGSLASYCAAGRGAGAGFGSRSLYSLGGNRRISFNVAGGGVRAGGYGFRPGSGYGGGRASGFAGSMFGSVALGPACLSVCPPGGIHQVTVNKSLLAPLNVELDPEIQKVRAQEREQIKVLNDKFASFIDKVRFLEQQNQVLETKWELLQQLDLNNCKKNLEPILEGYISNLRKQLETLSGDRVRLDSELRSMRDLVEDYKKRYEVEINRRTTAENEFVVLKKDADAAYAVKVELQAKVDSLDKEIKFLKCLYDAEIAQIQTHASETSVILSMDNNRDLDLDSIIAEVRMHYEEIALKSKAEAEALYQTKVCPCLITNFLSLGNQIQELQLAASRHGDDLKHTRSEMVELNRLIQRIRCEIGNVKKQRASLETAIADAEQRGDNALKDAQAKLDELEGALHQAKEELARMLREYQELMSLKLALDMEIATYRKLLEGEECRP

SEQ ID NO: 923469 - protein, 218 aa, Homo sapiens
MSRQLTHFPRGERLGFSGCSAVLSGGIGSSSASFRARVKGSASFGSKSLSCLGGSRSLALSAAARRGGGRLGGFVGTAFGSAGLGPKCPSVCPPGGIPQVTVNKSLLAPLNVEMDPEIQRVRAQEREQIKALNNKFASFIDKVRFLEQQNQVLETKWNLLQQLDLNNCRKNLEPIYEGYISNLQKQLEMLSGDGVRLDSELRNMQDLVEDYKKSAYCF

SEQ ID NO: 923470 - protein, 551 aa, Homo sapiens
MSRQISYSQQPCRSSGGAYCQTFSSHLAVVSGHSWISSIMSSFASSSGRAGGGQSLHGLGGKKTIPISVAGGGTWASGFSGAGGFGGPGGGCFGGSGFGGGGRGMGGSFGGRAGGFGGGIGGFRGGARGFCRGAGGFGGSGSFGGPGGFGGLRDLSDLGGFLGGIQEVTVNQSLLQPLQETDLKFGQVKAQKREQIKTLNNVCLLHRQSEEGVVGSPNMSSPLWYLSSSGPAYSSNRYEDEVSKCTAAENDFVVLKKDVDAAHMTKVELEANVERMIGEMNFLKALYDAGSLSSLPFLGTHLPCLLEERAFRSPAGLRGHVCLALWELSQMQSDTSDTSVVLSMDKNRCLDLDSILGEQQTTASRHGDDLRNTKNEIMELNRMTQRLWVEIESIKKQEVALKDTNAKLQDIKSGLRQAKEDLALLLCAYQALMNAKLALDVEIATYRTLLEGEECRVSGRCQSSVILETGHSSTGGGCALGGGVGARARGGSRGRSGWGLGGSSAVLGGLLWLRDSCAVSRGGGGGGSSAARENKAPPRAGVPFALRHAPL

SEQ ID NO: 923471 - protein, 587 aa, Homo sapiens
MHASLCPGSSIIQGTDIEEAAILAFVLVPNLQKKNNGTKNKNEIRRGIGIRRTNIKTMMGTDGTRTRNDPVSPGRGKDFKSRKDGDSKKDEEDEHGDKKPKAQLLSLEELLAKKKAKEEAEVKPKFLSKAEQEAEALKQRQQEVEEQQRMLVEERKKRKQFQDLGRKIGNEDEKGQQKIREEKDKSKELHAIKEHYLGGIKKRHQTRHLNDRKFVFEGDASEDTSIDYNPLYKERHQKKLDEMTDRDWWLFREGYSITTKGGKIPNPIRSWKESSLLPHILEVIDKYPTVAVIGGISREDWGFRLLMGCEIVIATPGHLIDVLENRYLVLSCCTYVVLDEADRMIDVGFEPDVQKILEHMPVSNQKPDTMIMFMATKPPAVECLARSYLRRPAVVYLDPAGKPHERVEQVFLMSESEKRKKLLEILKQGFDPAITIFVNQKKGCDVLAKSLEKMGYNACTLHGGKGQEQREFALSNLKPGAKDVLVTTDVAGHGIDIQDVSMVVNYDMAKNIDDYIHRIGRMGQAGKSGVAITFLTKEDSAVFYELKQAILESPVSSCPPKLANHPDAQHKPGTILTKKRRGETIFA

SEQ ID NO: 923472 - protein, 383 aa, Homo sapiens
MSGLCTELDFMGLGANQRQTAKASANDLQPFLESYIGCLQAYLDKLLMEQSLLDGELGTMQALVEEYKRRYEDEFNKYSEADNDFMVLKKDRIKATVARRQMDRENIQLIHLWSWVHDYQLVLGNVCHSCCKTTARRHDDDLRSTKNEIAELSRMIHRLQAEIENINKQGAMLTLKDAQAKLAELRDALQQAREDQAHLPCDYQELLNIKLGWMWRPPPTRRCWRARKRRPWKGWLLSVGTSSPQVSEALSRERCSSLQLVVLAFLAISREGSSSLQLVLPHLSILCVLSPALAVPWAFMDLRGEEVCADWSMGCPKENRRTGSAAAIWMAAASPGEVPPQLRRGGAPTGSMECAALAVPPCCSRCHHYEVDAVQEAVLCPWC

SEQ ID NO: 923473 - protein, 206 aa, Homo sapiens
MVCALLTLPGAECGEGNSVVDTPGAECGEGNSVVDTPGAECGEGNSVVDTPGAECGEDNSVVDTPGTECGEGNSVVDTPGTECGEGNSVVDTPGAECGEGNSVVDTPGAECGEGNSVVDTPGTECGEGNSVVDTPGAECGEGNSVVDTPGAECGEGNSVVDTPGAECGEGAGLWTSACKWPHSPDPLLSTANSTATSHGPKFDGQT

SEQ ID NO: 923474 - protein, 162 aa, Homo sapiens
MWLQLLADVRRYRQFLAVYSCQHLEKPPAEVHPKHVKTASQHLALWLQKPKASNLMLQSHKGTAFLVQSKGPHAPTAVRMLVDHCEHKFHSPRDGFTHQGMIRSGLPPQQHLQAGVQCLEGALGATTAVSSLHHGEDIQTKQNIGVYHQQTEGTSRKQLQKQ

SEQ ID NO: 923475 - protein, 189 aa, Homo sapiens
MRQQCLQGSWPTAPSQSLPPPSTLCVVEKTVGRKSAIAASVCGALFIRYCIYFYHKRRSDPNFKNRLRERRKKQKLPKERAGFSKLPDLKDADAVQKFFLEETQLGEELLAQGKYEKGVDHLTNAIAVCGQPQQLLQVLQQTLPPPVFQMPLTKLPTIRELKEQHLSNTDISSCSSLTAKGGTSGKGPI

SEQ ID NO: 923476 - protein, 162 aa, Homo sapiens
MSRRILNIPERIILIHSECLILPVFLLPFQALTVCFLPRNAFSAFCSDQPPTTIYYSQINFLVFLAARNGWKPTTFFSFNPSPQKISLMRESGLMRKSGPSTNTAWRVGLGVQLLGSNAFLRSSGWHQSRASKSGIGSDGSCSCSVAQAGVQVIGSYLSSNY

SEQ ID NO: 923477 - protein, 456 aa, Homo sapiens
MSFCPSVRSSRRPPLASVFPPISSQPPRIRAVLMIRPLVASLAPVPFRGTAWVLAKSRQVIRGQCGYWLLRAMKVRKTEEGVRGGPRLSTAAGLGPNLQPSINLTVLPTSAAAQTLHFGILAAICRIGSFCQAHMALGPERPPRGWRNLVSVEQIEKITSLDLEFGRQKPSFLSVKVDTLEWSGAQTMQQGPVRGVCCLPGSGNPNRKPLCGAEGKTEDIRTQDTPKREGWRLHIATLRGLPYPGFSSSGHEPRLREVKRLEEQGSPGDEKEEEKEMTQDRLFWGPPPSRLQGEAFVPKKLYPKDSQEAVGREQGLNARLGVRAWVTGPAALGRGWGPRDESDLAFVQDEVTVWWGDRGAGREVTLRGTVGGTLLGSQAPGNSKKARAPAPPWALGFQSHPFQAILASSQESPAAMPTNCMSLAAPLCLSLALSGLFYNPVLFSSPSTLCCLLVKG

SEQ ID NO: 923478 - protein, 167 aa, Homo sapiens [sequence omitted]

SEQ ID NO: 923479 - protein, 226 aa, Homo sapiens [sequence omitted]

SEQ ID NO: 923480 - protein, 217 aa, Homo sapiens
MTAQPGSWGSWMSSFVGGYRILGGTHRLWFTEWASQHVGRLARFPVLRLCVHGLEIRGRSESDTTAQNRKLGAPSVPMSDRDGGVGPRAPHYSDPLLPTERHRPVSTRPVVFLRPCEWWTSKTFGQQSKAPEYAEGARENSDLWPDCSRKAWSSLPASWPLDLPLCTASSEGLPARRPQQLLEPDDGPAWQFLAIRPRGPVPRQTLLPPCQFPPPVS

SEQ ID NO: 923481 - protein, 276 aa, Homo sapiens
MGNALILVAVVAEPSLHKPMYFFLINLSTLDILFTTTTVPKMLSLFLLGDRFLSFSSCLLQMYLFQSFTCSEAFILVVMAYDRYVAICHPLHYPVLMNPQTNATLAASAWLTALLLPIPAVVRTSQMAYNSIAYIYHCFCDHLAVVQASCSDTTPQTLMGFCIAMVVSFLPLLLVLLSYVHILASVLRISSLEGRAKAFSTCSSHLLVVGTYYSSIAIAYVAYRADLPLDFHIMGNVVYAILTPILNPLIYTLRNRDVKAAITKIMSQDPGCDRSI

SEQ ID NO: 923482 - protein, 382 aa, Homo sapiens
MAPRAGQPGLQGLLLVAAALSQPAAPCPFQCYCFGGPKLLLRCASGAELRQPPRDVPPDARNLTIVGANLTVLRAAAFAGGDGDGDQAAGVRLPLLSALRLTHNHIEVVEDGAFDGLPSLAALDLSHNPLRALGGGAFRGLPALRSLQLNHALVRGGPALLAALDAALAPLAELRLLGLAGNALSRLPPAALRLARLEQLDVRLNALAGLDPDELRALERDGGLPGPRLLLADNPLRCGCAARPLLAWLRNATERVPDSRRLRCAAPRALLDRPLLDLDGARLRCADSGADARGEEAEAAGPELEASYVFFGLVLALIGLIFLMVLYLNRRGIQRWMRNLREACRDQMEGYHYRYEQDADPRRAPAPAAPAGSRATSPGSGL

SEQ ID NO: 923483 - protein, 152 aa, Homo sapiens [sequence omitted]

SEQ ID NO: 923484 - protein, 168 aa, Homo sapiens
MACSFYSGQLHLDRGSMVAPGSLELQSPKEGVTALAWEAPMSGFPEGCSSSLLLVTRNVSRHLVGPKFLSCVRKNEACGQLEGRSSRQVSSSQQRRDQQWVARFHRQVILTNGGDLKWVCSSLLGVHSGPCLHWYPQWRLQNSKDCCLLPPPEASCKRVPLRTSVSLS

SEQ ID NO: 923485 - protein, 153 aa, Homo sapiens
MRKSLIGLLLRPLPLPIPSLLVFIRAESGSLLCSESTWYTFPCRQLWDWGLLDDEGRFSSDCPIPGYPMFAQIQRHQKRQRAFGATGSKGRGCACHWEKWAGFSEASAYRELQEGRASLPTPHTGPAYMDAVEGFVGSRSPGVWSLIQFSGPV

SEQ ID NO: 923486 - protein, 241 aa, Homo sapiens
MLRYCQSARAYHLAEACMAGSSLEGRGREQQCDSGGTAWPLAALPSGSGRQWSGGCAGQRRSSKEGRKGSEIAQGQQQQCGAGAAGATPLWPLTHGRFSRRKWGEIGEQEAGGGCGGKSLGILAPGSSFLTLTPVQSPEPGFLPREPAGHCFTHSENNSFPGSQPQVGGACLELRHLESSACYRVCQVWRRQQKRRKTPSPHSLSSGALEEVLHCSEFLHPEGRGEHPPALDSGSNHKTRS

SEQ ID NO: 923487 - protein, 168 aa, Homo sapiens
MPDSPSTRLCSVKIPPDCVEVLDSIHSSRPDLRDQPWPSGDWELYVDGSSFFNPQGERGAGYAVITLDTVVEATSLPQATSGQKAELIAFIGALELSEGETVNIYTDSRWQLCIAGDTSELPSCWVWGIPALTQRLQKQHLPPSGHQCSLKHLILDLLLLKKKRTFCR

SEQ ID NO: 923488 - protein, 153 aa, Homo sapiens
MPEGPRKKREEPLTLILRRKKVTFEDVAIDFTQEEWAMMDTSKRKLYRDVMLENISHLVSLGYQISKSYIILQLEQGKELWQEGREFLQDQNPEDMRKLTQERDHISVINVGKPLFNPLTFEDMRELTLEKSGMNVITVGKPLVKALALEETK

SEQ ID NO: 923489 - protein, 168 aa, Homo sapiens
MRVLAFAQERIQGQAGGIEEDSFIEEAALQPCDFSYVEVRVRILQCLVKGFRLPQFGGSHQIPDGPVELLNHQLPVLCLWPESMSHVIWLSVAQSHNVKVFLGEPVHDGIDVLPPLCLVAVWLQSMPGSRCIGSTRGSRGGMWLWPGQRTEDAACHGYSNRFSFGLMS

SEQ ID NO: 923490 - protein, 289 aa, Homo sapiens
MSSSSSLDIRNNITRGDISLGYYKYYHRLYTHCDNTVIHPKDTTKNITGLYNHYDIRKDPELQPVLTLLSLSLSMYLVTVLRNLLSILAVRSDSPHHTPMYFFLSNLCWADMGFTSATVPKMIVDMQSHSRVISHAGCLTQMYFLVLFACIEGMLLTVMAYDGFVAICRPLHYPVIVNPHLCVFFVLVSFFLSLLDSQLHSWIVLQFTIIKNVEFSHFVCDPSQLLKLACSDSVINSIFIYFDSTFGFLPISGILLSYYKVVPSILRMSSSDGKYKAFSTCGSHLAVVC

SEQ ID NO: 923491 - protein, 127 aa, Homo sapiens
MVRTIPVLSFFRLGGESDSADKHFMFHSLNVEDIFSLIPPIFSIFPGRFQKASVHADFGGSKQETIDPVQEMTLFEGNEGVPRNLEEWRCGLGCGSVVSFVNGNNISPPRRFSVNPKRPSVNENIVI

SEQ ID NO: 923492 - protein, 150 aa, Homo sapiens
MLIAATDDSSTFLLWAFIAVNFPLNTALAVSQRFCFPSNSQAPLLQVCWSLLEVYSKPCLPGYHQWRLQNSKDFCLFLCLEAAASLSEMPCPERRNLERQSGYRSFAELWWAPPSSNSLAALFTLTENHLTYSNQVYPTLTFAVLDRKEH

SEQ ID NO: 923493 - protein, 138 aa, Homo sapiens
MAHVYISKEFKVVLETLVVVMEVVLVGMTTLVMEETSVVMVGLVAAVVVVVDMVAVEMAIMDLVMMETILEVVEATVILAETSEAEVLVPMVMEANTLPNHETKMVIVVLVAAVAMAVAENFNYCQETKLSSRVEPET

SEQ ID NO: 923494 - protein, 143 aa, Homo sapiens
MRGRAGHRLSGSGSIILGALSLNAAPVLSVSAGANLKAPVVPASDSSQGSQPRSPAGQFLLHYPGCSREVKKEERSLGPGDLRNLDIILNTQEISYGSKMNSEPHYVTDWILLLRHCYGKPELQLKTALTERNFSDGPGESGS

SEQ ID NO: 923495 - protein, 134 aa, Homo sapiens
MFKSAISSLASAPLSRGVKGSVSLAFQVLLGYGKKKKELLQLVWYLPNWLPSSVLETQGPGGVDTRRNLLVCGLQRPQDKCNICARAPQAQTLTASLGIPFTRLAVFIFTLTKSIQSQYFTTSHFIPDLLPTYS

SEQ ID NO: 923496 - protein, 157 aa, Homo sapiens
MIRNELSSRCLKSLNTQALRRSDFLISHSDPQAFGVCCPSSTWEKMKWSIEDQQLNTSTENDICHFVQVHWPNKLAMVAGRDTDEGGNHHPQQTNTGTENQTPHVLTHKWELNTENTWTQGGEHHTPGPVGGSGVRVGNLEHRSVGAANHHGTGIPM

SEQ ID NO: 923497 - protein, 184 aa, Homo sapiens
MQVFVKEKVERHQLAVKHTASLDVNASRQQPQGRFTENENLSRCILTSTRSSKTEVKMKGSLAPTAEKSFWNRTTILLLQLRVIQMASSQQRNGVVLEWQHRAPAENSDGIAACGMKGMWGHSLAWSWQWPMGSKAFPVGYMAAENPGWGEEWVLLWMLCWCQEQSGTVGAETQENWKKMIPRS

SEQ ID NO: 923498 - protein, 146 aa, Homo sapiens
MVLTLNVNMELYKAPLSRFKQFTERGSPIESSADYGSYIEPTYKTKTKKGKRDKEKEVVVVTTFLTQLGYIKPEALYNVESGVAFITSGAALDFQGIQHHIRGMLCCALSLQFSEFIQSCVHRFFNILLKNNRKERKHRLIMNTNV

SEQ ID NO: 923499 - protein, 173 aa, Homo sapiens
MRWYCIVVLICISLMISDVEHVSICFGSYKLVLLPICHFHSITPRCLYNIKMQGETASANEEAAAGYPEDLIKIIDEGGYTKQDFQWVNAAGDLMLKPALTYHSENSRALKYLGKSTLPVLYKWNSKAWMTAHLIVARFIKYLKPTVETYCSEKKIPLKCYCSLTIHLVTQEL

SEQ ID NO: 923500 - protein, 160 aa, Homo sapiens
MVQAPSLGSFPHAVESVGVQKSRIKVWESPPGFQRLYGDTWMSKQKFAAGEGPSWRTSARAVWKGNVGLKPPHRVSTGALPSGAVRKGPPSSKPQNGRSTNGLHGVPGKAADTQCQPVKAGGRLYPAKPQGWSYPRPWKPTSCISVTWMDNFRFLKNLQR

SEQ ID NO: 923501 - protein, 150 aa, Homo sapiens
MGIRDSLEEAVCCLTDLQLCAGRSTALFRADRQEHLLKLHLQPPLPPGAVSQGGESFIYMPLTGAAAFLSEMPCPERRNLKKQCGYSGFAACWDIHLLRHQSCRLSGFRSLGLKLPLSQFSDLWPWTESYTIGFPASQAFGLRLNYNTSS

SEQ ID NO: 923502 - protein, 188 aa, Homo sapiens
MWVGPDKRIKAGCRSQQWQLAVTLIAKVCRFTPEASETTNPPGGTNNSRPAALRAVTLTVKVCSFTLKPARPRTHQKEKTLNTSEYQKEQTPDTPPLRTVTLTARVRGFILEVTVDSTVGSPGNKIPFDIQNEACLEQCPVHGNTSNIVGRQQAPDIHLCGGKCITKAFPGPESKPLNLIRLVTDKRE

SEQ ID NO: 923503 - protein, 135 aa, Homo sapiens
MGVVGDESGEELSAQQTSPGITGSQLLPQQRGPVLLPETEYHWQVASGVFTVILINFWKHGVETDSEGKVSKNSNTLLQHLFLKILYQCVLFGRQFKVTESRTDILGAGKSKIQTPSDPMNGHTHLTNTRFQAGT

SEQ ID NO: 923504 - protein, 134 aa, Homo sapiens
MEQHILLLTASASCKAAESPLLAWTSLTSDDMGNGGQKLAQDTGHKDPADKTGCSKEVDQNPPKPTWRKTLPMIIFTAHYTLTVMDSHTKRHSDQHHDGLQMPWQHLEVTLYSLKRGGTLSSGKSMPLSQKTHE

SEQ ID NO: 923505 - protein, 262 aa, Homo sapiens
MRVIWLSELSKVSQVLGKLGLERKKSPDLGEYDPLTQADSDESEDDLVLNLQKNGGVKNGKSPLGEAPEPDSDAEVAEAAKPHLSEVTTEGYPSEPLGGLEQKAASSLVSYVRTSVFLLTLGISMILVLLCAFLIPCPPRDLHSTWSRHLGSQGGVSRPAANLVCLSGMNGSTLWSSLLPEEARDITCLELMPGSLAETICLVTGTHKMLSAFNATSGKAIWTLNPNYLSNGTLAAPVVVLPDLDEDGVRDLVVLAIGELQV

SEQ ID NO: 923506 - protein, 145 aa, Homo sapiens
MLSAKYLSTGAPKKKTTQHSAGDPALIPLSPPNHKGHAANPEADQTWADHPQACACPFPGSLMPENLGPSEGQAPGHRDCVQKQAYSHGIVRKLKVDKSRKKLLVDQAEAHWPKTKEVCKLHDECLQAKKEEIIKMLSKEEETER

SEQ ID NO: 923507 - protein, 206 aa, Homo sapiens
MKGVSKYGTFNQNIQREGKAATFGVLQLSLVILRVTGKFKVTRDWSGPPAYHSSPMAKWPDCYVGACSHISSPGRSSRFRPLASPHQSYEASSNLPPPGQSLQGQLKAFLPLPLQWNCPCYPWTNKGTKTLSVLSISSTSCSRPKERRPVYLLWVPHTVHCLSPERKLLALAHSTDTSSWANCTEQLLTHISLGRRPQETSKVVEQ

SEQ ID NO: 923508 - protein, 143 aa, Homo sapiens
MAEHNLGWTKEYRAKFLLLVQRLQIKLTLPAGVPGGYSKWRDLTWSPTVKCPVQRGRIQRGSLATAALPSCSRLCPVQTSQELCLHYAYIWHSVYLGNYGSNMHKGRRQLSWCGLDVNHLSLVSNPCWRGYAVIWRKEDILAF

SEQ ID NO: 923509 - protein, 144 aa, Homo sapiens
MIKHQGKPAFPVHDRRRSFGEEHEYRGLISQGRSPDQSHGTKFHVRPCEETTKQALCEQHGCLFHLGAGGLSPKESQQREIRVGPFYRIWVVTSGHLGIYVQVTGDVMAWLGLRGLTMFMACADRSGQSHQGLAVALASSSKID

SEQ ID NO: 923510 - protein, 248 aa, Homo sapiens
MMLTKSKRVIFLFNFKMGHKAVKTTHNINAFGPGTTNKHTVQWWFKKFCKGDERLEDEKHSGWPSEVDNGQLRAIIEADPLTTTISDNAQLSGWMEKKLQSKHFTKPNLHQKMVMVTVWWSAATLIHYGFLNPSKTVTSEKYAQQINEMHQKLQYWQPALKQSRLTEPNSYKNQTLTAIKEYKSKKPYPKEATSKIEGTSARQMRNNQCNNSVNSKNQRVFLPPNPHQGNPIRLTSELLAETVQARTD

SEQ ID NO: 923511 - protein, 151 aa, Homo sapiens
MILAVGGGKLPSLQTGPEVLSRSKGLRSKTLEVYLVFYCTAAELTLKPQDAVLPTLPYTFQRQRSLPRGHCHHKPTGSELPSGPKQVQKYHPRAKCWDWGPQKPTWCSTPLWPELVPKVQDKVTCTFLSTFLKQKDPCPTATTAENVLSLT

SEQ ID NO: 923512 - protein, 158 aa, Homo sapiens
MKELVVEPTYLIFHFLLMLLVSYPFQNPRHEDISFIFSSESFIVLAVTCIFLIHLGLIITYGVSTMCNRNAEIGYACLVPVLKGVLSKHARYLQDPLVSIDLSEQLGIVVSLGKFLIQTGFGVVTETGLGPGTDLIRELTGLDPVRGLLHLTGSERNW

SEQ ID NO: 923513 - protein, 685 aa, Homo sapiens
MELERVDEEEKEYTCKSLSDNGQPGTPDPADSGGTSAKESECITKPVSFLPQNKEEIERTIKNIQGTITGDILPRLHKCLASTVINLFGVQQTKREEEHKLVKSKVVNDEEVVRVPLAFAMVKLMQSLPQEVMEANLPSILLKVCALLKNRAQEIRDIARSTLAKIIEDLGVHFLLYVLKELQTTLVRGYQVHVLTFTVHMLLQGLTNKLQIFNHELFGAVAEEKEVKQILSKVMEARRSKSYDSYEILGKFVGKDQVTKLILPLKEILQNTTSLKLARKVHETLRRITVGLIVNQEMTAESILLLSYGLISENLPLLTEKEKNPVAPAPDPRLPPQSCLLLPPTPVRGGQKAVVSRKTNMHIFIESGLRLLHLSLKTSKIKSSGECVLEMLDPFVSLLIDCLGSMDVKPRSFRLPSSLFCVLIQPTEEFSAARAARVLLDGAELADPGAFKETKAEQLTKHLFLLLKDYAKLGAARGQNFHLVVNCFKCVTILVKKVKSYQITEKQLQVLLAYAEEDIYDTSRQATAFGLLKAILSRKLLVPEIDEVMRKVSKLAVSAQSEPARVQCRQGLLHENCGMFFIPLCLMTINDDSATCKKMASMTIKSLLGKISLEKKDWLFDMVTTWFGAKKRLNRQLAALICGLFVESEGVDFEKRLGTVLPVIEKEIDPENFKDGPGLALPVIA

SEQ ID NO: 923514 - protein, 145 aa, Homo sapiens
MLLIYNLTPKPLLSETRAVSTQGFPWHLHLLVFAVHCSLLSSWDENTLFFRYPKLGGGGCWRGSHSKGLCHIVEQFCDLTIVLSFPDNMYAGIGKDFRLLLPILPESFFPNIYFISGSQLPLSAIWFSHTSHIPLDIVYTFELQV

SEQ ID NO: 923515 - protein, 137 aa, Homo sapiens
MNTVARFFCSKRATLPDKSYGRTTVEEEDDRTVLQESGHEGNGVTFRKYTISHRPSLEKAQITDFSCGLLTSYPHLKAGCCSELFGCSAAASCCAPGSWPVAPADCEVLEPHDSNSSKGKRCVDKLSNLPKSLGMEL

SEQ ID NO: 923516 - protein, 133 aa, Homo sapiens
MKLKPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIREKSSLL

SEQ ID NO: 923517 - protein, 137 aa, Homo sapiens
MALMVDGKARIEQKGRKRATSHSAGAGISVFSCPWTAVFWVLEPLDSDQNLHIVPPDSQPADMGPNYTTGFMVLQFARGISWDLLSSIIMGALGMAFYLGNFNLKSLLCTGKSVSKERSDLGQVVNAPWIPPSSSVK

SEQ ID NO: 923518 - protein, 145 aa, Homo sapiens
MEKWYREEYNLLYGKWKGQTSLQRCGIQVHYQFYTRKADLENGGLASYIPAETCLYWDTEAPSFLVISFQKDGSQVFEKDVPFLGYRMLISQGKLIFCPKHLNIKPHLSAMPWYCTIMRERERSEDNTMTIGREKSHSQGNKERT

SEQ ID NO: 923519 - protein, 143 aa, Homo sapiens
MTPVALIPGDTTLIELIYLAWAQQLNQRESVIKFTKHLLSTDCSMFLAFDSASREEKRLDVGKRQLDFRGKRTALPVPFQLPSLLRNAFTTLQFIHTTSFSLSSRQEFGIYQVQVPKKAVTLALCPHWQRAAAPCDNGKGPLS

SEQ ID NO: 923520 - protein, 132 aa, Homo sapiens
MIQGRDLTVWTSHDVNSILTAKGDLWLSDNHLLKYQVLLLEGPVLQLRTCATLNPATFLPDNEEKIEHNCQQVIAQTYATRGDLLEVPLTDPDLNLYTDGSSFVQKGLQKAGYAVNNPPLNTIWLTLFTPMI

SEQ ID NO: 923521 - protein, 164 aa, Homo sapiens
MINIISYLLSPNDKGCSNTQDWQKNTGVVCHTLDLESATPGPWTGSSPRPVGSWATQQEVCYKLNIHQTTGNFILMFGTEVHLLITVDDLFESFATFRFVSGRNGVEVSNPHFYDASQQNVDLITKKECEEINPEIETQIQEIPGHEVTYDENRTVPRSLVGVV

SEQ ID NO: 923522 - protein, 148 aa, Homo sapiens
MAPGRLLSIHSEKFVITDLLKPTSVNSSNSFSIQFCFLAGEELCSFRGEETQASQLQVCWSLLEVHSRSCLPGYHQQSLQDRKYCCLILPLEASSQRGIHVYEVSVGSYWEVSPGQATQGSGTHLRRQSVHYQSLNAMLGEPLLSSEL

SEQ ID NO: 923523 - protein, 164 aa, Homo sapiens
MAGYPFEMKLPEERSGSNICCSAIFTVLQPPLLIPRQTGSGVDLQQTPTDLQLRVLTVRRKTNKQKGHPHQNPICMSSSSKTKAMEQSWTEDDFDELTEEGFRQSNFSELKEEVRTHHKEAKNLEKRLDEWLIRITSVEKSLNDLMELKTMARELCDECTSFSS

SEQ ID NO: 923524 - protein, 171 aa, Homo sapiens
MPLIPSHFAGLILKLTNPGFHETLTEGSFLSYVLTAFTPSTPLICTQEERGNCFAHFLGPNCQVSSLKPKSAPEGSTHCDPLEQLFAVDDIKQGELLSSGTQHVLFDHFFHCKLFHSRAWAFFSATFPPVWGKAVPVPVSVLNILQPEHVELSFMCLFQDNRADWASGHFR

SEQ ID NO: 923525 - protein, 146 aa, Homo sapiens
MALHLGPHCLVEMKLSTDWMMPALIAHEEDPKRTLALTKLPTFSWSRWFMNVVPSGELTTPDVFTLLVFQCQPLGPKIQESKPLMSEGRKGWLSQLKTRKGIHPSFAFFVYPGTQQIKQCAPTLVRTICFTQSTDSSVDLFQKHPH

SEQ ID NO: 923526 - protein, 140 aa, Homo sapiens
MWRTFVTNSGIVKVPIAPCQNRPLGSTNQQDVAVTLTAKVCSFTLEASETTNPLGGTNNSRRAALRAVTLTAKVPSFTPELARPRTHQKEDTPNTSEHQKEQTPDTLPLRTVTLTVRVRSFILEVSETKNPPIPDTLGSH

SEQ ID NO: 923527 - protein, 256 aa, Homo sapiens
MANSGLQLLGFSMAMLGWVGLIASTAIPQWQMSSYAGDNIITAQAMYKGLWMECVTQSTGMMSCKMYDSVLALPGALQATRALMVVSLVLGFLAMFVATMGMKCTRCGGDDKAKKARIAMTGGIVFIVAGLAALVACSWIGHQIVTDFYNPLTPMNVKYEFGPAIFIGWAGSALVLLGDLPEDFEEKSLVINSETSGNSWLEFNMFIDCSISRLMSGSLVFTTLGRSTNINNGRTIIITIGFIRKSVQPHDSLLIK

SEQ ID NO: 923528 - protein, 175 aa, Homo sapiens
MDPENLPVINNYLDANEPVSLEARLSRMHFHDSQRKVDYVLAYHYRKRGVHLAQGFPGHSLAIVSNGETGKEPHAGGPGDIELGPLDALEEERKEQREEFEHNLMEAGLELEKDLEKLALKFSVAWHRQQVYGLFLEGTAYHQGSLGAHSCFREVEPYSVSVSGRGRGDFQKFCL

SEQ ID NO: 923529 - protein, 135 aa, Homo sapiens
MKHPVQDPLPPPGGLEDSLLSPWLHGKFFQGPGEDDKASHGQSPFLYYGSCLEVLAASLPTHWHIQVNAECASNLSHWSTLDNGTDPCLKPFGTLSEEIPRFLAEGWQRGSQGTGRFCKDHGEARAQQNAPISCS

SEQ ID NO: 923530 - protein, 278 aa, Homo sapiens
MWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNRIPLVNL

SEQ ID NO: 923531 - protein, 118 aa, Homo sapiens
MTPLMTSSPATFLWHGLKHCFSSTRSTKALEARQEQPRWKAPGRGGAPAACLFPFRGRICHLVNTLQVPDTLLAACEHCVTSSSSDYSHRMKSYMWSTGSATVHIFSEAFDNKAKWPP

SEQ ID NO: 923532 - protein, 785 aa, Homo sapiens
MACIHCLRENREKFEAIIGGSFEGYLKRLENPQEWVGQMEISALSLMYRKDFITNLEPNVSPSQVTENNFPEKVLLCFSNGNHYDIVYPVKYKESSAMCQSLLYELLYEKVFKTDVSKIVMELDTLEVADEDNSEISDSEDDSCKSKTAVAAADVNGFKPLSGNEQLKNNGNSTSLPLARKVLKSLNPAVYRNVEYEIWLESKQAQQKRDYSIAAGLQYEVGDKCQVRLDHNGKFLNADVQGVHSENGPVLVEELGKYTSKNLKAPPPESWNTVSGKKMKKPSTSGQNFHSDMDYRGPKNPSKPIKAPLALPPRLQHPSGVRQQQKPAEHVSLSNPAPLLVSPEVHLTPAVPSLPATVPAWPSEPTTFGPTGVPAPIPGRSVTQTLTPGPDSAVSQTHLTPSPVPVSIQAVNQPLMPLPQTLSLYQDPLYPGFPCNEKGDRAIVPPSSLCQTGEDLPKDKNILRFFFNLGVKAYSCPVWAPHSYLYPLHQAYLAACRMYPKVPTEASVNGQMLQPVIGPPTFSSPLVIPPSQVSESHGQLSYQADLESETPGQLLHADYEESLSGKNMFPQPSFGPNPFLGPVPIAPPFFPHVWHGYPFQGFIENPVMRQNIVLPSDEKGELDLSLENLDLSKDCGSVSTVDEFPAARSEHVHSLPEASVSNSKQREREIVPVELEPKRTIQSLKEKTEKVKDPKTAADVVSPGANSVDSRVQRPKEESSENENEVSYFEKWGGYQHVRSEESWKGQPSRSRDEGYQYHRNVRGRPFRGDRRRSGMGDGHRGQHA

SEQ ID NO: 923533 - protein, 138 aa, Homo sapiens
MLIRATLGCHCGPEAARGNFWLCVIHIVVMALSKSLNQDPHSSIDWNFRCVPHRVILVLDEGLMLPSVLSCQTKNLITTQCPSCFAPSVTAPTELKPTSAKWNCNTIGGFQGHIYTLTKNCRGGKPLTPRNESLVIGY

SEQ ID NO: 923534 - protein, 188 aa, Homo sapiens
MPNEAVRNTLLFAAGEIGDEEAFPAKVTDLGCQLQASVFCGALDGESKPHGPGSLTPAAWGSSKLHAGFQPHARSITGHARNRQEGIIVLFGWFRRAIKGDCGDKWREYGSKELGPLFTPFDTPLLLVHVPTLADFGVFLDSHTTAQIELQRGQQIYTVHKYSPSVCYKLEPPGPKKCIRTQPLNAEC

SEQ ID NO: 923535 - protein, 166 aa, Homo sapiens
MLTMKGKWASVGNKPLLATISGSHISHKALVQQVSREERSRAFVRRGQNTKLIVMFVLLFRRHVNIFLKIIQTRHKWEQDSFLDGKHLKAQSDTSVEQSDLRRNPQQEGTALRGTGQHNVSRMSSNLMTQNPAELQAPSHGCRSLPFSTPKTQSTTSPCDPFIPYS

SEQ ID NO: 923536 - protein, 136 aa, Homo sapiens
MAMKGDEQPHHCPIHLLRKTLPTTHWDMRLAPGSWEPGLQNSTTILKNTGNEKDQFTCGRCAYSYSSYNPIDFQFGALERPQMNAEAKWKSPVGFFLLWYEETHANDLFMRKPIENSFPPTVKVHRVQPPGWRTDL

SEQ ID NO: 923537 - protein, 160 aa, Homo sapiens
MKLPEEESGSNICCSAILPVLQLLLVIPRQTGSGVDLQKTPTDLQLRDLTDRSSSPAMEQSWTENDFDELTEVGFRRSVITKFSELKEHVLTHRKDAKNLEKRLDEWLTRINSVEKTLNHSMELKTMARELRDACTSFNSQFDQVEERISVFEDQINEIK

SEQ ID NO: 923538 - protein, 165 aa, Homo sapiens
MEATGFRTSLTDGPAGLMGPGAQTLASVAQTAIIAQEPRLILEIKGRKVDLLLNIRASLSLFSSLIQASPLPIKGYTRQQFCQESTLNKGDRVIYNLTRPPYCCVQFPIAGMGPHILYLSRLASNLELFKRGKGRGEQKKEEVTCGMLGKEVARKNRHPTPPDSS

SEQ ID NO: 923539 - protein, 143 aa, Homo sapiens
MLAGHICRECAEVWGPAPPEPLAATLELLAVGPQPLAGCWLEAAFSSLLWGPSHYGCLLPQHQQGRESFPAREVTVLCKVITEVMTRHPGCILLVKNMSRSCPLKGRELHWDEYLEVGIMGTTLGTVSHNEETGVEVAGGFIS

SEQ ID NO: 923540 - protein, 162 aa, Homo sapiens [sequence omitted]

SEQ ID NO: 923541 - protein, 148 aa, Homo sapiens
MFVVVKVRGGDGFNRVVNPGGRITQANIMYFKKFLTHIAVSSSSLDIYQRLSIFSHCDHECECILNKQLNTRINISLAPKIPKTCKTACDGLNVFAPCSTKFISALSEKPQELSFPFYHMRTQREGSIYKPGNKLSPDNICWHLDLGL

SEQ ID NO: 923542 - protein, 140 aa, Homo sapiens
MKLKIWSMNFLFSSFPLFIEVILPCDSVTSSLDVGSVSTHRTLSPCRKPTLQGNQHGFACQWREVEKNASRQRAWTPQRWLKGTDIKETQLDSRFLSTWCLIKLSSRFIGLYVPSGPGDAFGIDLIYDIKIPYILSEMKQ

SEQ ID NO: 923543 - protein, 162 aa, Homo sapiens
MGTHLLHQCDLGGSIWDRRLCCCMIGLGLRRLAFPPSKLGISIHYYEEDKDGYSIAPAPSVENRFSFPFNFLDTFIKNQLTENERGYFWAFNYIPLTNTSVLMLVPYSLYYLIFVICKELPNPSCPKVLHYPHSTQLGSTFQPETWCDPISFPVLGPSSHFF

SEQ ID NO: 923544 - protein, 140 aa, Homo sapiens
MATSPTALNVKTFSHFRFTPNLKIFSHVWSNSLVFASPNNRSQQGAPKSGRPGRPGLAAAYLKIDGEAMGAAVDAGLAHHKQALKQKEQKHPPAAILQEEVKEVQKQEHLKVQDGFLRKSDVFLHHHHGATLLFTYSQLH

SEQ ID NO: 923545 - protein, 143 aa, Homo sapiens
MKLGPGRPGQREFTAESSREETAAQTANSRDLQRDSDGNQHMHICNEASSPNPDPNGQDRNKNRAMDQRRYPIMTTNTCCSQTVSRILSRAHSGAFTSAPNGWIPGMFSQHLHGCFPAFQPQPATRASVNSSAIGGPIAVLLQ

SEQ ID NO: 923546 - protein, 262 aa, Homo sapiens
MGRAIVVCSGFTPDPICLGLSHPCRCHQERLQNSKDGCLLLPLRALSQRGTNLLPLGGTGSGTHLTKHSGCPLADGVHCTGVNPNPTCPDCQDSSEPGGKKTKSADPQRLASQPPLPGALCQGNQSSVHKPLAGVAEIPAGWTQLMKRDGSCSSLKKQSGHSLPQTLCCTLENYSWVQTSQTPKYQQGKMADWSCSDGCCLRPCELHRLRQQAPTVMVATLPPGNSGVLGSLQLGSHRESAQLCAWDPRPLWCGLTRGSPHL

SEQ ID NO: 923547 - protein, 130 aa, Homo sapiens
MGPHSRSSVTPNVNFTYEGSRLHAPYENLMPNDLRWNSFIPKPPPPLSLEKLSSTKPVPGAKKPHKNRERLQDPTDNIRSLRKKTNKEILDLKLTVDELDLVDIYGIHYRVHVPLICTRNILQDQPHAQP

SEQ ID NO: 923548 - protein, 150 aa, Homo sapiens
MTCARVMGGLPLSPSAAWCCGSSGLNQGSVPHALEAELGGRRESDSKELPGYTLPGAGIQLQPRTFIHLIDLFSKHLHQALGLSASLAPVNTSDKLPAFMELTVYNKKYASGENGVLSTEKGDMSNARLPSSVGVVQVAYQERLQSRRAG

SEQ ID NO: 923549 - protein, 135 aa, Homo sapiens
MKHMVSRSLAARTRLGSTKSETVKVTEAAVRIDSLESLRQLSGPSCKGDKIEIITLVPQQTGLEGCESQVKNILLKYFIKFDPGDTDETRSHHSHQTDTGTENQTPHVPTHKWELNNENTWTQGGEHHTLGPVGG

SEQ ID NO: 923550 - protein, 169 aa, Homo sapiens
MGIHDNEMSLITVQQGCVKEIFERKRIWGQLWPALDLSNSPVRFLVPALSPAPTAHIRARDPFKDKPYHIALLFRTPNLVRDTYCCHRAFAYAVLPPPYPKTPIHTQPSPPHHSTGKPDLLDHLGPLNICFLGAMSPFMTPCQAEFPVGRLKSSSFPVNMHSFFAPLMS

SEQ ID NO: 923551 - protein, 116 aa, Homo sapiens
MVRKTQRRWCEGKSLGNGERRGSLFVVEDGFSKAGWKREEWSRPEEGRMLEEGIGLFYQHCTINKILTYSMLFHKTYLKKVRGKNENPPSMKMEMGIQLGLEKAKQYTIQNASGCK

SEQ ID NO: 923552 - protein, 164 aa, Homo sapiens
MECVHVVEFEEPKVAFPISSCFISAEFEKLVTSSFEAFSPHCWFHVTTLIVFFSKFPICLDLNIMTKSPKLSFLPWPHRLVLFLVYTFKDGIPSRVRWGTFCALPLVSSLLPPFMPNSIHLQQADDSQSLLGSRLMPMTTGSLISSTPKTKSVSSHCNPSILYF

SEQ ID NO: 923553 - protein, 143 aa, Homo sapiens
MGGADQERSHWESCRRPPGSHGLPTVPSSSSASSGSSDCWTLQTQTPTPLQQEPTPLCPRNPLLRAQHEDCVQPLLRPSLTRYLQISSRTYMHVVAERGTQQWLDEEFPKLLPQLLPTFLMVYSQLQKKLCAPETGPHPHPDI

SEQ ID NO: 923554 - protein, 354 aa, Homo sapiens
MILGSSANPETAARGEGGLLQRKLRSLYGYFYHGLNLDDGKEDPCIPQRDMFYNGLYYTPVSNYGDGDIYNIVRRHGCGTSSVSSSANLSFLIPDTITQWEASGFCVNGDVGFGISSTTTLEVSQPFFIEIASPFSVVQNEQFDLIVNAFSYLNTCVEISVQVEESQNYEANINTWKINGSEVIQAGGRKTNIWTIIPKKLGKVNITVVAESKQSSACPNEGMEQQKLNWKDTVVKSFLVEPEGIEKERTQSFLICTEGAKASKQGVLDLPNDVVEGSARGFFTVVGDILGLAMQNLVVLQMPYGGGEQNAALLASDTYVLDYLKSTEQLTEEVQSKAFFLLSNGIHISPEVQP

SEQ ID NO: 923555 - protein, 243 aa, Homo sapiens
MYTYIKLLNPDNSPIPNEVVQLHLKDKIVGNYTTDVNGIAQFFLDTYTFTYPNITLKAAYKANENCQAHGWVLPQYPQPEYFAYRFYSKMNSFLKIVQEMEELRCNQQKRVLVHCILNMEDFEDKTYTADFNYLVNLNFSKEKSLPGSNVDLQVSAASNSLYALWAVDQRVLLLRNYGQLPAQTVYSQLHSSELHGYYFRGLNLEDGLKVPCLEDGHILYNGIYYTPAWADFGKDGYDLVKNS

SEQ ID NO: 923556 - protein, 152 aa, Homo sapiens
MTLSIQELQKISHGGSAGGKDDPGLSPDGGAWQKQRSSCHQGSSAEPSELDKTPEAAEGEWEGAQSRYSLQGRHLLRSLHSISPFQSDLCGKHPPPDPRPGQEASKLDPPLNIYWSWRSWSSTVCLASGTVRSDVSRGRKNNPKTLRQTGCQ

SEQ ID NO: 923557 - protein, 197 aa, Homo sapiens
MSSQRRARQATPQRPQPTPPAASAPPNCAPRAIEGGLGPSSRAAAGREGPGLLPTGTERQALLLTLTPSSSDGQAVRTASPQVPGTRELTTDSQGQLVSPWFPAREPVSTVEPQDSTIRAGFSKAVPLSSVTSRPFAAHCWHLAWALRLPNSSLQRKQETNGAFAALLSQTHARPAHGKGAREGESGGAEAWLLLLL

SEQ ID NO: 923558 - protein, 150 aa, Homo sapiens
MDPLRLSSTFLSAKFFVFQHLQGRDKEGEEEGDKQGAEWGSALGRTLLQSKRGVRQPASCCLQCMGMLSLSLVSWGGKARIFGSSSLPSHGQPSEDEALCKAYSTGRLGLTGTLLDATLDFSDLTIQPSITGIILFPPSLRDGSSAYSAL

SEQ ID NO: 923559 - protein, 136 aa, Homo sapiens
MATILNSKDIQNLPTIVESSTGQCYNICGIEEKVSLVANKQVSNTDFLHPVRQLNDERPQEKESFHVKKWPPTLTSRSKRDATLDVLAPHGPPAGFSLEDGEHLKPIHVSSIFLSDGFWKHADWLQVLPRVPEQPY

SEQ ID NO: 923560 - protein, 162 aa, Homo sapiens
MALLGALSPAIPGCLYLLCCPGAGPPALLVPRAGRGSQCCRSSLSCWPVVARGHLPRLSESPGSRATLTFSGYYRGTHGVIVVYDVTSAESFVNVKRWLHEINQNCDDVAALTLPSFEVGNKNDDPERKVVETEDAYKFAGQMGIQLFETSAKENVNVEEGN

SEQ ID NO: 923561 - protein, 121 aa, Homo sapiens
MRRLQEEAEEAARPVGCWCWAQRREGPNPGLGLSLSSAGSLTAEQGGSGPEHEPCRPRLSSVCLPRRASPWPVFRKGIWEQLVLHKDEGKGQGSSGRDVLGVGKSSLLLRFADNTFSGKKG

SEQ ID NO: 923562 - protein, 2154 aa, Homo sapiens
MGSLGRDHRVLERPGKAFRGALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLVAVQSGLWPALLARMKIDPEAFITRHLDQIIPRMTTQSPLNQSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 923563 - protein, 399 aa, Homo sapiens
MLSDRKRELEHRLSATLEENDLLQGTVEELQDRVLILERQGHDKDLQGHLTALSHTQLGILQMSAGPSPSDWVDSISRAQALLTVGQPRKQGYSRSLVPLANHFEVLTVKEVRLSCRQLQVKVEELTEERSLQSSAATSTSLLSEIEQSMEAEELEQEREQLRLQLWEAYCQVRYLCSHLRGNDSADSAVSTDSSMDESSETSSAKDVPAGSLRTALNELKRLIQSIVDGMEPTGSRRLDDDSLEEQIRQTSEDSRALRELMEGERGKLRQSLEELQRLHSQLLPYFKTCILSHPGYGHHFPIYLPSPSPPTLTRFGLIFLKRDLKVGRPLQVLAGAQGPEKVVVPFAEAWATEKVTLLSVEMTALKEERDRLRVTSEDKEPKEQLQKAIRDRDEAIAK

SEQ ID NO: 923564 - protein, 164 aa, Homo sapiens
MPLAQGVHVHPGLSVLRKNAVELELAKCRMDMMSLNSQLLDAIQQKLNLSQQLEAWQHSYIGFSVDFTEHVMEGPSQPNFMPSSRQWLLGTKEVICPGHREPALNTGLTCPDDMHRVIDRQLMDTHLKERSQPAAALCRGHSAGRGDEPSIAEGKRLFSFFRKI

SEQ ID NO: 923565 - protein, 211 aa, Homo sapiens
MDLDSNPCSLLLLFEGLWTCYLTSLNLSFLICKIETVTPRRVVVRSLDYGKYQEEDEEEGGGDVDISAGRFVRYQFTPAFLRLRTVGATVEFTVGDKPVSNFRMIERHYFREHLLKNFDFDFGFCIPSSRNTCEHIYEFPQLSEDVIRLMIENPYETRSDSFYFVDNKLIMHNKADYAYNGGQPLVDRLHKPSDETIDVARVQLASVEGCH

SEQ ID NO: 923566 - protein, 221 aa, Homo sapiens
MSLLLASRSPQMKPGNCVPGQMIKRDVGQDRAEDEARAHPFKVVRLERGSLVRQSNWCRDPGAGSLVFRHLVECSDHRAVPLRLCPVDTHFLSPIPHKRRPAAHCLAASPLPVSQVLLPLPNWFPFLSSLDLEIYRTLKCSSVSAAVRIFTASLQDVCIKHLLTTGSVRDTGSPAQASAIYSKAQSYGEKAVDSTLERTVASLRDLVWEWLPHPLPTSQAC

SEQ ID NO: 923567 - protein, 158 aa, Homo sapiens
MKKRMVLSLPRASKADLSLNTSRCLLVTETQGIHAPLITLLLGSDSKVLERGQEVAFLTNPQVMLMLWPMDHTSCSIAEIDSFPMSVPFMNSCSETLLFLFQNNKSLWQGMYYSMTPALSHRQLDHRRRPDPSWTNRIFSLGNLEFRFSNASQSLLVS

SEQ ID NO: 923568 - protein, 251 aa, Homo sapiens [sequence omitted]

SEQ ID NO: 923569 - protein, 207 aa, Homo sapiens
MAHVDQFQVPKLALAVHLLTKEKLAVSTLLLHQTCDRVEHNSSSYSLGAFHTCSGCGGSYSAPEQAWENAYNFVWCPSLSVSPSFSPSWRQGFGGTKCSPLAWLHGSPVERRPHYKAVCDQHYGNDPAKSYRSSLKKEIPGSCGKYGMRKFLGGEIGFTVSKKKIGVVTQSSGKVQLHPASHVLDSTQEDEKAIHVDFYQLRYLQAQ

SEQ ID NO: 923570 - protein, 147 aa, Homo sapiens
MTIYIYENLCYNFILRYVPMTQPEEVLTNMCPRWTGYSLVLHVLGRQETSVNICKKYTGSLQKVRDNSKQGGGFQVTGRVLGPSPHHCCSIAGGLGRKTKRKREEEEEEEEEEEEEDEEEEGRKKEEKEGGERKRKEKQNTEISPSL

SEQ ID NO: 923571 - protein, 134 aa, Homo sapiens
MCKAFEYGEYLWNVQEKAWNPPYVWSRVNKGESNQRCGQKDKTGLLYYIWNWTTTLVQFRQMDRVHSTKPGRSQATDCLSLLRDKWPLSSLCLFVLYFDQMIPLAFDLPGICCLNWLAFIGIQDLWVEIGCWYF

SEQ ID NO: 923572 - protein, 197 aa, Homo sapiens
MEGALSTKILGPRERLYSYKRHTQNNNHTAFGEEANAGTTRYNGRKKPGSAKARLSKKNKSGGITLPDLKLHYKATVTETAWYWNKNRHIDQRNRIENPEINPNTYSQRLLDKANKNTKWGKDTLFNKWCWDNWLATYRRMKLAPHLSPCTKINSRWIKDLNLRPETIKILEDNVGKTLLYIGLGKDFMTKPQKQMQ

SEQ ID NO: 923573 - protein, 138 aa, Homo sapiens
MSLCSFFAFCHNCETYLCKGRNKTMLQVLSKKQEFSGSCKLPWNSPLPDQNSQKYRELRPGYLKSITVHLTVRVREWRCLEQNSDRTGLRMAKRRRSHEWKNTEKCRSVGEETQVKLLRADHKYFRPYNALSIVPRAS

SEQ ID NO: 923574 - protein, 173 aa, Homo sapiens
MIDILWEWQDLERLSAKKKYYRIIIFLSKVSNILEEDHQKTAWYNTPKTADFEFHFELASLLKNLISLKGTRSPVFVPHRGICAGNKEVTGKRQSGNKIKHEQMKVVHVEKDGHEQMKVVHVEKDGHERMKVVHVEKDGHEQMKVVHVEKDGYEQMKVVHVEKDGRENSRAGC

SEQ ID NO: 923575 - protein, 147 aa, Homo sapiens
MEQGKLRGRVELSALHLSASGTIHFRRKFPDTHSLVVKYLNYSNVVWCMQQESLKSMLTAPTMETIQCHYRHYPPYSGPSKQARPMCVELVLLIHLHVVKDFQELDEIAADLLYHQSELCPSPYFASESSPHFQHQQYIPGFFHLTA

SEQ ID NO: 923576 - protein, 141 aa, Homo sapiens
MPFFNQMLPFLILPTASLGMPICTLRGTGQSCQESAPYAGEESSFFSSCVEVLGLHWEDEHPWALAQWQLPGVGVCDSQSPSGHVLWCALLALPSTDGLSIRQLSGPSAFLQGQRASVTALYIPGSCPASRKSLITHGLEG

SEQ ID NO: 923577 - protein, 126 aa, Homo sapiens
MVCVTRLSRFATWCLSGGETNFLHLYDRGSCASWGKGLQMLCPYLHTERKSYLPNDLVCDLKIEKGPKALLTLGLSLHIKLPGILSEFGLLELADPVCISDQPSIFQGQEFGDRVTISQTDSSWRQ

SEQ ID NO: 923578 - protein, 186 aa, Homo sapiens
MASSGRPESAALRDNFSICPYRLMVLQAENSKGMALASGKGFHVGSQHGEEGQKPKDLVPFVQAAPAMAERDQRRAWAVALEGASPKPWQLPHDVESVSAQKSRIGVWEPLPRFQKMYGNAWMLRQKFAAGAGHSWRTSAMAAQKGNVGSEPPQRVPTEKTASEGFLECGKCFWRNETGEKRVLVV

SEQ ID NO: 923579 - protein, 158 aa, Homo sapiens
MRQMTLEATFCKTIQQNASSSLKDPVPGPSIAFHVSSHLKTKNTVDSYLSIKTQHGRDGKPAVVCCCLTAETVAQTVVQKESGLQHTRKMLHVGDPSVKKTAISLLRNLSRNLSLQNEIDLAATQGPPGFNICLLPLPPTPDPTTTTTRFIPMLSTGS

SEQ ID NO: 923580 - protein, 144 aa, Homo sapiens
MGKKQSRKTRNSKKQSASPPPKERSSSLATEQSWMENDFDELRGEGFRRSNYSELQEEIQTNGKEVRNFERKIDEWLTRITNAEKSLKKLMEPERKVGLPTKGSTSDKQRISQQKLYKPEESGGQYSTFLKKRIYNPESHIQPN

SEQ ID NO: 923581 - protein, 204 aa, Homo sapiens [sequence omitted]

SEQ ID NO: 923582 - protein, 265 aa, Homo sapiens
MQTYVEERVVGKPFQALLIAISLRAADFTPEASKTTNPPGGTNNSGRTIFMNCNTYREARPRIHQKEETPDTSEHLKEQTLDTSSLRTVTVTASVRGFILGVSETKNPPEGTNSGHNAIHFCLLHFLLTVRPLCCRSAGVCWRFTPVPVCLGVSPVEAAEQQRLLPVPSSGSFIPKGHLPDASRSSPVCGVCQPLLGGVSQSGGRGVREPLDEAVCPLAELNCCALETHCCLQSCQAGTAATLNQFWQLGHLYSCLSHYFGLVLG

SEQ ID NO: 923583 - protein, 141 aa, Homo sapiens
MCSNHLQEEEHLDGQLQEPGQVILGSSPTVTSKDSLGVNQLSALLVPRSLSSVQEESGHTDKLKDDKCRGFYCQMEVTVSGKDGELERRWSGKMIVPWSSAIPRLISSLTTPSRTPLDIQTLLLLSPSVPHCCSAPLLFCS

SEQ ID NO: 923584 - protein, 132 aa, Homo sapiens
MYSHCSTHTYEGALPGEEESTEAVWLQQLCLAVVGSTQFKLPDNFVYTVREKLPTQASVMADTPLPTKLQHPRSTSDCCAGSKNFKPMEMQKSSAFCTDITGSYRPELFLFGHILPATSFSLKSILSNANNS

SEQ ID NO: 923585 - protein, 128 aa, Homo sapiens
MNVHIMLSIPPQAPSTRLILDLDFILTSETFSSFFLIKLCLYPIPFFMRLVFDFDENSFWLIYEFRKQLSWCSPESSYPDFHVLSSIFYTSEEIKNSILCAKIQHNMGRRRHDSGNETTQQQLTQNDK

SEQ ID NO: 923586 - protein, 184 aa, Homo sapiens
MSHAHIWDLPFIKPSDVMRIIRYHENSTEKTHPSDSITSPGSVPQQVGIMGTRIQDEIGVGTKPNHIRDLLNGFDQNADSDMDNRVRAGVVSDGDEELVGNWSKDVPVYALAKRLVAFCHHPKAMWNFELERDDLGYLAEDAPEGISWFTGCKDHGKSVVSGPDSIVPHGTVPQGSPWLEEGVP

SEQ ID NO: 923587 - protein, 142 aa, Homo sapiens
MVSLAEMPSRPDGWLDPEERQQSMHFSLQEATPIGKGGVHYVKGTPRGTKESEQQSSALDLSSDRGYSNEKEPENQPWFSKVKTKERILRCETEALAKNFVSTKTKHHTGRKDTVIFRQTNADRIHHYQTSTVKTAKRSSKS

SEQ ID NO: 923588 - protein, 166 aa, Homo sapiens
MIGKHVLSITIITTITITIIAIAIINIIITITITAIITIAITIIITITIITTTIITITITTITINIIPPSPSSPSLSPPSSPSPVITITITTIITITITTIIITIIITIITITVTTSSYQHHHQHNHHHHHHRNHQHHHHHPSPSPPSLSPPPPSSPSPSSSSSPC

SEQ ID NO: 923589 - protein, 141 aa, Homo sapiens
MGDDVHPQQTTNTGEEPLDVIGLSLDENDRELQGRSHAYDQHLNMILGDEEETATTIEIDEETYEEIYKSRKQNIPMLFVLGDGRAGCPSIDSWMKQFVLYGKYETSYSSLSKCTRHSKEKPAYILILRNNSGDSPTPEMN

SEQ ID NO: 923590 - protein, 180 aa, Homo sapiens
MGSRCHGSFPGLTASEMLLGFGKQQLSVLLALGEATCHTASHSTLWRGPHGKETEAFCQQLCEWGILEVDCAAPVKPSDEHSPDWHLNCKSEYLPYVKQCWAQGCTNKQDLVLFPEGSLRADKLGSAHGLKLVILPPLLLKLNGRESWIWWDVRPTFPNQRQKDVQQGLAGKKDCAQVRM

SEQ ID NO: 923591 - protein, 158 aa, Homo sapiens
MDLIKMKTNSADLGWGWRLHISKELPGNGDAVGSSTTLQMLKQLRRCQWKTAQDETAAKETQIKKLNSEYTSPETSKKFGFQILLYNLSVEKYIYLYNEDANEDYKVVDGEHNETIKAFSKVVVPFYTPTNNMEIAFSIPKSQFTSKCWEHKFKLKHS

SEQ ID NO: 923592 - protein, 140 aa, Homo sapiens
MDLITFPLFPHIRQAAYGTDLKKQLYLQLPHQTKDTNCCGLSGTFCFSADNTLALGAASRITGPTWRKSKIKALADSVSAESCEGPVLSLGDPGLNPSCSTSTISKTTALGIVSPPVFFHPHTVFSPPDLSSFPFFISNI

SEQ ID NO: 923593 - protein, 142 aa, Homo sapiens
MYVEEYFMFNNVINFRYFASILLRFIVFTFLSDIGLQVFVVVVVVVVVVSLFWNQGNAGLTEWVRENSFSSIIFKSLSRIDINFSLNFWFNLAVKPSGLGLFFNGKPFIISISFSLLVCSGFLFLHDSILVGCISLGIFHFF

SEQ ID NO: 923594 - protein, 141 aa, Homo sapiens
MPLLEHQCLLHNSRLSPVCVDTWSPVINRAKPKIRALEFHCKSVGCVRLLALCLCYTVVLLQACQQECYLKSAVQALHRARERISALYQHARFRDFLFDSIYSKGVKLLTKKLKAPKWKVPKAPSLNCKPCLIIFAIFSQS

SEQ ID NO: 923595 - protein, 179 aa, Homo sapiens
MDPKTQWPTTTGTHSSTQLMCSASGYSSGSEPNDEPSHGYMAVITNRVIHLRSKLTEKGKFQIAKANWRFVAGPEPEDFTGEEFKLGLNRWNWDFSTRLKEQSGKRALQLYSSSCIDEFPKELLCQLENPPLSEKDLRESSAKIQQSSNTPPWEGVSEDVNRPGSCCHNVQSKSQETLT

SEQ ID NO: 923596 - protein, 186 aa, Homo sapiens
MKGYTIGSEPGQPWLRSVLVCFHAADEDIPETRKKIGLTGVTVPHGWGDFRIMAGGERHFLHGGGKRREEDAKVETPDKTVRSCTLFENINVYNTIKTLSKPTEIAKPTEKGTGTKGGSFCDKKLHYYLMANGLESRRYVTDLFQGLQWCIWSQLISSLKKMSTLVNQTQEFRRIFENQGLIEPVA

SEQ ID NO: 923597 - protein, 149 aa, Homo sapiens
MGETIPMIQFSPTGSLPQHMEIMEATIQDDIWVGTQPNHFNGLPQNGSLGPKRIPHTEYFIISKDLLAMVLEAGKSKIKGPVSSKDDLAMLSHGGRTKRSLPEKETEISLGRPTGWSIFGTEYHKGDGYTKRNQHRLEERDFLKSLVVC

SEQ ID NO: 923598 - protein, 145 aa, Homo sapiens
MNGATHISGKKWNSSEVPIGRERVEATRAQWYAAGRDGMTPFEQKCHADLAEKMPGCKLCKWYLAAAIKRTESIYNQSDLKPPITHHCLQGHEAPAFSVCNTVLLCSSNKKYLGILVSVGVKEYYRGRNQNPKTKKLFRCGYYIP

SEQ ID NO: 923599 - protein, 126 aa, Homo sapiens
MSPIPMATSCSPHVNEVVAHNQSDWLQKAANQRLNIFISFDPEILLPGIYPKAIDELRNKGLPAVLVTIGQPHLLNKFNFVKAYFFLSVAATINCVPENKFKTVITNKSKPNLPNLEDNKHAGNKL

SEQ ID NO: 923600 - protein, 134 aa, Homo sapiens
MTPLKQEIWSPSFSRKAWALKIEILPLSHSLSLHDSEQGSVAQGSAEVRKPPSLPAWKLKRRLCASHLPMKTGREAECSPSTLFFCKNSGVSANCCAGLREGQYGLSEIKVAPLNLYVLLFSVLWSMEVSQPHS

SEQ ID NO: 923601 - protein, 175 aa, Homo sapiens
MGKKHSRKAENSKNQSGSLPPKECSSSPAVEQSWTENDFDEEEVKTHRKEAKNLEKRLDKWLTRITSVEKSLNDLMELKTMTRELLMNAQPSVVDLINWIEVDSINKIWDYVKRPNLHLIGVPESDGENGTRLENTLQDIIRENFPNLARQASIQIQGYRERHKDTPQEEQLQDT

SEQ ID NO: 923602 - protein, 173 aa, Homo sapiens
MGLSRAGFCCLLKGVQENTQCRAWRTMDMKGPEAQVRGESSTCLKNTLEKLAACTGLVLTQCGAKICQRDLWNLELERDDLGYLVEEISKHQNIQEVTEHKTLENLQPDNAVEKKNPFSGEKFKLPAEICVLVSQLGKIQHADTLKGEEDGIYVVKGKLSTERGGETNGVNFW

SEQ ID NO: 923603 - protein, 140 aa, Homo sapiens
MLSPLNMRVYKSNSVPILVSFLPLQLYILNSIFFVVVHTFLLILLTRLTLTLLKLLKTVLEVARSPINDHGFSGLHILIYKMIRLNKISPRVFSISKMLRYGIQNVARNGSQSRAQEGSWTSHKKEFENSSSNKILNFQQ

SEQ ID NO: 923604 - protein, 384 aa, Homo sapiens
MAHVYPIEDKGEFSVPSCYGNIKNDNGGSSLTFEHPLDDVNVVDLKWIHDFVLKSLEVLYQVEKWETLVSLAIQFNTVSHERYTEQVTPLLVYAQRQLLLRIQKFKGPDITQQPCARYEAEYGEKGDLEDFLEMMAFDERGQPYSDLGKEHCSPREKEWPMPCSGTERRPVWLKCSKQGAWEKEEAAPSEDFLLLLLLPSVPIPANCDSSLLVLLHDVCSNAAAEVPGPHSLFRDLEATLSHYLPFLGTFQDKYSRAKALVCVPVDVTDTLRCFRETLEKSKYHNRSIRHSRKLLSLFLAQTQGEKGEINDSKCTSGKVEFCLGTEEMHMSIPPDLSQEHFRVFSSVEKSKLPYSQLGLVISSYHQTIDVQPRFGVPNGIYWEL

SEQ ID NO: 923605 - protein, 204 aa, Homo sapiens
MALGENPSLPLPASGICWRSLAFLGFAAIVFSTLTLLQDSKLFEKKVVQDDTENPVSPGTSVTENKDDSEFLDPISLNAREYFNIHLWLRCRLALVTAFVAQIHGIGIVKGHTVAKQVYYKNKRKDPSKWLPALHLFDVALKLCRTTAVEEHEVEAEILFQKGKIERQILMEEKSPSFQLESLYEAIQLSLKNDQNSGSEIVGK

SEQ ID NO: 923606 - protein, 140 aa, Homo sapiens
MQVTGDRSTPDPVFLGISSGSCRTVDIGEPQMLLPDRSSGSFVSEEYLAVSFVIHYQQNSTKPYNLSNMSSVKLVLHFRSLRFQFVTLELHNCFAVFHLPGVSDVYCFAMTGNVRQVNKEWQPGSDGPNALQTIEGLGAP

SEQ ID NO: 923607 - protein, 164 aa, Homo sapiens
MKNEAPKKDKVSQAISPSCPQKNRQKLCVGLVMTFSLFSSLVLNLSWLFNEIPRKGASRLLVIAIHEKLSNLAQIAELSLPAAPEITSNENIYEVEVEEESVDNEMEAMNSLWALCVLFISYSSFVAYRRNLIDVEWINGERILFCKRGLWESRAGSWGLGQGS

SEQ ID NO: 923608 - protein, 157 aa, Homo sapiens
MMNLILCIYCERDEKYMHSLINQVWPHSGYNCTFLKFSHFVYVHSSSGNVMADSPQLSTLSSNFFQLKDMNSFWREAHIQLLVDVGVQRPNPTTTTIQDHSEGPPQPQNSPMGIYKVNSKLIVAINVEDKTIKLEEIIRDYLHDLGVSKAFINRMHF

SEQ ID NO: 923609 - protein, 195 aa, Homo sapiens
MRWYKPVQLVTVLNTVCNCNTTSDLSSAGLLEFAGGPLQTLFAWLSPAEAVEQQRLLLTPSSESFVPEGQSQPDLSCMRCLLTPAGTCLPVRRHRCQGPTLGGSLPGDPLLSSEPVGRERLSLLKMRPQPPLPPGAQSQGERSFIYKPLAGPAAFLSETPCSERRNLERQSGYSSFAELWWALPSLNFPAALFKL

SEQ ID NO: 923610 - protein, 169 aa, Homo sapiens
MCFIAPEDLPEGQDVEVEDSDIDDPLELNPIKNHLNFEADISPVVPSDETPALTIPLIAVLGETMKQRTQISHAQISLTNRNWDRISTYEFWGDTSLQSIPPTVSEGAFWRSLYGFPDNDIEAFEDRKSLGQGLIRSSALVTIRDSTAQRLQAQAMELGFKSQYHFSGV

SEQ ID NO: 923611 - protein, 140 aa, Homo sapiens
MALVSVVIQTCWEESLCIGAGLAWFDHSHLVTKKGVTAFLWACPTMGLESYFRRSKDESRKTDKVIAIILGKKDGGYDQGEKLLLMSNDHKDINNWTWSLSAAVGYTSFTKAAFFTTATDLANSSDKENDATTEWFQTTF

SEQ ID NO: 923612 - protein, 200 aa, Homo sapiens
MRNAGQTRDQTCGRGLVENSGLVRNQRNKVWRNPEYQRSKHRDTELTLGCPTYLCVPAPSINSPAPWRVVSRLLHNCEPTLALGTQQTSRPFMFSNAAQCQRALIKCPRSQSKSIVESGVEPAVVNLEPTSLFRVSDCLSEPQEILLSMLFGGCPVYCSRYCQMKSSNARSMLSDSLHLYELQRYKQQQHRHSQEIYSHS

SEQ ID NO: 923613 - protein, 161 aa, Homo sapiens
MITVLDSASREEKQLLCQRLQLELREKLLDVRGFRGPGHPLQDAATESAWSFLLLVPKSAHPSFRTNSSLCSLPGGVKCKVGPSHRGPTGALPTGVMRRGPLSYRPQNGRGTDSLHHVPEKLQALKVIPGEQPWGLNPGKPQWQNCPRPSEPIPYTTVPFI

SEQ ID NO: 923614 - protein, 145 aa, Homo sapiens
MIKTQPMIQLPPTGFFPLHMRIVGVTIQGSSSPVVLQGIAPLLAAFRTGVECLQLFQMHSVSCLLVDLPFWDYREENREAAPMVAVASSVVLIAGIAWGRGAILRRQLAGVLQQQGHILELLGRVASEEDANALNEGQQDAPHHR

SEQ ID NO: 923615 - protein, 170 aa, Homo sapiens
MRKLIVGLIFLKIWTCTIRTSTDLPQTEDCSQCIHQVTEVGQEVKTVFLFYSYYEFTGTQKGTCLYNATQYKKAQTSNFWVLKSSIIGQYCIAREGKNFTAPVGKLSCLGQELYNSTAKIVTWWGLNHTEKNPFNHHTGVEWALNTLISMLSLQKWETWTQTHTHRETAV

SEQ ID NO: 923616 - protein, 145 aa, Homo sapiens
MTHKLCLHQAFVIKSVLNKCERLWLMRAAAATAALLLVVLSSSPLAALSALALASHHDRSEKPNFSNGLQGPSQSSSPCCSYAGVLGLPPICPCHEDTQVALWRDPHDKNLRPINSQQEIQDCTVVSHFVSKSFCSCKAFRQLQP

SEQ ID NO: 923617 - protein, 148 aa, Homo sapiens
MSKPNPGLNFLSVVFCYSSINALKTVIDRKWKCYYKKYLKMWEQLWNWVMGRGWKSWRGRLEKAKITINEAIPENVQENWSCGYLKEPQFGQFLVMPLEIEVIRDSIIGSFEDRIIVYWMQIPNPRLNSYGGALLVDSFSWSCCSLYS

SEQ ID NO: 923618 - protein, 172 aa, Homo sapiens
MNFPLYNLFSGVLLLSCSTTAVKLGYLTLDEIVKVAEALIPQQKLECRGTGTSQPLWRWQGRIPLTQTLCASPLSGWGVCSIQEEQGHTNELKTVNVGDFIADESGPQREGKLKRGQSGWEEHGPFTCIYMKMKPLEEEIVRPLSPSQAIASPVTCMYTSRWPEVTEDPQKK

SEQ ID NO: 923619 - protein, 163 aa, Homo sapiens
MSSPGIAGRKGIASSSYSLDPVFWLFSSDRPLFFICRNSDVHVEELWFYPLWKPEPGGHSSWLLQAGLGAAWEPRVGEIKLKGDLVGTDLPSTVIVTRSSASVMGYRASEAIGQHQSSAAKPRRSQSESLGPEFQGLWEWLPVLFNVGSRLGNKMYIENKTAF

SEQ ID NO: 923620 - protein, 150 aa, Homo sapiens
MYDQEICLLKDSRAVMLTPLGEDGEPELKVVPGQETALKCGPPSYICKEMNSANTSDLERCPQFQMRTAALANTLISVQEENHKTRCWRWSTGERTHAVAVQLLKNTDERAVKDDSLSDGRWISQSMTSLINWPWLPKELSKGGCTEKQL

SEQ ID NO: 923621 - protein, 153 aa, Homo sapiens
MKQERLADARPQGPSKDIWMPYLGQRKGEKKKKEKEKGKGKRKGKGKGKTRRKEEEEEEEEEEEEEEEEEEEEEEEEEEEEEEKEEEEEEEEEEEEEEQEEEKEEEEEVEWKKKRKKKKRKKKNRKKKRKNKRKKKKNCYTNTQKCGTGFETG

SEQ ID NO: 923622 - protein, 130 aa, Homo sapiens
MISFDSMSHIQGMLMQEVGSHELGKLCLCGLAGYSSRPGCFHGLALSVCSFSRPMVQAVSGPTILGSGRPWPSSHSSTRQCTSGDSVWGLPLYISLPTALAEILHEGSALAFLINHSDSSIKDGFEENKP

SEQ ID NO: 923623 - protein, 163 aa, Homo sapiens
MALISIAQKINTDWLMGCMGRLAAGVLGQVGLVPRTTGTGLVPEFMGVGMEPGSTGAGLESGSTWVGLVTGSVRMVPEPRCRGGLGASNHGCRPGAWGSGGQIGTVAGLSPDSMEAGLVLWFTRAGLVLGCAAKLNVHSLSSMWRVPLFMLCFLGLVESHKKE

SEQ ID NO: 923624 - protein, 149 aa, Homo sapiens
MIKNIHVLSLPCHAISDRSNLPSHVRLTGGPVLLCKTSELDHIHLVQVMCLKTQPRTQGCEAQCSILPPCPSDICPRKKHVLAGDGSGTMKGLDSMPNPAPSILQNLSKHGPFQHPIRVAYSPELLSYLVSSGSVPLPPPVCSVVPVSQ

SEQ ID NO: 923625 - protein, 142 aa, Homo sapiens
METPSLGSFHVLLSLWVHRGQELRFGNLHLGFRRCMETPGCPGRSLLQGQSPLGQPLLGQCGTEMWDQSTHTEFLMGHCLLELALGSHLKGIEQGSHMILFSVERLLCQLHELQMRQGREKITAIVARYSHFVDEEPGALRN

SEQ ID NO: 923626 - protein, 142 aa, Homo sapiens
MTLGVSGVEAEVDWRSDIGGQGTGQPRLKGWKDPGPTSQHCTKHFTCSIAVSVISYRFVPSNVRGTSMNFLTLFNGFGCFTGALLVKLVYLISDGKNRIHAPRRINVMLILKLHILCANSSYTSQRNMVIKRYNRMTCKVLM

SEQ ID NO: 923627 - protein, 210 aa, Homo sapiens
MDNEVQAEVVSDGDEELVGNWSKGHSCYALAKRLAGFCPYSRDLWNLDLERDDLSNKEPNVNQQDYGENVSRAPSQQPLPSQAQRRRKEKWFPGLCPGPPCSVQLQDMVSCVPVDSAPAMAKRGQGTARAIASEGARPKPWQLPRCVEPVGEQKSRTEKFAAGAEPSWRTSAGAAWKGNVELEPATKSSHWSTTKWSHEKRATVLQTPEW

SEQ ID NO: 923628 - protein, 167 aa, Homo sapiens
MGLGAVEQGAVLIREARAAHEPMERVGGSGMAGCRSRALPREKAAKARRETEGSAGGLALLGNPVHPPGPGAKPLIARGRQDRPAAPSAGPAKPPPTRNSSWPASAARSPGSRSRLSLHSSLQAEGAGSGLGQPRKRLPQCGGGLKGSSSATKVGAQAEEAPRASQG

SEQ ID NO: 923629 - protein, 166 aa, Homo sapiens
MVMQAPLWPQPLKLCSVRLEASTALGLAPHTLIGITGILGATVQDEIWVGTQPNHITMNQGLRIKDLNIKPKSIKTLEENLGNTTLDIELDKDFLMKMPKTIATKPKIDKRDLIKLKSFCTAKKQNKNKNKKKNKKKTINRVNRQPTEWEKIFAKYASDKGLIPNL

SEQ ID NO: 923630 - protein, 144 aa, Homo sapiens
MGHYHPKRKEILWYAVTGSRSKSKTKKFPHVFNAEPAFRPLLQAGPTNLWQPCFFSVPWQAAPREGFCKAESYFYPWIKRGSAGQEIVDKHKIVKAGSRMVTAFLSSGAVNALDIPAFIMKFSEGRGAMWNPVLAKANFKEVKH

SEQ ID NO: 923631 - protein, 213 aa, Homo sapiens
MVKNIGSGIRLPSGKHYDWHHVLSITITIIIIHHHHYHHHHHHHHRHLHHHHHITITTTAIAITTIITITIITIAIINIIITITTTIITITIITITITTIITITIIMTITTITITITTIIIITIITLTITIIPPSPSAPSSSSPSSPSLSHHHTITIITITIIISTITFTHHHHHHLHHHHHHHTITIFITTTIITIAIIITTMLRKHFAYIN

SEQ ID NO: 923632 - protein, 148 aa, Homo sapiens
MPGGSSGQNPHSVCASEELQPGAVCVLIYGTEPFRVVMALSAQGDFLSHFWAGLENPLFFHSPHFNAGPCWQQQASAPHQRKQSVTPLIRFCQSPVWSSAKIVTGSQIWKPQSYFWPSLLLLIHHATFCSPARTQQSEMRKAQKLVLI

SEQ ID NO: 923633 - protein, 154 aa, Homo sapiens
MAGYSSETKLPEEKSGSNICGSPISTVLQSLLLIPRKAGSGMDLQQTPTDLKLRVLTVRRKTNKQKGHSLQKPICTSPSLKTKAMEQSWMENDFDELREEVFRRSNYSEVKEEVQTSGKEVKNVEKKLDEWLTRVTNAEKSLKDLMELKTKAQN

SEQ ID NO: 923634 - protein, 141 aa, Homo sapiens
MSACRSSCSPVRQYFGSLGGDHRCTVPPLLEQNKKGKEKAIFPPNTPPTHRHPPTPVSWPPGAGTFFFLCTSELQVCLSLDSRTYTNITHYLGFSGLWPQTENYTISFPSPEAFGLGLSHDTAYPRASSLQMACHGTSQPL

SEQ ID NO: 923635 - protein, 126 aa, Homo sapiens
MFLVGIRYYKTTSLQIATFFFIRFRNPNGATSASTGVKFCQTHGLVSKLSMQNGAFENEVKLMDKSVLGALCGTSRHRSRSNARESNACRLLPRPWPGISLPSCKLSSWLVISKIDSQPTWNWHRK

SEQ ID NO: 923636 - protein, 136 aa, Homo sapiens
MGASKSGGVKGMRKDRLRVHKLGPGGQCWYGSCKGLELWEPTLFIGDQTKKQVVRTGHEGLYVMSPGFHQSHERFYALGLDLWCGRAAFHPLAQSLAFQRPRGVLDPGPWTFSKTLLYYDRQASSALVLLPTSIYT

SEQ ID NO: 923637 - protein, 148 aa, Homo sapiens
MTFNSEFKGTSFLLESLAGLAWCLELESSEAGLELESMWLISVELGTTGASLVPKALGSAWSLGPWGLAWHWGSLKPGQHGAWGHGDLEPWFKDKAGAGTGLYPGSMSRGRSLSDRVHEGRPGAGVHGKDECSLHSPSPTQKVSPFTL

SEQ ID NO: 923638 - protein, 148 aa, Homo sapiens
MWCVYICNGILFSSKKEGNPVICSNIMNLENIILSEIGQTQKDKYCMISFIHGTILKCRDLVHNIVLVRMNVILRIMNKPKHTSIWLTKHLPCMIVPSNTTWIEACLYYLTIRLVQNYGFAVKSNGLCSSSSVGDNNTFLRGSAVRFK

SEQ ID NO: 923639 - protein, 145 aa, Homo sapiens
MAYPHKCSSPQPFENVKEDVRDSQGFMQGSRGLKEGAGDMKMSKVDKRDARQETQEGRAAAHNPLGRVGTAREFEMDIQNHRLKLDRNEFQLPDVNLYPLSLYLHNPSDTSGLLIALLCLSSGHRGGHVVKPWPNMTPHLLVYNN

SEQ ID NO: 923640 - protein, 148 aa, Homo sapiens
MLISCVEADHLTAPCLSFFLYQMAIILGLTPPVQKPGPLPHICVLSSCRYIVGYGDGVAIVGLNHLAYTAVHSTSALYVFRASGSCCLHAGYGGRGRLAVYTHRILISLDFASGQKLIQYRLQELAFEYVPQRLLLKNIHSEKHRRIM

SEQ ID NO: 923641 - protein, 154 aa, Homo sapiens
MKQQKHLLPKNPQRSLDPADRNRQNSKRKGSNGAHHLAIVNSPFVVAKMCLELVPSGGFLVSLTSRMKPRNLTVRGLTDFRNEAADPLARHRALIGAFSQSADWCVYKPLSRQKSSPSPHSTQEVQLASPLIPPSENQLLDIHQHITVLITIDN

SEQ ID NO: 923642 - protein, 169 aa, Homo sapiens
MTLPMNCCKCFHSPSFKTKDYNFIKAVCFALGRLLRIITSTVCNVSWKCGLSRGCKALQLLLEGGFSGHAILHMVSETFKSERELKDHEIIPVNFTGEERKAQRHCGEPLKDFKQGWANGALCKSLLFNSMIKSMGDTKQELKRLLERKIGGEETNHNSRNSSVFVDKF

SEQ ID NO: 923643 - protein, 157 aa, Homo sapiens
MYYGNRMWRPQALVADEEILFIDEQRKWFLEMKSVSGEDAMNITEMTTKNLEYYINLVDKVTAGFDRIDSHFESYTVGPSAKWEVQCSEGPNNSTGGNAQSWGELSLGPCWYLSSKFSQFLQGSESSLRPDVRCQIIVSERAKLCKLFEEIYSEPNE

SEQ ID NO: 923644 - protein, 128 aa, Homo sapiens
MCEQTVEQKPESLVAALGPDPNAPDGCCSMHGQQRAVEFDFLPGIRSFLRPESEKGAAWRAQADPFMEGAREVGQNWHAVSFVLKEYCLSVSQEKSCQLILVRGHPRPKGRNMVAIKRMEKVARLNQL

SEQ ID NO: 923645 - protein, 157 aa, Homo sapiens
MGFRDLKSPASLQVLNDYLVDKSYIEVYEAVSGPPPADLCHALCWYNQIKSYEKEKASLPGVKKAVGRYGPAKVEDTTGSGATNSKDDDEIDLLGSDEEESEEAKRSIQADGLVWGSSKLVPVGYRFKKLQIQCVVEDDKFGTDMLEEQIAAFQDYV

SEQ ID NO: 923646 - protein, 142 aa, Homo sapiens
MHVIITYIFFPETCSHSSVPAVTALSDDDDDDDNDDGYDDSKPFCASLEKLQAVLYQLEKNSLSTPLLNTVKTGLEVAVGESVSEWQVNGKVLDITAHSFMFVYPSTLTSTWDIVNAQSMLIEQIDMDWCAWDYRFIFETSS

SEQ ID NO: 923647 - protein, 140 aa, Homo sapiens
MRVSVCPELSCLLLGATLPNLKVFTNLEAPPSSYKATNPVGLGLHSDDLLKPELPPKGPASKYSPSLEVPRCPCYYILLVKAVTGPAQRRGGHVPPLDVRMACTYRVKGNCWGPSLEDSNHRSFLEVAIGHPCLPPISQN

SEQ ID NO: 923648 - protein, 141 aa, Homo sapiens
MAHVYICNKPAQEDRKMRETLELLRDWLNGCDQNTDRNIDNEGQADKVSDEKVTGNWSKGHPCYALTKSSAVLCLGPRDLWNFELRSDDLGYLAEEISKQQSVQDVTWLLLTAYNQSWEKPSNSFPKMDFYTPFYTPISNV

SEQ ID NO: 923649 - protein, 137 aa, Homo sapiens
MLSAGQLRSETCKMLRSKRRIRAVELLQAAKPTLGRKGCGSLALLCKPPRVAANTQEQYLLEKVYAEEMSEPQDSPENQVPLRGNCHPLPEEGTVVQRPGREQLQPMKTIPASVAVALLPAVLVLPLDLFLELVGAG

SEQ ID NO: 923650 - protein, 331 aa, Homo sapiens
MDPHKVNELWAFVKMCKQDPSILHTEEMHFLREWVESTVGKVPPATQKAKSEENTKEEKPDSKRVEEDLKADEQSSEKSDLEIDKEEIMEEMMDQANDKKVAAIETLNDGELQKATDLFTDAIKLNPRLAILYAKRASVFVKLQKPNAAIRDCDRAIEINPDSAQPYKWRGKAHRLLGHWEEAAHDLALACKLDYDEDVSAMLKEVQPRAQKIEEHRRKYERKREEREIKERIERYGSFLGGFPGGMPANFPRGMPGMGGGMPGMAGMPGLNEILSDPEVLAAMQDPEVLVAFQDVAQNPANMSKYQSNPKVMNLISKLSVKFGGQVNYKL

SEQ ID NO: 923651 - protein, 147 aa, Homo sapiens
MHGDECAKRPISQNVSPSLNNTTVYSARQATDAARGLQEPRLNPLTIKVTSSNLHSAMVEECSVWTSERRISGASNQAQMSVSPTPAVGWDRTQRKSPQWGFLGAEQPYCWLPAGRGCTCVSPSVRASAEAAEAQQGLLSPTPSKSS

SEQ ID NO: 923652 - protein, 193 aa, Homo sapiens
MAMHCDTSTFWARATSFLPEGWALLILYLYNQKGPLKTPSKNRTISWNMTCYLPSLKTDTVGNQIATTLAKKKIVKFCTLMYMQNAKHYYYMTGHKSGPYGLNMVDRAMPWFGQLGSIQGKGKFWKLKPEPEDLACHLLRAQFMAPENNYNSNINDHGSLITITDVIVKKFAVFQEFPKCGIETQSESILLEK

SEQ ID NO: 923653 - protein, 135 aa, Homo sapiens
MFNLDIAGKRASSVGQPNALEFPYPFDMRLLLVPGALCARGLHLEDAILISKWLEVQTYMSQHFQGFIVVGISIPTAAKLGSEFPVSGVVKTAGTWLFVEDNGKEVKHPVNIGGPFRISVQNSQGTSDAVVPVLC

SEQ ID NO: 923654 - protein, 128 aa, Homo sapiens
MDLLVHVSLMLKHLCAAFLGGLFPLQNKRPLLLHYFGICLEFYLFSTRFNCSTRICNKLAYFVSQFKGNEGELEEKKKSGKCHDVIYSSGKPGLQGPKEAAERPVKRLPRSSQMLEIMVLDVRREGED

SEQ ID NO: 923655 - protein, 402 aa, Homo sapiens
MARGERAEIVEKQTQLSPDTLIMQVTDLQQKVHAQLRQVSTIKVRTLIGKEWDPATWNGDVWDDPDEGEDTEFVNADESFLPEGTASPFPVVATSPPRPMLPSAIPPLSEEISAGDLQPFTTVTLHWGKRNGRRFQGLLDTDSEPMLTPGDPKHHCHPPVKIGAYGGQRELDRILLPQDIVLVHYIDDIMLIGTSGQEVANTLDLLEPADPMVPDMSVEDRGAVWSLWQDPIGESQQRPIGVWSKALPSSADNYSLFERQLLACYWALVEIERLTMGHQPAPMASWGVPYNQLTEEEKTRAWFTDGSAQYAVTTGMWTAAALQPLSRTFLKDSSEGKSSHQQAKKGVTVLAVVTDLDYQDEISLLFHSGGKEEYAWNTGDPLVGNYNSPIQAGLQMAQTLQE

SEQ ID NO: 923656 - protein, 167 aa, Homo sapiens
MKSHVIHKTQTSGQCLSLNVNDLEPSSAPQILTYMEIPGNPVTTTYYVPSTVVSAKIQNQIRQIAGHSHESDVLMGRDRQKAREEGDHVTSYFALKQIKQDCVKALWVRGESASDCVVMETLNNGRDKAGKGGKEYSRAEEEIRLGGLKSEGQKPGQRNSHELREGA

SEQ ID NO: 923657 - protein, 147 aa, Homo sapiens
MGNEVPAVVVSDGGEELLGNWSKGDSCYALAKRLAAFCPCSRDLWNFELERNYLKLELMFKRKADHSSLENLQPDDAIEKKNPFSGEKFKPSAEICINNKEPHVNHQDNGENVSRVCQRFWQQLLPQAQRPRSQKWFHGPAGSCVQS

SEQ ID NO: 923658 - protein, 142 aa, Homo sapiens
MCVSVPVIQMKKLKCGEAKSLMSLSSQELNLGLPKALLAGDGGLGANATVILKAHSCWLSVNCTLGQCSLKRRAEQCTCMRTTWTKPMLWTQKDLTYQPRVHSDPYRGCYLGGVFLNTEANALDAITGSSIGANGYVVGIEQ

SEQ ID NO: 923659 - protein, 162 aa, Homo sapiens
MGKIAPMIQLSPPGPRLDMWGLLQFKVRFGELVDSLPFLTLKTVYDYEPQSEVLDEAMGQTNKLKMGIYWHGQLLIDTLQLCLDLKDLDGKECAVFFITATSMGCTQQLDVTLTEIEMTLSEVHYFSLHQLMLPHLDSNEAPILGTRDSASRLDVEGPDDPP

SEQ ID NO: 923660 - protein, 156 aa, Homo sapiens
MWESLELLRNLLNGFNQNADNEVDDEIQAEVVSDGHEELHGNWSKSHFYYALAKNLVPCVPGASPPAMARRGQGTTWAVASEAASPKPWQLPCGVGPAGAQKLIIEMKIKIETIRERNAAFEVIKCKLLSSSVHENMQSLPLDIGFRRSLLLNCGL

SEQ ID NO: 923661 - protein, 260 aa, Homo sapiens
MTLPLSAHKRSASYMNLNYPFYPTGTVSVCFSPFCSVLEEKFINTFGKKKQEGPSSKFDLDVKTDDATHPPHIGRLSHRVIGSQQKGGPGEGGLSLPAGHPVTSAALSREGSSSVHLVTSYPAISRDSSSSLQNGHAIISLFSALLWLSLGFLWTSEGRKCTATGPWATMDGPEKAPQVPTLVRGSGSPALSLWDLPGLKVEPYGGPISFCPGICLPPAAVHGCLDSAPTLFQDWSQHQQQGKTRQQDRFFGACKGRGPS

SEQ ID NO: 923662 - protein, 146 aa, Homo sapiens
MAFVNCHDAGGIFRRINVQFKSSLRKRRRGQSLPLFSTRRIKPLIFNRYLSFQGQWTGSWENSPCYKYILNCTWYFNLNADSQALTQDGVALVRALLKISHLNVYQSMLSKYFSSTSCTPGAGDKVVEETKWRPPGTHILKQSCPM

SEQ ID NO: 923663 - protein, 193 aa, Homo sapiens
MSLRKGIACTDLPLLKTEIGVCYTKVPKETSSRSYNTHDWHGSCGKDLGVPRRESVRGWKKPPGDTGCKRYGYISSLLHKPLILVGQGEGIETELPSPPLQHLNKAFFPDNTHGLSDCLSVQQTQLPPNTGSPSVLSVALDSSLWLQLRSESHWPIRAPYLPEHGDWFRDGHVTKAEPKRFHPGMFAKTVGGD

SEQ ID NO: 923664 - protein, 167 aa, Homo sapiens
MWPTLWALISPEVSIREKANAFPEYRPPTPEVLTPRRSLGLQGEKPEGAELKGSAQMALVIWGKCPVHDKVLISIPGLCPPAASSTPCPSVTINNKCLQTLPLGKVESKITSSDLLNRDKGDGECVPLELAGSSVLAWVAQGSSGRHWEPHQCSLDTKGLEDKPSFK

SEQ ID NO: 923665 - protein, 135 aa, Homo sapiens
MGVSRDEQFEVGFGARTWFTADLDSGVTPQPGCGAGIDVTDVLGVGGGCTCDPLGGTECPRRSMETPLKHVGAKDMDEAGNHHSQQTNKSTENQTLHVLTHKWELNNENKWTQGGEHHTHRGLSGSGRDSIRRNT

SEQ ID NO: 923666 - protein, 144 aa, Homo sapiens
MFAQGPGALQSAGGKVSQVGALPFRVVSFLRIWVGPEVLSGSQGLDSKTLEVYLVFYCIVAKMALKPLDAVLPPLPSPFQMQRSLTLGPPPPQAYRVLPDYCQCSLKDIAAGFSGPKDSSATAPAGISVGHVPPGPLALGPVQH

SEQ ID NO: 923667 - protein, 155 aa, Homo sapiens
MRIKIVRISLSLFYFEFAELLDVQINVFNKIWDTFAINYSNIVSSFFSASFSSGTAIVLMLAAKSQTVAWQVSLGKELSILGELRVKPNTDNLASGFFQGTIRQDTEVLNTAILTGKPVSVPVKVVGVQEDGSVVDVSESVECKSADEDVIKQSK

SEQ ID NO: 923668 - protein, 142 aa, Homo sapiens
MAGVQGTKQVSSCLPALCNMSPRATCGWVNGSFYEILQVDFGIDNSSDLAGAQQITWQVEYPIEDSMSELVVSEIFVSQTTFVGIVPLAMQVMERSVAINAGLPLHEALRFPGIPDFPECEQIKAPSCSPSQRSAQPVTPGT

SEQ ID NO: 923669 - protein, 147 aa, Homo sapiens
MMFTASADNAACVPLAYSIQITSARAENPLPTFTVSDMASCTPENPLWSGIFCYDLPLAHVSLIELGPLVKYGPTHWLDGSIGVCLFDSTQPCTLARAENSIKGITGKGENLIKEDQYCLCGVKVAHVMGIWVSGEGISQESSCGQP

SEQ ID NO: 923670 - protein, 215 aa, Homo sapiens
MHTGRTSHEEGRGRDASTNQGTSKIASNHQKQRETHRTGSPSQLSEWGDLANTFILDFQAPELQGNKFLWLKPLNWWYFVTAAPRGQSTCLHLFWSTSLEHRTMAELFIVKWLAWFQPIFSKSQKHLPRIRKSLLPPASVLSGCQVTFDPQARSSLEHSGCTILHSYQRCKRVSISPHAHMDKEKRSVSIYWDVIQPRKGMKQQHRLQHGRTLKT

SEQ ID NO: 923671 - protein, 186 aa, Homo sapiens
MNEEAPEDEGTCVLVLGQNKRRNKNLTEEPSVGGKGVGFGVRGSGFESWLCQNQLCDLQPVVRYRVGASDLFIWMLRTTVAGLATRLLGERTLWESEKSYYGSKIKAAAGVKITAVRVSSEDQWAVQEEIDNGSTQTSATLTCMGHRPDTQSRIQPSLNQVFTTVISASSVLCFSSADVYQVPPTF

SEQ ID NO: 923672 - protein, 168 aa, Homo sapiens
MLRDVFPVERGRNKDTHFALVRIDIGDTLHKVFEILIGLEVERQLGGKKSPFLLQMCSGLDCDRRPQGLMGMKVGFNPIPSEKREIHVKTQEDDHLQAKERSRKKPAMQTPSSWTSGLQNCEKVNFCCLRRPQSTTHSERLAESGASSLRFPSAAAMQVCKLLSVHCL

SEQ ID NO: 923673 - protein, 313 aa, Homo sapiens
MSNCKVTESRGIVDSLQKFSSLPAYLPTNLHISNAEESFFLKEANQDLTRNSSLQARVEPFFIYRARTPPIINASYGPFSVEKIIPQELLLTSTAFGNMDKFPFNWKLKSHILDSSIYSNRPKVQTLFYVTGMGWDDSDLTEDLPCVKMFAFPEAREVAASCRLQGAPGLCVAELELLPEWFSSGLDLEPEEEIPALLGGTTMELFFTLYPADKAGQCPLEEEGKWENNIHSGLESPQQAFPARERIGSVVVYPTQDDLKWSLVSLDENVVISVPLNLVREGDTATFLVSLTSSSVADQFTLRYVTHLAPEGI

SEQ ID NO: 923674 - protein, 115 aa, Homo sapiens [sequence omitted]

SEQ ID NO: 923675 - protein, 306 aa, Homo sapiens
MIEGHGVTDNIQRFSSLPPYLPVSYHILRAETSFFLKEANQDLLRNSSLQARVESFFTYKTRQPPVLNASYGPFSVEKVVPLDLMLTSNFLGPTNKFSFDWKLKAHILRDKVYLSRPKVQVLFHIMGRDWDDHGAGEKLPCLRVFAFRETREVRGSCRLKGDLGLCVAELELLSSWFSAPTVGAGRKKSMDQPEGTPVELYYTVHPGNERGDCAGGDFRKGNAIRPGKDGLEETTSHLQRIGTVGLYRAQDSAQLSELRLDGNVVIWLPSRPVKQGEVVTAYVTISSNSSVDLFILSDVMNSYIFL

SEQ ID NO: 923676 - protein, 135 aa, Homo sapiens
MEQTAPTSLVYDSHLRLRQIRAADQMMLKWIFNVSCIKQSHDFIHTADKAHGLRSLIAALTSVENGNILGAKGNVIIMCHVSGSALCEDSAFMSRIFAMILSGSVRGLGVYVLNLYNDPIRLCARTRRLCLKYLQ

SEQ ID NO: 923677 - protein, 116 aa, Homo sapiens [sequence omitted]

SEQ ID NO: 923678 - protein, 144 aa, Homo sapiens
MRRGPPAQSPCGTGIQERCSALCAPSSRLCAPCPQLPIHSFGTVGLVLQEGRPGSLHPLSATARVSVRALEERSLIAQLTRDPSLAETRGSLRVLSNESFAVGERGWGGGCVPRDGNYLTSGPVRGSFTSVSSSLQWESVLATE

SEQ ID NO: 923679 - protein, 135 aa, Homo sapiens
MGAVPPGVAPSGLMTPPSKSSFREVVGRRESQRVHGEGERKKNLPRSPPPTHQRFTPCVLPLELPNVHIVTGEQVTYMEPKVNGSGALNAELYVMGQLEPLPDCRESLRYLEIDILSRGALEPLMGLAESPDPLP

SEQ ID NO: 923680 - protein, 244 aa, Homo sapiens
MKAVLTLHVLHIQLRVLTSAKASLMWLVDQSLQCLSLCPGNKCETEGCTVGFPTFEVLGHGLASLLLSLQTVYCETSPCDHGTPSTFSLTSRWSDAGHMPTPKPNTGGARDTMIGLEYSGLTPDLDIDETSSVSQTHIVELRFTHQKAPVHWGNSNGPCECLKVGSFRSSRPDTPWMNTPRHKPIYSAPHLQKQLKKEFQQEYLNVSFDRCAETGVIASEMESFANNYITINSEEHYHFFISTF

SEQ ID NO: 923681 - protein, 318 aa, Homo sapiens
MTVVLVVMLEICSYGRNGGDDRGSKNYVGGDGNDDGGGNKGDDGGGNGRSVGGDNDGDNEEVVEVMMVKVIEVMMVEVAVELLLAMVEVMKVVLELVEVMEVMMVEVMELMMMEVSVVLVVMVEVIEVMLEIVEVMKVMMMEMMEVMEVMMMKVAVELVISDGSDCGGGDGDDDGGSSGIASDGRGNGGDTGDGRSDGGGDGDYGGDDVGDSNALVSDGRGEGSGGGGDGGDDNRGSSGIVGGDRGDGDDGIGEGDGDDDGGSNRVVISDGRGNAGEGIGGDDGDDDGGGSSGVGDGRGGGCRGVSSDGNGGMVVGCH

SEQ ID NO: 923682 - protein, 143 aa, Homo sapiens
MRVGLLSLAEPDSKVCDCLIHRQIPLALPWHHHHWAALPLTRYEKSGKAKQKLKVKKGVNILSAQTREPRQWGVKQEVGSGGKHVTATVACQRLGPSPRNRGAIEPTTWKSGGIDIHAGPSASAAGRGGALALQRCGVSFGAG

SEQ ID NO: 923683 - protein, 176 aa, Homo sapiens
MSIIEATTLPPSTTSQQAELIALTWVLTLAKGLHINIYTDSKYTFHILHYHAVIWAERGFLTIQVSSIINASLIKTLLKAALLPKKGGVIHCKGHQKASDPIALGNAYVNKVAKEVASIPTSVPHGQFFSFSSVTPTYSPTETSTYQSLPTQGKYLRPRKISPSSLTGPFYSVMIS

SEQ ID NO: 923684 - protein, 208 aa, Homo sapiens
MILQIWKSVRNCGRHTSAPSPSCPSPEPNIIPRICEYVSFNGKTDLAEDSEEDRKMWESLELPRDLLSGFDQNANSDMDSEVQAEVISDGDEELVGNWSKGHSCYTKRLVAFCSCPRDLWNFELERDDLGPRNGRSMDSLHHAPGNATEPQHWLVKAARRETVSCKAKEVELPKTVGTHLLDQHELDDKIGDTGYFTKVLTGMAHFQI

SEQ ID NO: 923685 - protein, 184 aa, Homo sapiens
MSTPDPVFLGISSSSCRTADIGEPQMLLADRSSGSFVSEEYPAVYQAACWENRYSLQSCQRGTFKSADVTAVFLFVCALPPEVEPTEITHLLRCSRWELALRFPKPLGGPEVLPGSQGPQSKTLEVYLVFYCAAVELALKPQDPFYSSLLFPKAEEPHFIPTTNPGHKEYCQTTSDVPLRPKVP

SEQ ID NO: 923686 - protein, 156 aa, Homo sapiens
MENFYEGKGPVGPRTHPVVISPVPQCIIGIDILSSWQDPHFGCLTGRVRAIIMVGKAKWKPLEPPLPRKIINQKQYGIPGEIAEINTTIKDLKDAGVVIPTTSLFNSPIWPVQKKDASWRMTMDYHKLNQVVTAIAAAVPDVVSLPAKASNIPLLS

SEQ ID NO: 923687 - protein, 223 aa, Homo sapiens
MGNDHSLPQAQPSISPDAVAMLDLIPLLDKINMTTGLMALKSTKIGAASLLFAKLSHSTLWALESPNQLRVEGIPQHSTAVLPKHGQTASLTFTGDTSRYWKTQGDWDQAASKPQQPYRKVIKLLKQKQKPSKGQQPQRLKIDNPIKMRKNQHKNAENSKRQNALFPPNDCITSPARVWNQAKAVMAEMTEVEFRIWIGTNFTELKEDIVTQWKEAKNHDKTS

SEQ ID NO: 923688 - protein, 318 aa, Homo sapiens
MLSRQLPGYPQEYQRNGGESIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQSGLSAACLLEFVGGPLQTLFSWVSPVKATEQQRLLPVPSSGSFVPEGHLPDASQSSPL

SEQ ID NO: 923689 - protein, 166 aa, Homo sapiens
MHKPGSDHEVAAQETLSLEFNLYSPDWRSKPEKALVAEKDEHPYSSSLEGESRELLEAYRFMGPELHLLSFCTWFIPMDVHSKIEGEMQRFPISHLSHTCTTFPIINIPHQSESFITIDESTLTHHCHTKSILYIRVHSWYFLIDKKYSQGVNSMITHSGGKRYTV

SEQ ID NO: 923690 - protein, 124 aa, Homo sapiens
MAGYTLLTLRMGEKYIFTFYYGPENTETTEAETLFPGTNTLPVVTEFGKWQRWDVSPSSRDPESAYFTTALYCLNPILCRVVKEDFPDMETSEQRPEGSKGKRHVGNSIPGRRKVKLMSVGIEQ

SEQ ID NO: 923691 - protein, 139 aa, Homo sapiens [sequence omitted]

SEQ ID NO: 923692 - protein, 140 aa, Homo sapiens
MIQASKSMPNDRLAICINTGKWALGRKHKHFHNCASRQEEQKCGLHSSLPLSDFHSGVHVRVCYMGKLHITEVWYTNDIITQVKSKSFPISSPTPTPSRLPLTPHWAELGPMTFIKFNLRSLPVNVSKKGQQDFNVWSVL

SEQ ID NO: 923693 - protein, 155 aa, Homo sapiens
MRWPGSHLATSQQRTNPSPAHDHGMTHEPLTARQKSTFMKPCQIMEWGPDKGYGVGETSSLLQAFFKNRRLSATELRIWGYSRVSLRIFCCKEQLSHTAVLHGGCRQESKHGLEFSEDVIHKGTVNQTQTSLQNLTVQAKLIANRRKVPDQRSPF

SEQ ID NO: 923694 - protein, 144 aa, Homo sapiens
MGGCQAKYFIRAVAVGYMLACTCQQPQQCDEVHAHWLEMATGHAFSPTLGYWNSRLFSLWTLRFVPTASHGSWAFDLKLRVIPLASLVSGFTTWTEPHYWLLRFSSLQKVIWDFSASIIIINRIPRSDLVLNDLEVKRKSPFLQ

SEQ ID NO: 923695 - protein, 124 aa, Homo sapiens
MGETDPMIQLSPPGPALDKWGLLQFKVRFGRGHSQTISVIQQNFYLPWFWVLSISGNHAFYHFIKATDENTEKKKIEDRALMQVMTLIKQLACFRNANGHRQKLQLATGYTLSGPDLQSMSDID

SEQ ID NO: 923696 - protein, 150 aa, Homo sapiens
MRTPRHRKGKITHRGLLWVLPTSDTPQNDVKKFESISINFSYQDLQLKKCLRKESLYWNQYTVTSTWRLILPFNSSISLNTVSSGKVKLLKLFFNIPYLKVKILNACRHFLHSHNHAHFNSLHNGFDLLMCFNMPLLTELTQVKHLASTW

SEQ ID NO: 923697 - protein, 154 aa, Homo sapiens
MKLPEERSGSNICCSPIFTVLQPPLLIPRQRGAGVDLQQTPTDLQLGVLTVRRKTNKQKGHPHQNLICTSPSSKTKAKEQSWTEHDVDKLRKEGYRRSNFSELKEEVRTQRKEDLMELKTMARELHDECTTFSSQFDRLEERVSVMEDQMNEMK

SEQ ID NO: 923698 - protein, 123 aa, Homo sapiens
MAERSEHRHTREVDGTAMESVLLVYKPLPLETGTVKGQPRTAGYFTRHLGTATPFLQKKKKNGANQVRPQFNPLRPFSFASPHSHRTRLRLECISINPGQYGKCKRDQGRDGAAKDSWRRHLS

SEQ ID NO: 923699 - protein, 152 aa, Homo sapiens
MRSLRQPCGNVPVEELRPPANSHEDIDQVEGIRRRAGHMNGGLQEVSPGHLEGGADLLRDVVTYSATALVLRRHIKKALADAGPSTLDFSASRAARNKSLFFINYPVSEIKCDSYYIRARIHTIRARIHTINTISRLLTLITCEVTCTATSH

SEQ ID NO: 923700 - protein, 136 aa, Homo sapiens
MKSTLSGCPASGLGWQRFLEDRPSLHPRNASLCRAAPALECWRYRGKETNEGTVTLTEEWVDLISSNNRVPYKSSSSVHSAPPTCQAMRQLLISPLYGRENKAQRGLKSFFDFQETVIKMTIPLTVVILNLHQLQA

SEQ ID NO: 923701 - protein, 124 aa, Homo sapiens
MWLPSSDINQRNRDITLLQEPPDYRDFKASVLRDQSLIRAGDTVCWGLPETVPETFSLAHSHLTPVGPVLSRLVWLAQLGATGLYNGVSALPSGPISQNVENTIGSFRTKCNSPLKCEIIPFRW

SEQ ID NO: 923702 - protein, 190 aa, Homo sapiens
MGLGESHGRGKRGRTLGHRNEPAMHFDIPAGLMLLKVVEDTDDAQCFLEQCSGPSFLCRIIFHLHSRLPTLETQSVMSNNNVGNVTTINNFIIQDDIKPKGKDETIWEYQRQKIPNVRPKAGFLNICTIDILAGQFLAVGACPACGRTFGSIPALPALDAGSRPSPKCGMTNRNVSRHFQESPGDKVNPC

SEQ ID NO: 923703 - protein, 147 aa, Homo sapiens
MIILVVLKEPSLVSQTSQFQLSLPSAGSTFFPYGISATVESLKTQVNFDLYAKCLHLNFRLYPEFTVRNSCNAHKEAHKRMFTATLLAAAENWRQPEYPPVGDWLNKSWHAHAMEAGSAVLSNEDDLQKGLQDILISEKNCRTIAFM

SEQ ID NO: 923704 - protein, 115 aa, Homo sapiens
MQAQGARFSDFARRAGYFNVKFPTSKGGLADRLRWESLITSNYPLVNCSEAIKTTKETGEDPVILSKVFRTCVNNLVAKSILPYHTKNINRMHFYLFLRNFFMLGLCLALYLDLG

SEQ ID NO: 923705 - protein, 142 aa, Homo sapiens
MQLRRGRYDYYLHFTAEETDLKPIPEPPGPYTVPLFQKKLSDERAEGEYVQHLSLIVFHLAAPSSSAASVNNGLCSSHFPYQSLTAGMAFRGDGRCDNSCARAEEGGRKGGVRSNFDPVSYSGVCGPALILRLPGNMTLAFL

SEQ ID NO: 923706 - protein, 154 aa, Homo sapiens
MSFLLWRYSVVDGHVSASMGLSASLCNGWAKDSNYIFPERGLKLATTDWLSEERLWSPLHGFLVQTQISFPLAAFLKLIKSWLKKASSCQQDEKTECREAQGQKQGCQLHEVGDLACCIHFYLLEQRLAQSLSNSNGCKEKEEEVEKRNAVSSA

SEQ ID NO: 923707 - protein, 149 aa, Homo sapiens
MSICYLVGTGNLTRTSLIASFNRMTPDTELSLGFSCQRLQTRCSRCSRRQPSLSPRPSEAGAQAKRHFARGGTVHCNLCCEIPSREIDSKRTDLQGSFMRNLKESVHNNFWSIYFVLPAVLGTVVSLVTRTELLSPRSYVLIGGWEDTD

SEQ ID NO: 923708 - protein, 158 aa, Homo sapiens
MSHWKGDNSSFDGHRVTHSLLSGPGLGKTRSVNQRFKSSFPELKILISWLCTQEIKPRSSKWTGRSMKLRLSWVAGEGLNEKLAPGPRTEGGEGVSKKNIQAEGTTVQRPRGECVRVHLRHLMEATVARREWPGMGRVVGVGVRKIAGSRFLRACTTL

SEQ ID NO: 923709 - protein, 168 aa, Homo sapiens
MPWGLCTGHFYSLEPPPQQCPSPQMGVTGRITTLQRCPQLNPTLSFSITLISTEHATFWAPPKAYLQTRIWVQTVDFGSSPRKHETVATWGRWCEILGDLGPCRQCPAWELEPLFTNSHPALAEGCSWGMNSQHSPPVLWTEPAQFSSQSDPQADTQEALVCAKAVCS

SEQ ID NO: 923710 - protein, 135 aa, Homo sapiens
MEKKLPRPRDARDGGGGGACGRERTFQAKRENPAQRLWKEKVRSFQEGGAVIPAFQRPPKLLVGTEGPPALAACTPILGLQMKAAMTPAKDEGSNRTGDEEVSEKESAQSIFTGLLRNPCVQGVLVPLHLAPNVY

SEQ ID NO: 923711 - protein, 151 aa, Homo sapiens
MCRRAKLDPYISPYKPTQALAFLRCRKPWMAHFRLIIQENPTPWLKALMVRCLSAAEHFLTVRTIPNLLFPYLKTEGRADTQGEFPNVLLIDLGVKPPRNWRPESWPSHLPLATILLAGPSGSKHGRQEPTLSEHLPSVCQVPSEEGWSSG

SEQ ID NO: 923712 - protein, 178 aa, Homo sapiens
MAMVQQMPERCCDAVLVELAGNPPPGCWEKLLLGGVLLEALCYKTAGRWVGEGDCWGRLLDATCCHALPEPGLGKPPELQERGITGALKKPSELPSAAESKTLSSRNVSPTPSIGKLNIVPSGSRKAYQSSCLLFGFWWCEMQQLVFHLGGEILTFFIALSPRHFTEEYLVWGKPYHF

SEQ ID NO: 923713 - protein, 161 aa, Homo sapiens [sequence omitted]

SEQ ID NO: 923714 - protein, 134 aa, Homo sapiens
MAVCALIQHPIYGTVSSIARIHGSRNQGVEVEVAPLTINPNDPLAKFLLPVTATLCSAGLEVLVPEGGTLPPGDNNGSIKLGVNGKVQQPNPGRTTNDSDHSGMKEVDDWRDGSMERTWPDVAGFEDEGSRTMS

SEQ ID NO: 923715 - protein, 156 aa, Homo sapiens
MGFPAFPLFRLSNCVFSPSTFGVFSSQICSNYVGVVKILVSLCKFIAIPGNELDKVVIDGNASPSFKGGRAGIAFKFQRDNLVLSIAQDALEGSLGACLTTFLMSEETCLAGFSRQEVSSTTDTVVLGTQKTMPVSFPLSLGMTLPSHCPFTWQHQ

SEQ ID NO: 923716 - protein, 180 aa, Homo sapiens
MERLREALTEHPSLSPDSVEGQLILKDKFIRQAAANIKRKLHKQAIGPDSTLENFLKVATLVFCNRNQEEAQKKETMVRRTETLAAALQACKVQDPGGASASCYQCGRPEHVKKECPYSKTKPPQPSPACGRDNRRWNCPQRWRSLGSEPVLLMIQQNWIPGLKLQLQRLKLPLQHRSSE

SEQ ID NO: 923717 - protein, 149 aa, Homo sapiens
MSRCWNPVYPDDPWFHGQVSARTYFLAAGRADSHCGFNLIKFFKGLQYHPIVSGPLDNDLLLWEYFSLLALGAFTNSFLSSRYSWKINWRSKCSRSKNFPKSYYSHSRLPPFLKSQKKQWHFSFQYKFSTCAFNPISFSHLQGLIRVNF

SEQ ID NO: 923718 - protein, 148 aa, Homo sapiens
MDPAVLHDQMKMVDLEFGPRGPEGMNKLHEQVAQNSVSLTKVYVNISVPDPPLNLQESHVIRRRKMKELDLGMEASYIIGHWKSLWKEKLKHHFRANTVNESKNQPLKSNITAITVTFNGLLEEILLPVPTTTAPHKRHIIVKTYSLT

SEQ ID NO: 923719 - protein, 148 aa, Homo sapiens
MRMNTFMVIHFHMIKLPSPWDRAPGERGCCGLSFSRLKHSCLPALKREVDLPAQWLSSAMGQTACSSGSLTPVPPDWETHPSQGRQTPPTGELWLASGGCPSGTKLSEEEEGSDLCCSAAPAGDTQAKRVCNGCPANSNRPAQEKPDC

SEQ ID NO: 923720 - protein, 157 aa, Homo sapiens
MAYTSPQSHKSPLSVLQQPLKHFPSYSTCSCYATCKGLIHSSHILQHKKSGRQQKEKWVPKPKAGASPECFRVEKGPVQLEISPGGPPALMMPSLPSSFLMFLTFFGELHRLSLWWCPLDTSDPQGNRGSCVHAVFVALGLLSIPRQKLSNHAGAGE

SEQ ID NO: 923721 - protein, 135 aa, Homo sapiens
MRDVLASGHLSQLKDWNRSPQPLGYGPVLVRGWLGTGPHSRRQVMGKRAKLHLYLQLLPMARITTQALPPVRSVAALDSHGSTNPTVNCTCEGSRLHAPCENLMPDDLLLSPSPPDGTISLQENKLRAPTPSTLW

SEQ ID NO: 923722 - protein, 144 aa, Homo sapiens
MGLPAGHNKAECYAAGLGTASRLPTVRSEEAKVKDALTQRDCSVKCTTGGELWPLDKGHSQPTVTLQRIIAYSITVLCLDQGYYHKKLTDVYSALSVHPFTNRTQETITGRGIQGQALDANFQPGVSRKKTHPSVGAPKPILSQ

SEQ ID NO: 923723 - protein, 139 aa, Homo sapiens
MCRDTGSTSHLRHQGKAGKSRHCTVGDVQEKESIPAANPLSIPGQSPQVGDQIPGQSPQLGDQMEGGCGYKFHVEPVPLSHCEKSKESLPAPLNTLKSTLKIKLIHSQWDSRAFVPAVPSPWNSLCLYPFFIGVHIPSM

SEQ ID NO: 923724 - protein, 138 aa, Homo sapiens
MHESQRNYSRRKTKGVKALFNCSHCLIQTLLTVCFYRHGKTTLGSHLRKYSWYHRAKDSRHVAQTHLKLLDPDNPHTLASQNAEITAYLKLTSDDMIATPYPELISTYDVGIFHMEINTGKQLIILSGFIRNKWISET

SEQ ID NO: 923725 - protein, 133 aa, Homo sapiens
MCREVKSLSHSNQETVYGLCLSPKMILKASIFKREKWDGEERGGCGDPYVARKRSRATKTARVDGAEYQIGENCTQREKRLSNSKSTDLQRAPREYTAEYLAGHECEDTAPGWGQNHLKDVYPGSTLFTCQRE

SEQ ID NO: 923726 - protein, 447 aa, Homo sapiens
MRGFSFLFQCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQRIPATAAPSLLMSPMVFAQPTSVPPKERESGLLPVGGQEPPAAATSLLLPIQSPEPSVITSSPLTKLQLQEALLYLIQNDDNFLNIIYEAYLFSMTQAAMKKTM

SEQ ID NO: 923727 - protein, 142 aa, Homo sapiens
MAARPRPSRPLTCAFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGLYVPIGKMRRTRQECSTAIWKMAQATLCG

SEQ ID NO: 923728 - protein, 320 aa, Homo sapiens
MKGLRMTIAKHTITTILDTLGENDFINIIAADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKVSREYSAMSHLQLGRVQALARGSQGSPAFHTHAAFPTAGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKSGLERTPQSMMEAWHWLSYVPIENTHCCELPSLTVLWPPNPCPTPDAQHKQQA

SEQ ID NO: 923729 - protein, 117 aa, Homo sapiens
MFVTGMAVMSLFLMITDLEKSGWGGGLALGCSRGHRVTDTTWDRVSATYNQKHPQNMSPHGRFRELLATPFCVTKILQREKCFLWMNDICMKSQPAGRFLSFEDACQRVLRFSLQQF

SEQ ID NO: 923730 - protein, 396 aa, Homo sapiens
MPRYAQLVMGPAGSGKSTYCATMVQHCEALNRSVQVVNLDPAAEHFNYSVMAVWDIPYSFGPDSFVEPGINAHIWSSHLLHGKFLNLFECLRGTLLEAHSIDVLVNVDGVFSGYHFVDGRMALFLLATLLCRSHSAGSKLENIRELIEVDDVMEDDSLRFGPNGGLVFCMEYFANNFDWLENCLGHVEDDYILFDCPGQIELYTHLPVMKQLVQQLEQWEFRVCGVFLVDSQFMVESFKFISGILAALSAMISLEIPQVNIMTKMDLLSKKAKKEIEKFLDPDMYSLLEDSTSDLRSKKFKKLTKAICGLIDDYSMVRFLPYDQSDEESMNIVLQHIDFAIQYGEDLEFKEPKLLESMVCACGEKVKDPIPVPSPLDTGVSKMNLTIPVLEDFTVS

SEQ ID NO: 923731 - protein, 211 aa, Homo sapiens
MSESSSKSSQPLASKQEKEGTEKRGRGRPRKQPPMSPGTALVGSQKEPSEVPTPKRPRGQPKGSKNKGAAKTRKTTITPGRKPRGRPKKLEKVLGGGAVNRACRLLLTGGAAAFWDWTALLRSHRPRPFRRPTITTASGRHPHLPPVPTPPHYAAHQPLQGSHGLSGEQFSPGLSSQLPPPTHAYTHALLDKASISLSRTLHLLRPHSSLH

SEQ ID NO: 923732 - protein, 169 aa, Homo sapiens
MGKKQSRKYENSKNKSASPPPKEQLHDECTSFSSQVNQLEERVSVIEDQMNEMKQEEKFREKRVKRNEQSLQEIWDYVKRPNLCLIGVHENDGENGTKLENTLQDVIQEDVLNLARQANIQIQEIQRTPQRYSARRATLRYIIVRLAKVEMKEKMLKAAREKEFHIQPN

SEQ ID NO: 923733 - protein, 233 aa, Homo sapiens
MTDDTRRSYKTGLIAMKGNPTNGQSCSQCALSYMLCGKEKWAAAYGLVSWQTADCKKFEGSENLQRKRYVDILRGMGMKCKYICIINALQRAFNTGKTIQQPNRISQPAGISQSLSLVSPVLNYGCINVVAIVEEDYEGPNRMPPTHQEAACINDRSTWLYNRLAHSPQHKISARHPPRPLACVENASQPNHSFLHNPSSFSSTAGVNPESTLQSTSCLQISISEFCCLGDLA

SEQ ID NO: 923734 - protein, 196 aa, Homo sapiens [sequence omitted]

SEQ ID NO: 923735 - protein, 180 aa, Homo sapiens
MFSNVWSHFWLLQLGEGHLVDNAERVIIWEGQSERVAEDAMTENLPPASPCSAVPRSPQWSPIAGCSWLVSRTAVPCSELLYGVAYVAGTEDNLQCQPAKNGGPQCPALSCSMEWPMWQELKIIFNASQQKTEVLSPTSHKEMNSANNRVNETAVLVRNAIAAFRRDSGIEDPTNGCLDS

SEQ ID NO: 923736 - protein, 180 aa, Homo sapiens
MLVREARAAQEPMEWVGGSGMAGCRSRALPRGKAAKARREIEHSAGGPALLGDSVHPPQPLARVLSPPLPGASRAGRLLRVRGLLSPRPPGTPGGPQAPHAAPVPAHASPSTPHCKLKEWAPALASPEKGSHSAVGGLKGSSNATKVGAQAEEMPRASEGSEDCQHAVTSHDDNNVQCYP

SEQ ID NO: 923737 - protein, 434 aa, Homo sapiens
MWPVAENSAYAVRECNEPCICEVHEQRQLQVWMHPEATGVLRITIIISTIITIAIITITITITIITIITITITIITISITITIITISITITITIITITIITIITITVTIIIITITIITIIISIITIITISITIITIIITIITITIITITTITITIITIIITTTITIITITVTIITIITITIIITISITIITIITTITITTITITVTITITIITTITIITITVTIITIITITIIIITISITIITIIIIIITTIITTTTISITITIITIITVTIIITVTITISITIIISTITTVTIITIITITITTVTIIITIITTITIIITIIIISIAIITSVTIILCSGTPVTGDTCDLGRLCLETPVPGTPVPGDICDQGHLCLGTPVTWDTCDWGHLCLETPVTGTPVPGLPMIRNTLCLGSPITRNTVTSDIRSGDTWTQS

SEQ ID NO: 923738 - protein, 135 aa, Homo sapiens
MAGLALPLLAIIVSHRVGWLPSAGKGHSVTTFFVPEFGVEVAEDQTTVNPAAPLSLATQWSCHTWAGPGACLQGNGWAVELPNVPVFCVMLPGQQILGHVRGRQKSVPFPSSILAYPSPGNLGRHDHECQSDLHP

SEQ ID NO: 923739 - protein, 228 aa, Homo sapiens
MHIKVWVIKAICDKPTANIILKGKKLKAFPLRMGTTKGCPLLPLLFNAVLEVLAREIRQEKEIKGIQISKEEVKLSLSIVDPHLSPYTKMNPRWIKALSLRPETIKILKDTIGKTLLDMGLGKDFITKNPKSNETKTKINRWELSELKIFCKAKGKSVNRQPTEWEKIFAYYASDKGLISRIYNELRLTSGIILFLTSSYFSLKAQISDISLYHPSHTAFILGIHIRV

SEQ ID NO: 923740 - protein, 148 aa, Homo sapiens
MELSGRFHRAAYKAVNYDKLKETTQGKDENPAQFMARLAATLRRFTALDPEGPEGGLILNMHFITQSTPDIGKKLQKLESRPQTPQQELTSPSRCTIMERRMCPVCAGPHWRSDCLTHIAATPKAPGAQTQRSLADSFPDLLGFVAED

SEQ ID NO: 923741 - protein, 141 aa, Homo sapiens
MGSEPPHRVPTGAPPGAAVRRGPPSFRPQNSRSIDSLHPMPEEAADTQHQPMKTAGREAVPCKATRVELPKSMSTQLFHQCDMNAGFKKDMDSIKIILKLQDLTALLDFRLAWGLLYLRCSGQFLPYGKTVFTQYLYPHCI

SEQ ID NO: 923742 - protein, 528 aa, Homo sapiens
MEGPAEAMAEECRLLGPFGKSCSNPISAFTIPYLVVRGGPFSDAYAQLNFDALTTEQVTKVCMRAWDKLCAPGQTPVSFTTVKQGHPELYPDFLAKLQDAVKKSVSDECAQGILLPMLAFENANHECKMAMRSVQRQNLPDHEVLPAYIKACEGIGSDAHKTILWAWAMKDTNHTGPINSSLGACYDCEQLDQIAILIGQAQCRILQISGFDPNLIVIPLNRLEVQAAFQHSVPWQIHLADFIGVIDNHYPKNKLFDFIKMMSWVVPLLTKDQPIPEAVTVFNDGSSNGNASYVGPTDKLISTSYTSAQNVELIAVITAIQDFPKPLNIVSASAYVVHATKNIETATIKHIDNSELASLFSRLQQAVHQHRHPFYITHTRFHTTLPGPMSASNHKVDSLVYFATQEAQEFHNLAHVNAAGLKDKFALTWKQAKFIVHSCPQCQVFVLPNQESGINPRGLTPNALWQMDVTHVSSFGRLSYVHVSVDTFSGFIWATCQRGEGTAHVKKKSIFLLCSYEASISNKDRQCP

SEQ ID NO: 923743 - protein, 168 aa, Homo sapiens
MEPGYLVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQSRTEDKSVNKTDTIPAVIQSTFS

SEQ ID NO: 923744 - protein, 480 aa, Homo sapiens
MSACQFNELVSPHLRKSLANNLINNFPNLMASGRLKSPSTGSRVDLWLQPWCPVRKLVSGAEQVPGQMQRAEPASLPHQEEADAPEALFLENPVPEMSIVNVIMVIAIIMMVVVMMMMVRVMMVMSDDDGDNDGGGDDGDGDDGDGDDDGNGDDDGDGDDGDGDGGGDGDDDGDDGDSSSDYGGDDGANDDAGDDGGGDDSFGNDAGDDGGGGDDSFGNDDGGGDVGDDYHDSEDDDSGGDDGDDGGGDGNDGGDGDHGGDGDHGDGDDGDGGDDADGGDVGDDYHDRMMIVVMMVMVVVTMVMMVVVMVMVVTMVMVVMMVMVMVMMVVVVAMMMVVMVMMVMMLMVDDDSGGDGNGGGDNGDDGGGDGNGGDNGDDGGGDGNGGDNGDDDGGDGDDGDDGGDGGDDGDGDGDDGGGGGDDDGSDGDDGNGGGGGDVGDGDHDSEDDDGGGDNGDYDGGDVGDGDDDGDGDDVVEEDDR

SEQ ID NO: 923745 - protein, 128 aa, Homo sapiens [sequence omitted]

SEQ ID NO: 923746 - protein, 161 aa, Homo sapiens
MRLRESPGQLALRVWTFNHEFSTTVRKSSGISPNVGAIGRGGDCGAERVQSQGEQRLHPQMLQQGEPRASCPGCWIRSGIRLALSQEELPRTAVHQSRTQATPPCTWLPAAHRALSSTHQTQPLLTVIRAPGLPCGKGQWKWQHGRRHPWPCDAWLCQWLI

SEQ ID NO: 923747 - protein, 162 aa, Homo sapiens
MATVQGLNLWFISISYLPGRGPPNTIQPLLSRRSKEDSIPGTRSSRDHPFRESSVRLYTTWTRMSKSSYVEQRQGSRPCNDPGWCVLKTGERRPHIVGSCKDLTISNAWMRGLIYVAHLCLGKKKNLGRNLITLKANTSPLLSFGGWGTGIDFMYVYVMWGI

SEQ ID NO: 923748 - protein, 166 aa, Homo sapiens [sequence omitted]

SEQ ID NO: 923749 - protein, 302 aa, Homo sapiens
MESKRIFERTRTESSNGMECNNPWTGRQSSSNGIEWNHRMDSNGIIIERNRMESSSDGNEWNHHRMEMKGNRMELSSNGIEWYQHQTEKNGIFEWNRRESSNGREWNHLMEWNGIIHGLEGNHHRMESNGIIEWTRMESTSTCNHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNKSNGIIIEWNRMESTSNGKKRNYRMESKRIIERTRMESSNGMEWNNPWTRMESSSNGIEKNH

SEQ ID NO: 923750 - protein, 258 aa, Homo sapiens
MKLKWMDSSSNGFEWNLRKKLIEIIIEWNRMVSLNGIEWNHHQMEMNGIVIEWNRMDSLNGIRWYHRMDWNGIIEWTRKGSLLNGIEWNHRMVSIGIIIKWNRMESPNRIEWNNHRMDSNGIILKWNGMELSNAIEWNYRMQSNRIIEWTRMESSNGMEWNKSNGIIIEWNRMESTSNGKKRNYRMESKRIIEWTRRESSDGMEWNNPWTRMQSSSNGIEWNHRMDSNGIIIERNRMESSSDGNEWNHHRMESNRIME

SEQ ID NO: 923751 - protein, 270 aa, Homo sapiens
MEWNGIKTWTRMQSSSNGIEWNHRMDPNGIIIERNRMESSSDGNEWNHHRMEMKGNHRMDSNGIIEWNGMEQSMNSNGIIIEWNRMESSSGIEWNYDQMESNEWNHRIESNGIIIEWNRMASTPNGKKRNYRMESKRIFERTRMESSNGMERNNPWTRMQSSSNGIEWNHRMDSNGINIERNRMESSSDGNEWNHHRMEMKGNRMELSSNGIEWNQHQTEKNGIIEWNRRESSNGPEWNHLMEWNGIIRGLECNHHRMESNGIIEWTRME

SEQ ID NO: 923752 - protein, 150 aa, Homo sapiens
MESKRIFERTRMKSSNGMEWNNPWTGRQASSNGIEWNHRMDSNGIIIERNRMESSSDGNEWNHHRMEMKGGKKRNYRMESKRIIEWTRMESSNGMEWNNPWTRMQSSSNGIEWNHRMDSNGIIIERNRMESSSDGNEWNHHRMASNRIME

SEQ ID NO: 923753 - protein, 688 aa, Homo sapiens
MESSSNELNGIIEWSRMESSSNGMEWNHRIESNGIIFEWNRMVSTSNRKKRNYRMESKRIIERTRMESSNGMEWNNPWTRMQSSSNGIEWNLRMDSNGIIIEQNRMESSSDGNEWNHHRMEMKGNRMELSSNGIEWNQHQTEKNGIIEWNRRESSNGPEWNHLMEWNGIIHGLECNHHRMESNGIIEWSRMESSSNGKEWNHRIESNGIIIEWNRMVSTPNGKKRNYRMESKRIFERTRMESSNGMEWNNPWSGRQASSNGIEWNHRMDSNGIIIERKRMESSSDGNEWNHHQMEMKGMEMNGIIIEWNRMDSLNGIRWNHRMDWNGIIEWTRKGSSLNGIEWNHRMVSIGIIIKWNRMESPNRIEWNNHRMDSNGIILKWNRMELSNAIAWNYRMQSNRIIEWTRMESSNGMEWNKSNGIIIEWNRMESTSNGKKRNYRMESKRIIERTRMESANGMEWNNPWTRMQSSSNGIEWNHRMDSNGIIIERNRMESSDGNEWNHHRMEMKGNRMQLSSNGIEWYQHQTEKNGIIEWNRRESSNGPEWNHLMEWNGIIHGLECNHQSSSNELNAIIEWSRMESTSNGMEWNHRIESNGIIIEWNRVESTSNGKKRNYRTESKRIIEWTRMESSNGMEWNNPWTRMQSSSNGIEWNHRMDSNGIIIERNRMESSSDGNEWNHHRMESNRIME

SEQ ID NO: 923754 - protein, 145 aa, Homo sapiens
MEWNNPRTRMQSSSNGIEWKSSSNELNAIIEWSRMESTSNGMEWNHRIESNGIIIEWNRVESTSNGKKRNYRTESKRIIEWTRMESSNGMEWNNPWTRMQSSSNGIEWNHRMDSNGIIIERNRMESSSDGNEWNHHRMESNRIME

SEQ ID NO: 923755 - protein, 173 aa, Homo sapiens
MEWNNPWTGRQSSSNGIEWNHRMDSNGIIIERNRMESSSDGNEWNHHRMEMKGMEMNGIVIEWNRMDSLNGIRWYHRMDWNGIIEWTRKGSLLNGIEWNHRMVSIGIIIKWNRMESPNRIEWNNHRMDSNGIILKWNGMELSNAIEWNYRMQSNRIIEWTRMESSNGMEWNSQ

SEQ ID NO: 923756 - protein, 450 aa, Homo sapiens
MKLKWMDSSSDGFEWNHRIKLIEIIIKWNRMVSLNGIEWNHHQMEMNGIVIEWNRMDSLNGIRWYHRMDWNGIIEWTRKGSLLNGIEWNHRMNHRMDSNGIIEWNGMEQSMNSNGTIIEWNRMESSSGIERNYDQMESNGITMKLKWMESSSNGFEWNHRIKLIEIIIEWNRMVSLNGIEWNHRQMEMNGIVIEWNRMDSLNGIRWNHRMDWNGIIEWTRKGSLLNGIEWNHRMNHRMDSNGIIEWNGMEQSMNSNGIIIEWNRMESSSGIEWNYDQMESNEWNHRIESNGIIIEWNRMVSTPNGKKRNFRMESKRIFERTRMESSNGMEWNNPWTRMQSSSNGIEWKHRMDSKGIIIERNRMESSSDGNEWNHQRMEMKGRIIERTRMESSNGMEWNNPWTRMQSSSNGIEWNHRMDSNGIIIERNRMESSSDGNEWNHHRMESNRIME

SEQ ID NO: 923757 - protein, 1059 aa, Homo sapiens
MKLKWMDSSSNGFEWNHRIKLLEIIIEWNRTVSLNGIEWNHHQMEMNGIVIEWNRMDSLNGIRWNHRMDWNGIIEWTRKGSLLNGIEWNHRMVSIGIIIKWNRMESPNRIEWNNHRMDSSGIILKWNRMELLKAIEWNYRMQSNRIIEWTRMESSNGMEWNRMESSHRIEWNYHRMESNGINIKRKKTELSNGIEENLERTRMESSNGMEWNNPWTGRQSSSNGIEWNHRMDSNGIIIERNRMESSSDGNEWNHHRMEMKGEWNHRIESSVINIEWTRMESTSNGIKRNYRMESKRIIEWTRMESSNGMEWNNPCTRMQSSSYTIEWNHRMDPNGIIIERNRMESSSDGNEWNHHRMEMKGRIIERTRMESSNGMEWNNPWTRMQSSSNGIEWNHRMDSNGIIIERNRMESSSDGNEWNHHRKEMKGCDHHRMDPNGIIIQRKLMESTSNESNGVNQRPVTASSSSNGIERNHREWNHRIESNGIIIEWNRMVSTPNGKKRNYRMESKRIFERTRMESSNRMEWNNPWTRMQSSSSGIKWNHRMDSNGIIIERNRMESSSDGNEWNHHRMEMKGMEMNGIVIEWNRMDSLNGIRWNHRMDWNGIIEWTRKGSLLNGIEWNHRMVSIGIIIKWNRMESPNRIEWNNHRMDSNGIILQWNRMELSNAIAWNYRMQSNRIIEWTRMESSNGMEWNKSNGIIIEWNRMVSTPNGKKRNFRMESKRIFERTRMESSNGMEWNNPWTRMQSSSNGIEWNHRMDSNGIIIERNRMESSSDGNEWNHHRMEMKGMEMNGIVIEWNRMDSLNGIRWNHRMDWNGIIEWTRKGSLLNGIEWNHRMNHRMDSNGIIEWNGMEQSMNSNGIIIEWNRMESSSGIEWNYDQMESNGSSSNGIAWNHHQMESNGIIIKWNLIESLKRIEWNQSNGSIVEWNRMVSTPNGKKRNYRMESKRIFERTRMESSNGMEWINPWTQMQSSSNGIEWNHRKDSNGIIIERNRMESSSDGNEWNHHRMEMKGQMESNGIIEWNRMESSSDGNEWNRHRMESNGFIEWNQMESSNGLKWNH

SEQ ID NO: 923758 - protein, 170 aa, Homo sapiens
MVSNGIIFKWNGMESSHRIEWNYHRMESNGINIKRKKTELSNGIEENHRTDSNGIIIERNRMESSSDGNEWNHQSNGIIIEWNRMESTSNGKKRNYRMESKRIIEWTRMESSNGMEWNNPWTRMQSSSNGIEWNHRMDSNGIIIERNRMESSSDGNEWNHHRMESNRIME

SEQ ID NO: 923759 - protein, 529 aa, Homo sapiens
MEWNNPWTGRQASSNGIEWNHRMDSNGIIIERNQMESSSDGNEWNHHRMEMKGMEMNGIVIEWNRMDSLNGIRWNHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNKSNGIIIEWNRMVSTPNGKKRNFRMESKRIFERTRMESSNGMEWNNPWTRMQSSSNGIEWNHRMDSNGIIIERNRMESKKRNYRMESKRIIERTRMESSNGMEWNNPWTRMQSSSNGIEWNLRMDSNGIIIEQNRMESSSDGNEWNHHRMEMKGRIIEWTRMESSNGMEWNNPWTRMQSSSNGIEWNHRMDSNGIIIERNRMESSSDGNEWNHHRMEMKGNRMELSSNGIEWNQHQTEKNGIIEWNRRESSNGPEWNHLMEWNGIIHGLECNHHRMESNGIIEWTRMEESLNGIKWNHHRMEMNGIIIEWNRIELWNEIQCDHHRMDPNGIIIQRKLMESTLNESNGNTIELKRMELS

SEQ ID NO: 923760 - protein, 1114 aa, Homo sapiens
MESKRIFERTRMESSNGMEWNNPWTRMQSSSNGIEWKHRMDSKGIIIERNRMESSSDGNEWNHQRMEMKGEWNHRIESSVINIEWTRMESTSNGIKRNYRMESKRIIEWTRMESSNGMEWNNPCTRMQSSSYKIEWNHRMDSNGIIIERNRMESSSDENEWNHHRMEMKGMEMNGIVIEWNRMDSLNGIRWYHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNKSNGIIIEWNRMVSTPNGKKRNFRMESKRIFERTRMESSNGKEWNNPWTRMQSSSNGIEWNHRMDSNGIIIEWNRMESSSDGNEWNHHRMEMKGMEMNGIVIEWNRMDSLNGIRWNHRMDWNGIIEWTQNGSLLNGIEWNHRMVSIGIIIKWNRMESPNRIEWNNHRMDSNGIILKWNRMELSNAIAWNYRMQSNRIIEWTRMESSNGMEWNKSNGIIIEWNRMVSTPNGKKRNFRMESKRIFERTRMESSNGMEWNNPWTRMQSSSNGIEWNHRMDSNGIIIERNRMESSSDGNEWNHHRMEMKGMEMNGIVIEWNRMDSLNGIRWNHRMDWNGIIEWTRKGSLLNGIEWNHRMVSIGIIIKWNRMESPNRIEWNNHRMDSNGIILQWNRMELSNAIEWNYRMQSNRIIEWTRMESSNGMEWNRMESSHRIEWNYHRMESNGINTKPKKTELSNGIEENLRTDRMESSNGMEWNNPWTRMQSSSNGIEWYHRMDSNGIIIERNRMESSSDGNEWNHHRMEMKGMEMNGIVIEWNRMDSLNGIRWYHRMDWNGIIEWTRKGSLLNGIEWNHRMVSIGIIIKWNRMESPNRIEWNNHRMDSNGIILKWNGMELSNAIEWNYRMQSNRIMECTRMELSNGMEWNKSNGIIIEWNRMVSTSNGKKRNYRMESKRIFERTRMESSNGMEWNNPWTGRQSSSNGIEWNHRMDSNGIIIERNRMESSSDGNEWNHQSNGIIIEWNRMESTSNGKKPNYRMESKRIIEWTRMESSNGMEWNNPWTRMQSSSNGIEWNHRMDSNGIIIERNRMESSSDGNEWNHHRMESNRIME

SEQ ID NO: 923761 - protein, 546 aa, Homo sapiens
MESKRIFERTRMESSNGMEWNNPWTRMQSSSNGIEWNHRMDSNGIIIERNRMESSSDGNEWNHHRMEMKGMEMNGIVIEWNRMDSLNGIRWNHRMDWNGIIEWTRKGSLLNGIEWNHRMNHRMDSNGIIEWNGMEQSMNSNGIIIEWNRMESSSAIEWNYDQMESNMEMNGIVIEWNRMDSLNGIRWNHRMDWNGIIEWTRKGSLLNGIEWNHRMVSIGIIIKWNRMESPNRIEWNNHRMDSNGIILQWNRMELSNAIEWNYRMQSNRIIEWTRMESSNGMEWNKSSGINIEWTRMESTSNGIKRNYRMESKRIIEWTRMESSNGMEWNNPWTRMQSSSYKIEWNHRMDSNGIIIERNRMESSSDGTEWNHHRMEMKGEWNHRIESSVINIEWTRMESTSNGIKRNYRMESKRIIEWTRMESSNGMEWNNPCTRMQSSSWYHRMDWNGIIEWTRKGSLLNGIEWNHRRSRLESLSNGIEWNHRIESNGTIIKWTQMELSSNGIEWNYRMQSNGIIECNRIESSNGLEWNHRMEWNGTVNELEWNHH

SEQ ID NO: 923762 - protein, 649 aa, Homo sapiens
MESKRIFERTRMESSNGMEWNNPWTRMQSSSNGIEWNHRMDSNGIIIEWNRMESSSNGNEWNHHRMEMKGNHRMDSNGIIEWNGMEQSMNSNGIIIEWNRMESSSGIEWNYDQMESNNRMELSSNGIEWYQHQTEKNGIIEWNGRESSNGPEWNHLMEWNGIIHGLEFEWNHRIKLIEIIIEWNRMVSLNGIEWNHHQMEMNGIVIEWNRMDSLNGIRCNHRMDWNGIIEWTRKGSLLNGIEWNHRMVSIGIIIKWNRMESPNRIEWNNHRMDSNGIILKWNRMELSNAIEWNYRMQSNRIMECTRNGIIEWNGMEQSMNSNGIIIEWNRMESSSGIEWNYDQMESNEWNHRIESNGIIIEWNRMVSTPNRKKRNYRMESKRIFERTRMESSNGMEWNNPWTRMQSSSNGIEWYHRMDSNGIIIERNRMESSSDGNEWNHHRMESNRIMMNEIQWNHRMDWNGIIEWTRKGSLLNGIEWNHRMVSIGIIIKWNRMESPNRIEWNNHRMDSNGIILKWNGMELSNAIEWNYRMQSNRIIEWTRMESSNGMEWNKSNGIIIEWNRMVSTSNGKIRNYRMESKRIIERTRMESSNGMEWNNPWTRMQSSSNGIEWNHRMDSNGIIIERNRMESSSDGNEWNHHRMESNRIME

SEQ ID NO: 923763 - protein, 628 aa, Homo sapiens
MESKRIIERTRMESSNGLEWNNPWTRMQSSSNGIEWNHRMDSNGIIIERNRMESSSDGNEWNHHRMEMKGMEMNGIVIEWNRMDSLNGIRWNHRMDWNGIIEWTRKGSLLNGIEWNHRMVSIGIIIKWNRMESPNRIEWNNHRMDSNGIILKWNRMELSNAIAWNYRMQSNRIIEWTRMESSNGMEWNKSNGIIIEWNRMVSTPNGKKRNFRMESKRIFERTRMESSNGMEWNNPGTRMQSSSNGIEWNNRMDSNGIIIERNRMESSSDGNEWNHHRMEMKGRIIERTRMESSNGMEWNNPWTRMQSSSNGIEWNHRKDSNGVIIERNRMESSSDGNEWNHHRMEMKGMEMNGIVIEWNRMDSLNGIRWNHRMDWNGIIEWTRKGSLLNGIEWNHRMVSIGIIIKWNRMESPNRIEWNNHRMDSNGIILKWNGMELSNAIEWNYRMQSNRIIEWTRMESSNGMEWNKSNGIIIEWNRMESTPNGKKRNYRMESKRIIERTRMESSNGMEWNNPWTRMQSSSNGIEWNHRMDSNGIIIERNRMESSSDGNEWNHHRMEMKGNRMELSSNGIEWNQHQTEKNGIIEWNRRESSNGPEWNHLMDWNGIIHGLECNHHRMESNGIIEWTRME

SEQ ID NO: 923764 - protein, 162 aa, Homo sapiens
MESKRIIERTRMESSNGMEWNNPRTRMQSSSNGIEWKSSSNELNAIIEWSRMESTSNGMEWNHRIESNGIIIEWNRVESTSNGKKRNYRTESKRIIEWTRMESSNGMEWNNPWTRMQSSLNGIEWNHRMDSNGIIIERNRMESSSDGNEWNHHRMESNRIME

SEQ ID NO: 923765 - protein, 162 aa, Homo sapiens
MESKRIFERTRMESSNGMEWNNPWTGRQSSSNGIEWNHRMDSNGIIIERNRMESSSDGNEWNHHRMELKGNRMELSSNGIEWYQHQTEKNGIFEWNRRESSNGREWNHLMEWNGIIHGLEGNHHRMESNGIIEWTRMESTSNGIKRNYQMESKRIIEWTRME

SEQ ID NO: 923766 - protein, 570 aa, Homo sapiens
MERNNPWTRMQSSSNGIEWNHRMDSNGINIERNRMESSSDGNEWNHHRMEMKGRIIERTRMESANGMEWNNPWTRMQSSSNGIEWNHRMDSNGIIIERNRMESSDGNEWNHHRMEMKGMEMNGIVIEWNRMDSLNGIRWNHRMDWNGIIEWTRKGSLLNGIEWNHRMVSIGIIIKWNRMESPNRIEWNNHRMDSNGIILKWNGMELSNAIEWNYRMQSNRIIEWTRMESSNGMEWNKSNGIIIEWNRKAIIIEWNRMESSNGLEWNNHLTESNGIIIGWKRMESSSNGNERSHHLMELHGIIIKWNRMESTSNGIKWNHLTELNGIMEMNGIIIEWNRMDSLNGIRWNHRMDWNGIIESTRKGSLLNGIEWNHRMVSIGIIIKWNRMESPNRIEWNNHRMDSNGIILKWNRMELSNAIAWNYRMQSNRIIEWTRMESSNGMEWNKSSSNELNAIIEWSRMESTSNGMEWNHRIESNGIIIEWNRVESTSNGKKRDYRMESKRIIEWTRMESSNGMEWNNPWTRMQSSLNGIEWNHRMDSNGIIIERNRMESSSDGNEWNHHRMESNRIME

SEQ ID NO: 923767 - protein, 212 aa, Homo sapiens
MPPGLQGQSVSSGSSEIKSDDEGDENLQDTKSSEDKKLDDDKKDIKSITRSRSRKPNILCIVNCQSHLNQSQGQVDIKILPKTWHKMEKFPENSGRKQSNVDTFFFPTPLENVASLLSHSNNDDEDLTPEQKAEREKERRMANNARERLRVRDINEAFKELGRMVQLHLKSDKPQTKLLILHQAVAVILSLEQQVRETERQSFHTVEQCICA

SEQ ID NO: 923768 - protein, 249 aa, Homo sapiens
MDRTQGDYVLKTKDQVFKDCPSRPPHYPPPGAWGVFSILCCALEYSDTDHKVNEHEQDGNELQTTPEFRAHVAKKLGALLDSFITISEAAKEPAKAKVQKVALEDDGFRLFFTSVPGGREKEESPQPRRKRQPSSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 923769 - protein, 300 aa, Homo sapiens
MRQLSLSSLSLSSSLSSSSSLFPLSSSSFIVTILITIVIVTIIIIIITITTITIITIIITITTIIIIATITTIISTIITITTTTIIITTIIITITTIIIIITIIATIIITTTIIITTTIINIIIIITITIITVIITIIITIIAIIITTIITIIITTIIITITTIINITIITIFIITIITIIITIIATIIIIITTIIITITTIINIIIIIITIITIIITIIITIIATIITIITTIIITITTIIITISTIIITIITIIITIIIITVIITIIIIIIIILTIITIIIVIIIIQSRSHADAISSY

SEQ ID NO: 923770 - protein, 280 aa, Homo sapiens
MGSGLDDDDDDYDGNDGEDDDDDDNDGDDDSNDDDGDDDGDDGDDDGADGDDDGGDGDDDGGNDGDNGSNDGDDDGDDNGDDGDDDDDDVDDGGDGDDDSGNDDDDGSDDGDDDGDDGDDEDGDDGDVDDGGDGDDDGGNDDGDDGGDDDSDDGDDDGDDNGDDGDGDDDDDVDDGGGDDDGSSDDDGSDDGDDDDDGGDGDDDGGNDDGGGGDGDDGADDGGDGGDDDDGGDGDDDSDDGDGSNDTGCLGSSLPFTWLCLFRQVTLLSLLQFLICELSL

SEQ ID NO: 923771 - protein, 134 aa, Homo sapiens
MGRTSRWGRDGRGSPLLPVSEGQISPTQGLKTRLGKTTTFFSFSDWGYPHDFLCLSHQSCLLKAWHQEQGFDLCTSGSNLVLLLASCVTLGQLLHLSEAWSSSVQNGNHSNTYSPEFKLHILYPPDRLKLKTVW

SEQ ID NO: 923772 - protein, 137 aa, Homo sapiens
MYGGPMSACSLMYPWCLEEDLEYGGIPEESIVIIGDDSSMHVIPPEDLPVGHDMGVENNDVENPDPPEVTTPVLLDVLQLPVAHPCPLMRNSSPTTLLMGPHPLTEGPGRSLSQRDPSHELARACDLGGMSQSDYSS

SEQ ID NO: 923773 - protein, 156 aa, Homo sapiens
MLALFMQAIIKSAQLPPEEKLQSCRAGWKRGGDLQKRKRKGLKVENNRDVCITNTQAQMHREMHSRARPEKGKRCQSQAKRDRAETAAHKNNLRKRRNERDVERQHFRDINQRDDTSIQRQTRETENMCAHERQTKEGTNTESDRNTKTQNKRYTE

SEQ ID NO: 923774 - protein, 128 aa, Homo sapiens
MKSYWIRVGPKFNYWSPNKKVQRHTERRQPFEDRGGDWNDVATSPGVIGFVSSHEKLERSKPRFFPRASEGTWWELNNENSWTQDVEHHTPGPVVGSGEGGGIALGDIPNVNDKLIGAAHQHVTCIHM

SEQ ID NO: 923775 - protein, 233 aa, Homo sapiens
MCAQLFHLLPAGREQADADKSLRNIAITNSHKYCLQWLPSPSLSVFLLKEVMGERRGVEIFVLCAQQVYCKDEVTQWMFKHIQKWNLASEILKPEIPLFLEPGSPEVEDCPSHKAPPSSDDITQSRTNHCNFLKVPPTGKFINTQIAEPRQSNSLRTYYKLPPTLCPTSSYSGPYEETEKWEFRENLMKLANSQGLSRAFCEDHPYSYLDSAGCSPSTKNLIFGFLFVLEKQG

SEQ ID NO: 923776 - protein, 379 aa, Homo sapiens [sequence omitted]

SEQ ID NO: 923777 - protein, 316 aa, Homo sapiens
MQPPQRANAEFGDGDVDGDGDGGDGDGVDGGGGDDGDGNGDGGGDGNGGGGDGNGGGGDGDGGSDGDNDGDGGGDGGGGGGDGGGGGDGDGDGGGGDGGGDDDGGGDGGGGDGDGGGDVVVMVMVMVAVMVIVMVMVMAVVMVMVVVMVVVVVMVMVAVMVMVMVVVMVVVMVVVVVMVMVMVAVMVMVVVMVVVMVVVVVMVMVMVVVVAVMVMVVVAVMVMVVVAVLVIVVMVMVVMVVVMVMVMMVMVVMLVVVVMVMVVVMVMVVVVVMVVVMVMMVMVVVMVVVVVVMVMVVVMVMVMVTGYSNICICFCI

SEQ ID NO: 923778 - protein, 139 aa, Homo sapiens
MNTLIVSPHRSRDRAFLRPQQAVLRPLSVGITPRDLNPGLADPRAHADASGKPQCENELRSEVLARIRYWEYFSAPEEKTSDHRVPSGFVLYHQDYVKYIVPFGKPSSSPRKVDQVGIPFIFTEQETGSEKCGDFTRLT

SEQ ID NO: 923779 - protein, 147 aa, Homo sapiens
MWFCVITAVPFSVWQAASWGPSTVVQMGHIQIRFHLPWVAFLNLGGLAHHESSASVVPCCLSWSKNKPFFLFAWLLRFPCIQGDLNDEKQQVTYRSGGIMFQAEGTASVEPEMGMSLGMRSHMEDGKNPGICSPYKGTNSIMRTPLS

SEQ ID NO: 923780 - protein, 121 aa, Homo sapiens
MIFPGKPCLSCLCVSKTPKSLVMFGSTSCVLGALFSMHFSKAHGSEIQQEQIMEDSNPDYARKVIWAEENLLAIPRSIPSASGQRQEEPQTSPPASSSTEGVLDLKLSGDWNHCCGLYSRA

SEQ ID NO: 923781 - protein, 218 aa, Homo sapiens
MRLKVKDLRQYLILRNIPIDTCREKEDLVDLVLCHHGLGSEDDMDTSRRAYGWRPNIQIWSAGTANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 923782 - protein, 118 aa, Homo sapiens
MYWLKMETGKSKIEGLAWHLVGTFLLCHPMVEGGRAREGGDQVKKDEAEEPAMGQIMQRLLNFIKDIRLHFQDNRGSLNCFNKGNDSITLALKDNGSDGSHYETPDNAEPIPESVPVV

SEQ ID NO: 923783 - protein, 233 aa, Homo sapiens
MEDAKTITNTIIIITIILITIITITIIIIITITIIITIIITSIIIITIILTTIIITIILTTTIITTIIITIILTIIIITIIITIIITTIVTIILTTIITTIILTTIITVIITITIIITTIITTILTITIIITIIITTIITIITITIIITIIITSIIIITIILTTIIIITIILTTIIIITIIIITIIIITLCWTHPYPSLIFQSLMSPIPLHPIPLSPYLSLIGIMIIIFQLAA

SEQ ID NO: 923784 - protein, 141 aa, Homo sapiens
MRVTNRKPSRRGSTLSLSRASGGSSPQSSMISVNPGSDEPPSVNTQVTSSKDIEDNESSSTKPDEEPLYMNLQKLLEMVREDARRTVTIENGMQRKAPSRTNCDINIHYKSGVCNTMRAKFYSVAQEAGFCLQDKMEILMK

SEQ ID NO: 923785 - protein, 162 aa, Homo sapiens
MAAADSGISPRAVWQFRKMIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYSCCYPTGFLQQKVRERTQNWTDWPSFLA

SEQ ID NO: 923786 - protein, 154 aa, Homo sapiens [sequence omitted]

SEQ ID NO: 923787 - protein, 140 aa, Homo sapiens
MEAAEITDEDNSISAMYQAVGELPQANRDTLVFLMIHLQRVAQSPYTKMNVANLAEVFGSTIVAHAVPNPEPVTMLQDIKCQPKVVERLPSLPLEYWSQFSIVEQRTLTPYMSLKTQMPFQHQILKMFDFILTLICKTPI

SEQ ID NO: 923788 - protein, 136 aa, Homo sapiens
MKSLQGSGLVPASSIPISTKHLNLPLNTLELATEHLNSSLPNLPGLVKFSRLLHKLLLTNSKFPEEKDPNVRNDKYYWRKHKREDWNFRYQKKIIIGGQKTRLINSLATGDRTQSLTPLEVGLREGLKAPNLESYG

SEQ ID NO: 923789 - protein, 141 aa, Homo sapiens
MIKVTRRKRRKKEKERKRERKKEGRKERGREGRKEEEEERKKNGKKKERKKEGRREGEKEGRKKKKKERRTERRKKERKKERKKERKKEERKERKKEKERKKERKKERKKERKKERKKEGKKWLKIGYLITIFQAWVPRRN

SEQ ID NO: 923790 - protein, 141 aa, Homo sapiens
MAGCRSRALPRRKAAKACTPSAAAGPGAKPLIAQGGRASPLLRVRTGQAHAHPELQLARKHPRSPCSRWRLSLHTSLQAEGAGSGLGQPRKGLPRCSSGLKGSSSAAKVGAQAEEALRVSEGCEDCQHAVTSQYDCIPRKP

SEQ ID NO: 923791 - protein, 180 aa, Homo sapiens
MTMVVFQFVSVTLEELVTEKDFLVLQIKLLKVCSLPVWMMRVRGPSPSSPNSSQVVAAALFHGPCKLGKQKPREKQMGHLGIKHIISYPFCGTAALLKSESITVARMVTPFLVSWNEKTKMTRQQLEFNGTLPVSASGNIFSLVAKISNLRRKKNGCHWLVLPGKFMNQVPQVGSISFQL

SEQ ID NO: 923792 - protein, 255 aa, Homo sapiens
MCSSMVKATSSSYYRSLALTRLQMVRCRCGFHFVLWVPVVLVGSGVSLSSPSSHPAFLLNISLAEKSQAHYQMLKQQPSIDFFTNFHNWRTQTHNWYQEWSEDEGSRMGWGLDNSLVARSTPPHDTWGLTPARTPGDGANLLLGSLLEIWAGASDPAGWSEDWGKGWTLFLKDTTSILVAAQLQRVTSILEGPVELAKCLICRCGIPYSIASDHGTHFTGAQCQDQPSVLRTLFLNLLPLASQGPQRFQPPLSES

SEQ ID NO: 923793 - protein, 165 aa, Homo sapiens
MEQYVCDGRTGDGPTISAIYGGGNNEPPGPCSAPPCNERVLLTKNIDCKGLRLQRQSHSHRILETAKGTLETTFRHDRKFSEDPPEADAAGPGQGPYCPAQPWDIFPGILAAPAPALAQRAPDAAQNAAPEGKNHKPWGLPCGVKPVGARVQELSLGSLCPDFRG

SEQ ID NO: 923794 - protein, 136 aa, Homo sapiens
MKSCRPCSRQPEMQEAVLGCTCKEQESNTPQWQRQLNMFKSTHFLAVFVLTTTFPDSMNQYEQVGCLVLKGWTFLSLLEDETPCGAEKPSQPSPTDQTGFLVARSSIPSGAASLLESQLSQPMPEELSADPENDEK

SEQ ID NO: 923795 - protein, 135 aa, Homo sapiens
MTACLRVLKPYVRSQSLTEPIPKSTGSFLRQHHGATKWTAFEQLNSLWEAIVTMPAEEAKCLKDYNSHPQCDSLPTAVCCELKVCEERRGVLTHTITRSHKVCKLRSKEASLNPKAEKLGVRCSMAGSIQHGRKM

SEQ ID NO: 923796 - protein, 147 aa, Homo sapiens
MRLSYMAFIMLRLIPMTCASTGLDESPGAFLSPLEKCPVKEQSNHCCNDVPAQEVRGGPHAKNLLYRPKPYLSGKSSCARSCEGEKPNSGTHGWSSRYTLSEVSFNFSVEFSFSFLDKSSLCESLHDSLLLPNWPGHKIYFQRMPPT

SEQ ID NO: 923797 - protein, 134 aa, Homo sapiens
MLNFPRPPWPTMPPSCAYKNPETLAGMSTSSWTSRGTHQWKNTQAAGRQEDNERGTPAEEHTGRHQQMLAGQLERVVHVASRNETNLKKSKNLGHEQVGNVYDYSFWIPNRNLRNHKYFHEKLSLQEIATDILP

SEQ ID NO: 923798 - protein, 129 aa, Homo sapiens
MTGVPGHSPRADRGRDGATSSICGPPAASRRLHQPIPSLGTPAPFTHHSRLRGCPGVLPMAPGVCRSQRTAETPNPVQRAREAGLCQKQQRSPAPAAKKIDTPTRTSLLNAWKNWSYMTAIFNKGTKGE

SEQ ID NO: 923799 - protein, 156 aa, Homo sapiens
MRPEKENQPLTSRNGSDDQKQAIIIVALLEIKDDGEKRRMDKGEGTAWCSSLLIHVVGMEAERKNGQSQKSQDLVLVGCGAQLPTCGPEQWRMPWLCPGTQPSTSLASEHWGLWQWAPVTPTGPHDVCSHPTYEEIVSQGDDVTCSGLHSKYLDRV

SEQ ID NO: 923800 - protein, 156 aa, Homo sapiens
MTVQPLCWQGGVTASWKLMGLSYLGKGFQQGGLCQRENPGLKCCCSDFVPQGAPFRHAFPLPIGMGLPESQSAVIVFSLLGLATTWSYWALGWYRGGGRGVCKESCDVTHLQVSQLWMPASAPVENAFNDEEKDLYTYLQNFKKLNSEDLSKSPIA

SEQ ID NO: 923801 - protein, 155 aa, Homo sapiens
MAHVSVSNGNIGLQASWPLGFQVGCIGTGGPGGLLLGSPGGTLDISSEDVYKALHGLGCQQHSHILRSSRTHNAAVLWVNVGDFDGALGYGDTEDNELSDRLPMVVSNIHWGPSPGSVFLRKFLSIKSTIETWVMRACSLVMVANLYRGNLTRMQ

SEQ ID NO: 923802 - protein, 135 aa, Homo sapiens
MVDPLTACTGKAADTQHQPTKIAGRKAVLCKATDVELLKTIGTHLLHQCDLVAEKADDGLLIAELQPIKMLHRTLSYFCKDICCQKRILIKQKHISVLSVARRLVKAFLSQMHAKSGEMEALRSNLHKKHNMVFS

SEQ ID NO: 923803 - protein, 140 aa, Homo sapiens
MGTDILSSWQNLHIGSLTGRVRAIMMGMAKWKPLELPLPRKRNRRRLCNRSRLLCKLLCHLGHMTQQIQWCLWCQWQIRMLFGSFGRNPIGESQQRLLGFWSKALLSSADNYSPFERQLLACYWALVKTEHLTMGHQVTM

SEQ ID NO: 923804 - protein, 165 aa, Homo sapiens
MYIPLPFDDGMLLCVTHFMARWLKANCFWWALWTGMEKKAFAKSMAAYWVPDVLICSSNETTSGTAAVIGVEAAQMASHHNSPHPTSQGASVGVLPAAKYVYANYAFWHWGNDHRKIFGTTLLEMFWGFKIEVFVFVRFFPQWSTRGNNYTVKGVVCKEDPFTVL

SEQ ID NO: 923805 - protein, 204 aa, Homo sapiens
MWAAEHCLDKPGAMCIIEGPVDSWDSPVMPKGLVESGQSTYLDGPGRSCSEILTGQRIPEHCYKALSVCSSHRIPEHCCHCLNVCPPHRIPEVCCWGLNVCLPSRIPEHCCEGLNSHRIPEHCYKGVNIFPSPSIPEHCCKGLHVGPSYRIPEHCCCGLNVCPSHKILEHCYKGLNVCPSHTIPEHCCRGLNVCPSHRIPEHCY

SEQ ID NO: 923806 - protein, 1070 aa, Homo sapiens
MYSHLLQGTDKQVAGLFPVVYCSDGFCDLTGFSRAEVMQRGCACSFLYGPDTSELVRQQIRKALDEHKEFKAELILYRKSASACIQFQPRVSRIQQKNIRISAGQIYHTTGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLTLLMAVFALLAHWVACVWFYIGQREIESSESELPEIGTGGSLCMWWGGSCVRGVLAVKGQSGGKPWGWVCVCVSPPPGPGILAHSLPACSGPAVPPSGWLQELARRLETPYYLVGRRPAGGNSSGQSDNCSSSSEANGTGLELLGGPSLRSAYITSLYFALSSLTSVGFGNVSANTDTEKIFSICTMLIGGEPGRARLPGATPRLLPAGGAVPLPGGPEAGGSSALALMHAVVFGNVTAIIQRMYARRFLYHSRTRDLRDYIRIHRIPKPLKQRMLEYFQATWAVNNGIDTTELLQSLPDELRADIAMHLHKEVLQLPLFEAASRGCLRALSLALRPAFCTPGEYLIHQGDALQALYFVCSGSMEVLKGGTVLAILVKDLYMWGGGDLTTADDIESSGSQGTCRFTVGTAEALGLRFLIHLAIHNQDEKQERARKASATEAQPSSEGNLSNLQPPLLSSWLKLSGLADLYFLSPGKGDLIGCELPRREQVVKANADVKGLTYCVLQCLQLAGLHDSLALYPEFAPRFSRGLRGELSYNLGAGGGSAEVDTSSLSGDNTLMSTLEEKETDGEQGPTVSPAPADEPSSPLLSPGCTSSSSAAKLLSPRRTAPRPRLGGRGRPGRAGALKAEAGPSAPPRALEGLRLPPMPWNVPPDLSPRVVDGIEDGCGSDQPKFSFRVGQSGPECSSSPSPGPGVRSYQVNVL

SEQ ID NO: 923807 - protein, 373 aa, Homo sapiens
MIMMMMMVVVMMVITMMVMIMVVIMMTTTVMIVIMMMMMMVMMMMMVMVVMMIMMMVMVVMMMMVMVVMMIMMMVMIIMMIMMVVVMMIMMVMMVMTLMMMVMIIMIMIVTMVVVMVMVMMVVERAQLCPRDTQAFTPNSGSCGTHSTGALGHWALGLRGFPSLAGIPCFAANSFMRGKPEEKAQGKWPLSPPWYQVAKVYAMPPERLRAHLISEAKQGTLLEATWVTGLHRTQHFGEGNGDPDWPPRALPEPDAEGEGALPGASRGTLSTAPIAHAVIDKRRRDTFVGPRLALPTWGALPASLRPHAPSARRGSSADASSQLRVPARRTLIRVCPRSSHRASTGGFRMHEVHAPARDPESGPGPRVPPPLGP

SEQ ID NO: 923808 - protein, 364 aa, Homo sapiens
MEKSRANLALVLGSGAAVSTCSPHVLVVFSGESPDLSEGATCPSILLRPPPRFLHLRSRAQSFSLQTRIINAQVLEELKRKPIACQNMPQKGTGATETLLTPLVCPLTAPGEGPTGIQHPDCAGKHLLTGKEISISTNGHSMQVTLKIHGGRAVGPDRGAGSGCTGALTCWVTVHRVTLLGALTCWVTVHRVTLLGALLGWVTVHRVTLLGALLGWVAVHRVTLLGALMGWVTVHRVTLLGALLGWVTVHRVTLLGALMGWVTVHRVTLLGALLGWVTVHRVTLLGALMGWVTVHRVTLLGALLGWVTVHRVTLLGALMGWVTVHRVTLLSALLGWVTVHRVTLLGALMGWVTVHRVTLLYPKT

SEQ ID NO: 923809 - protein, 149 aa, Homo sapiens
MRSSPTFVDLKCGGPRGPLFRATLTASQLQRGQVDSTPSSTARCLPLSAAQISGAPAAETWTLLYAKQRAVGFPRVTVRFAGDCEPASVASALPGAHPVSDPPARRILDPHLPHPWISASSVSWRSLSQAQFLMDVTTCSLTGASSIPE

SEQ ID NO: 923810 - protein, 138 aa, Homo sapiens [sequence omitted]

SEQ ID NO: 923811 - protein, 145 aa, Homo sapiens
MTPRQRGGCLALVISEPASPLGGVAAPREKEEDHRPPQELVACGAQAPYQSSPRLCVSRSPVGWRGQASLLAAFCGGALHEARCTEGETDARKARGSLGHRQPWCLEKGSGLRSRDLKYADQKSPLKAASTDGRPVILALENLPD

SEQ ID NO: 923812 - protein, 197 aa, Homo sapiens
MPGPHYPQMSHGSSSSPPPPPLRLLFLLLFFLLFLFLLLLLLFLLFSSSSPLPPLLLFLLLFLLLLPSSSSSPPPPPVPGAVVMDTKGQVHFWSQTCIQLLSAAKWKQLHLLKPQGPVVAGPGTVPDTDASWDVRASLPQGAEESRQSTVSFAAGSEGSLPIELLRLRTVTSPEDVPCYALSTYKKGILCPQFIPVL

SEQ ID NO: 923813 - protein, 122 aa, Homo sapiens
MAIKMMFSPSVSGMRHVRTSEKYSSFTMNVNRLLQMNSPQTTLSSPGDTFKSPSVSSVWSVVNSDWSMHHSDKSMLYFNISVPWGICSQLELPTGLERAGKFSPPHHLSVVYPQSLYISRQV

SEQ ID NO: 923814 - protein, 147 aa, Homo sapiens
MAGMFGRAVHSGSDEEPEGLRHRKLLDPPARMRLRESPGQLALRVWTFNHEFSTTVRKSSGISPNVGAIGRGGDCGAERVQSQGEQRLHPQMLQQGEPRASCPGCWIRSGIRLARGPTKGVCTQAGSLFPEHLSPAPTAVPSSARVR

SEQ ID NO: 923815 - protein, 143 aa, Homo sapiens
MDVYSSVAGLNPGCPHAPQVLVSITVTMETTSSKGNVLKRQKHQYPWAHSHSTQNGDVCDFPGSYWTHVQTMWTSKKGLRVYANGTLSTCDMRRKVSHAYGDPDVNLVMGSQQDWTQHYDNGALDEFNIQGWPYLWMRSPCTS

SEQ ID NO: 923816 - protein, 144 aa, Homo sapiens
MHGLQSKHKTQTIQTWDQIGFLNENEAPTVAADFLRSYQNQKLNGNTLEIGPARMFQFEGKKGKNFCGKRRGLKMFKIYFMSDKEMKRTIYLCVSKDTSFFSTIDYYVKTGFLYNLQSYPKDSKEIFCVPRPVLGIINIIENRT

SEQ ID NO: 923817 - protein, 301 aa, Homo sapiens
MRAIMMGKAKWKPLEVPLPREIVNKKQYLIPGGIAEISVTIKDLKDAGVVIPITSLFNSPIWLVQKTNGSWRMIVDYRKLNQVVTPIAAAVPEVVLANSFFSILSIRPTRSNLSSAGKASKEKKALQQAQSAVQVALPPGPHDLADPMVLEVSVADRDAIWSLWQAPRQLLACYWASVETERLTMGHQVTMRCKPPIMNQLLSDPSSHKVGHAQQHSIIKWKWHICDQAWAGPEGMKWGMLPPGDTTIIPLNWKLRLPWTTLGSSFPLSQQLTRGVTVLAVVIDPNYQDEISLLLHNAGGN

SEQ ID NO: 923818 - protein, 139 aa, Homo sapiens
MDCTWRILLLVAAATGTHAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATDTVNIHRVGKAAINGVDANIPL

SEQ ID NO: 923819 - protein, 170 aa, Homo sapiens
MLYFNYLFLKFLSHLTGIALAGAGWQDSPSDEVSNIEGHFLNGGVVEDLDVSKSPLVFFCHHVNSHTFTAKPSTSTDSMDMVFPVGGKNWRIPSKVNTSFVTRIRMRSLMNFLVTSSTSEGIAADSKTTWVHVIKAVNNLIPVTLNDTFGLHPIGAVVSGSGILARRHDP

SEQ ID NO: 923820 - protein, 156 aa, Homo sapiens
MLLYDLKGESLFQSSKENFDVNSPHLTKSVKNTMRCWCSADTVLVFPTHGGNLGICLTLVLAGSRRANLAEVPRGILTSRRSMNVHGLNARLYIRRKPDPDLHWMATWHFSMFLPLSPPCPLESQGAQWPSDQGLGASLQKTVTQWRKTNHKALKS

SEQ ID NO: 923821 - protein, 172 aa, Homo sapiens
MEELYNQRAISGEDSQRPSAHLAVKKIFVGGIKEDTEEHHQRDYFEQHGKIEVIETMTDQGSGKKKRFAFVTFDGHDFVDKTVIQKYHIGNGHNCEVRKALSKQEVASASSRQRSQNCSGNFGGGHGGSFGGIDNFGHGENFSGHGGFGGSCDSSGYGGSEDDYNGFGFKPV

SEQ ID NO: 923822 - protein, 155 aa, Homo sapiens
MGLAFLWSKSGSGFVSWGPCLFPLAMPSPTSPPGPTVRPQALPLLSGMGYLHAKGILHKDLKSKNVFYDNGKVVITDFGLFSISGVLQAGRREDKLRIQNGWLCHLAPEIIRQLSPDTEEDKLPFSKHSDVFALGTSWVHRLQSLSCSLVPRDRI

SEQ ID NO: 923823 - protein, 193 aa, Homo sapiens
MILDQILELGKQRDVCLHKLQMHVEMCPDLRMCTGPSRTMREAGAVADTILTSLPLRPQNEEVHDEAEESEDDFEEMNLSLLSARSFPRKASQTSIFLQEWDIPFEQLEIGELIGKGRFGQVYHGRWHGEVAIRLIDIERDNEDQLKAFKREVMAYRQTRHENVVLFMGACMSPPHLAIITSKLEIDKLSSHP

SEQ ID NO: 923824 - protein, 250 aa, Homo sapiens
MATGILPEGDEPPFSFQALPEPTPVSDPLCNRLFSSLCRHTVSATLVPADPSQRSRQLHQAQSCCCLISLGEESTLAISRGDVPRELIECTSAPVGLSLYTGDLQTAQVCSKWMGLESEAIFVEQMNDPYESSRFSTKYWMSQTCTVCGKGMLFGLKCKNCKLLNDNDNDNKKQAYDCFTGGHDTSFKKTAELLVKETICPPQHLSMKEERKGRFPTAQGFPNISLAMSWSSENFSGFTAPADSNADPLP

SEQ ID NO: 923825 - protein, 145 aa, Homo sapiens
MIFTNCQPPEKIMAMYHHKISISLINEKGPPELQYGLEPGQLPTLYLQESFLLLFIQSETFFECSPAVMGNEETDELMSKISILIEHPGCWEHRYKRADYDNVKSCKVEVQNATEIYNRGAAMVLLNRAVSILLFKGNFCYLTDE

SEQ ID NO: 923826 - protein, 135 aa, Homo sapiens
MFKGASELPAVTASLPSKTALWFTRTASNCCYYYCIDPYIHSGLEPEPGFQIARQRSDLVIYPIRLKCIYYMLKHIPVSSENDPQRKTEPDPNPISICVRQNIPRLLSITSVPPNLYLEFRRDCREVIFRGSKVT

SEQ ID NO: 923827 - protein, 151 aa, Homo sapiens
MLTVDVKKQVKPENKMKKNQRRGGEKEEKVMSLKLWEDSDAQCGRIGPRTAEEWLESSGIQDVSIVNLSRAFQRTYHKIQLYGICQRTKVRINAKCIDANYALKDSENDHKRVHGPYISKDHAANSTYIVWALSLFYQISMGLLGDELGKF

SEQ ID NO: 923828 - protein, 141 aa, Homo sapiens
MAQGWCGRFKTVFSPLFSASFNDMKLKPGPLLQVCWSLLEIHYRPCLPGYHQQSLQNSKDCCLFLPLEALSQRAPARYQPECSYMSCLPLLGDVSQSRGTGVRDPFEEAVWPLAELEHCAGRSAALFRAGMQEHLSLLKLG

SEQ ID NO: 923829 - protein, 181 aa, Homo sapiens
MHSCKQFLCKYVSERVQEGYWLSVVSVLSGYALVYTNKECWGDQTQHQVVGVTKLGRVKGLRKREKKDASTCKHVHCTMSPPLVCTNTVTLISWCSWHMQSTFGDTRYGPVSPLPKIHSNVNFCPCIHTVVGEAYIAEREREHYILQGSSSVVLSFQLITSYPKSEFILSVSLCFTLSALN

SEQ ID NO: 923830 - protein, 176 aa, Homo sapiens
MRAIPKPLGQDRPRKLGCEVCGILKGKEELGVRVQGNTEEGILEVQNRITRKAREKSKVSQLQLRRWEKYLVTGCPRIPWMVIDLEDSCPGQEINTEKTTPVSRRKSISWPSIVKHTWGSPGTGAGLVPATPWANLKLKHAQKYESSFKKSKMKKIFDQTFYQRRHMDGKKRMKRW

SEQ ID NO: 923831 - protein, 134 aa, Homo sapiens
MTLNKDIREIHKRGHYHKIQCEVDSDRRQTNSQADRDRSLVKLDLQAKDSMKPENQTTSSEWSPCTGDKNLELAELWEQKELREATGHHSLLLSNRREEVKPLDATPGDVLLQLRPSGHGCSGERATLQLKHKG

SEQ ID NO: 923832 - protein, 137 aa, Homo sapiens
MEIAGELELEVEPEYVTELLQSHEKIVTDQESLLMDEQIKQFLEMKSTPGEVALTARLSQSSGCCCPGSLGPAHALIAYPDFSLCGEGVLLECKGNLEAARIVLLFTFVEIDARGMMEYKCVLLHLYYEENIMKSLT

SEQ ID NO: 923833 - protein, 345 aa, Homo sapiens
MVPGQAPAHVINLTEPRVCLIIEGQEIDFLLDTGAAFSVLISCPGRLSSRSITIRGILGQPVTRRTNEAVIPLYPVVPNPYTLLSQIPEEAEWFMVLDLKDAFFCIPLHSDSQFLFAFEDPTEHTSQLMWTVLPQGFRDSPHLFDIKTVEGVPWNYWLLPTWIPRYSKIARPLYTLIKETQRANTHLVKCEPEAETAFKTLKQALVQAPALSLPTGQNFSVYITERAGIALGVLTQTQGTTPQPVAYISKETDVVAKGWHHCLRVVAAVAILVSESIKIIQGKDLTVWTTHDVNDIVGAKGILWLSDNHLLRYQALLLEDGASNMNVHGPQPCHFSPRGWGTHRA

SEQ ID NO: 923834 - protein, 140 aa, Homo sapiens
MLHAQENGILYLVDDVYHSICGCVVPIDNGGPFNCDILDSYTQRLPCEHEDAIYNPRREAKDRPFPQSLRRNQSCPHLDLGLLAFRTMKVSMLKRARSVSSFTYAGMGGSERPHTEATGSCPGVGADQAWTIWHVSILRG

SEQ ID NO: 923835 - protein, 203 aa, Homo sapiens
MTVALKTKSDQTKVKHFRNPYLIAVEDFPRLSSQGVEHVCVIHIFDVHLTSNYVEFHKVLSSFIIHQKLIYLREKSQFYYYLKKKMSFVTHAVPYLLSKTSKPGHPNLGLGFCKYKCMKALTIILAIHYHQCNQPGPGLPGSRNLESWRQCTIYSQTRGGCFSIETDMGKAQHRNGPRRNKEQGIYLEHGKQMGIKFEVSWKE

SEQ ID NO: 923836 - protein, 141 aa, Homo sapiens
MNQASPDPETTGTLILDFPASRTNLRQGYIHKYGGDNAGLSAPAMNSHFWPYPPYPGNGLRPWKLVWSCLGRKLQASEYPECGLVGGPGSWGACPFGRSDSLPWSSQQRARMGASNMQCPGEGLLLPRSKGQTAGNTSGSG

SEQ ID NO: 923837 - protein, 129 aa, Homo sapiens
MLFPVVFRSQPGGKKVIPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQEQGL

SEQ ID NO: 923838 - protein, 137 aa, Homo sapiens
MSGGTHPGGWGILAGCVAPYPGVTCANGLISRDPTAPYEPAGPLWLPKSEYILRYICGGCGDVVTQGLRFLEEGSGPPWVHNQYGICCLSEDRKLPLTALPRPARAKRLPDILAVSSLSQSPTENSEEGPIPLMWAC

SEQ ID NO: 923839 - protein, 153 aa, Homo sapiens
MSMMAVMKMATLELRNVHSLDNLTALSLSKNRWEEATGKYDMGKGNRVLALTGTGSSELIAHRPTGMIQEALPSHNLVTLSTSRTCHLCSTSDMHNHSHILDHKANFGIAASLKCDYDDTFSAGLSENSSCRNGNRVDKGHFQVFLVCKAAPL

SEQ ID NO: 923840 - protein, 414 aa, Homo sapiens
MEAITNGMMNLNRQRHQHLVALRIIFAHGENGGEEVFIRDKLMERRNRRTGRTEKARIWEVTDRTVRTWIGEAVAAAAADGVTFSVPVTPHTFRHSYAMHMLYAGIPLKVLQSLMGHKSISSTEVYTKVFALDVAARHRVQFAMPESDACDNLKTCHTSHGSVMAETAVINHKKRKNSPRIVQSNDLTEAAYSLSRDQKRMLYLFVDQIRKSDGTLQEHDGICEIHVAKYAEIFGLTSAEASKDIRQALKSFAGKEVVFYRPEEDAGDEKGYESFPWFIKRAHSPSRGLYSVHINPYLIPFFIGLQNRFTQFRLSETKEITNPYAMRLYESLCQYRKPDGSGIVSLKIDWIIERYQLPQSYQRMPDFRRRFLQVCVNEINSRTPMRLSYIEKKKGRQTTHIVFSFRDITSMTTG

SEQ ID NO: 923841 - protein, 179 aa, Homo sapiens
MRMMGMAVCQYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSK

SEQ ID NO: 923842 - protein, 156 aa, Homo sapiens
MIKKEKVSFALHGFLKENCHIKLYMSMMAVMKMATLELRNVHSLDNLTALSLSKNRWEEATGKYDMGKGNRVLALTGTGSSELIAHRPTGMIQEALPSHNLVTLSTSRTCHLCSTSDMHNHSHILDHKANFGIAASLKCDYDDTFSAGLSHGYFDS

SEQ ID NO: 923843 - protein, 139 aa, Homo sapiens
MVRQILWQCLPGASLQDLSKASYKVHSFSKACSQKLKVCCRGGALMENLYQGNTEGKCGVVQPPHRVPTGAPPSGAVRRGPPSSRPQNGRSIDSLHCAPVNAADVVKAGCQWPTDKEGYSRESLEGPARRSRDRLDHPI

SEQ ID NO: 923844 - protein, 135 aa, Homo sapiens
MDTNNRGDTFPKTKSPGCFYSRWDSGQLKVINGIEKEKEKWLLSKEKAREGENSSTQRRQGILQRKRMMDLPSCLQGPCSLPPSGLIPYLIPFVHPAPDSLVSLSSPILPVSNCPSFGNSALLFINEITYPTFSS

SEQ ID NO: 923845 - protein, 142 aa, Homo sapiens
MVGSNVSMPDSLLFSHSLVLVSPDAATERLLGSNCPALLGVLLARINSGCPLETQSVSPRPLPTTCNPSWKAGNKRVGLLVVGILLGKLLDLIEERGATTCRFLASLPIGPRTNPQPSADNCHQVAPAAVDLDSLDSCNPGC

SEQ ID NO: 923846 - protein, 379 aa, Homo sapiens
MMFLSLCPCVLIVQLPLMSVNMRLPGAVFDLQLAEVESTQVRITWKKPRQPNGIINQYRVKVLVPETGIILENTLLTGNNELSENLMQQMEMPHRQKLAPPNPFDLLPGESSTLESLAKLHRQSVITVAKAVTTRNQYITDIAAEQLSYVIRRLVPFTEHMISVSAFTIMGEGPPTVLSVRTRQQEYPNGKITHYTIYAMELDTNRAFQITTIDNSFLITGLKKYTKYKMRVAASTHVGESSLSEENDIFVRTSEDEPESSPQDVEVIDVTADEIRLKWSPPEKPNGIIIAYEVLYKNIDTLYMKNTSTTDIILRNLRPHTLYNISVRSYTRFGHGNQVSPCFNLYQSILARAVCVAPVSKWAASVEFLLATYEFTFRA

SEQ ID NO: 923847 - protein, 231 aa, Homo sapiens
MDRLLPQVGGCPSGTKLPEEGSGSNICCSAASAGDTQANRVWSGTPANSNRPAAEDPVRRKTNKQKETTSININKKVIYTKTPFVGHQHQRPKVEKTAKMERNQRRKAENSKNQSASSPPKDRSSSPAMEQSWMENEFDKLTEVVFRRSIITNFSELKENVRTHCKKATNLEKRLDEWLTRINSVEKTLNYLMELKTLAQKLHDTCTSFNSRFDQVEERVLVIEDQMNERK

SEQ ID NO: 923848 - protein, 142 aa, Homo sapiens
MGAKKRHLLDHRLTVNTLGIKRKYPNKIKGIYEKLTSNMILNAERIKLFSLRSGKREKFHFVLLFNIVLILMDIIFSPYFSGGRLSCRGGWPKAELPFGLKKELLSLNSLAKTGYLVSLNQKAIREYNCTMSSEYLMKSVND

SEQ ID NO: 923849 - protein, 148 aa, Homo sapiens
MDAELQVTLTVEDTSTPSLATDHAPLTISLKPNHPYPTQHQYPIPQHALKRLKPVITHLLQHGLLKPINSPYNSPILPVLKPDKPSKLAQDLRLIDQIVLPIHPVVPNPYTLLSSIPSSTTHYSVLDLKDAFFTIPLHPSSQPLFAFT

SEQ ID NO: 923850 - protein, 136 aa, Homo sapiens
MQIQETKEDVKEKYAYRPLNSFCCKADFVLSQWKNAHGLALTLRQTSLALGLARYMTMEMDTTFAFNKAFAEEIELSLKVLLVTERRLMSNFKESYLDMFRGNDHYTQSGMFQKLEFAINVHFQGQARVSPMCLCL

SEQ ID NO: 923851 - protein, 148 aa, Homo sapiens
MTWEMQHYVVLGNATFGQENKNACPHLGPWAQAWGWNPRQGPHPSLPSTSLPRFGGLSSFQRVNITLRFFKENSYLSYMFKTLHLRDKSEGEKKCYKIPKWSETLREEKRKQTQRYKEEEHVNEEADFGIVLSQTMEYLESPKPAEGK

SEQ ID NO: 923852 - protein, 144 aa, Homo sapiens
MVFISYGVWKKRMLMEATMVKKPGESNCVHPPQKTSLLTGLTWALTHSLPHLHPQKSAWQTHVEKSPLTLLFEACDIWSQRVETLHTLQSDACTVDFVISKSVTVYPQPELGKHPSYVFPCTGHSHVVIEGKIPNDSIKCCWCQ

SEQ ID NO: 923853 - protein, 152 aa, Homo sapiens
MMKSSRDCDERRRRYIALVILCFRVNLRVHLLWPFFLLPQPGLHLQDYYYCCCSVEQALMKTFLLRMSKQFYQRKNPALRGYKPLYSSPPSNATRRAECLHLPLSAFNKSQTRGQQSMTEISCYCCVWHVSILVKTPSQSSLLLKPNICGKV

SEQ ID NO: 923854 - protein, 134 aa, Homo sapiens
MLGFTWFIKDKRHLKRTQVQPELVSKPYELDELNPSQRAKTGYSFKCGSIGKALFLGEKKTTWKGRTLYHLSAYCLPALNPPFPMQLCNTEARPYRRFSFASWHTRLYQQRACEDKGAFPSSLFLCCHFPSAQK

SEQ ID NO: 923855 - protein, 124 aa, Homo sapiens
MSIIDFKCDKFLKKLKQNVMKENDRGGTVWTGLLGPRAESSMTEKDKSSEEDQEERNVHGHSRQMRVEILETPENHRTKEKAKPRLKVVSEVGAGDGDWEGRRGFIEPVDWSPTLTAVAAAARD

SEQ ID NO: 923856 - protein, 128 aa, Homo sapiens
MKRSLIGSLFCRLYRLLLLGRPQEAYDHGRRQRESRHIFIWLAGNREWGGELGERCYTPLNKQNLGEVYHKNNKREVLLHDPTTSHKPFPPTLRINYKIWLMISYHTSLRNGNDWRRTPFSPNHLVYT

SEQ ID NO: 923857 - protein, 139 aa, Homo sapiens
MKPEDFVQFTHLERCQCQHSSPKSLLVLQQRPDAIEDRKEDHTPKPTDLSAGELLAKAFHFPVCKVGKYNTVKCHNGKWEPMKGLEQHSGQADQADSQLFPLHSGLGGAAGSAEFDISSGDFQCYTEYKCKSGHPCLIP

SEQ ID NO: 923858 - protein, 154 aa, Homo sapiens
MGSNQLGVFSAMARCTWTSFVIGPSLSMKAGYLFPARKSGFLICQWETLIPFSRIMLPCTSGLLEVRQGMDTPCSGQWHMSRSELCLQTSFSYGGACANDVPANMMWMDVYGGFHHELHIQANFTAIEISKISIEAVDHSSMLISEAINCVCEI

SEQ ID NO: 923859 - protein, 189 aa, Homo sapiens
MPHREVENADESGKLLKYRLVKRCFMVINGMRADNRKIELGYRNNMYKGPVEGWRLGIFRDLKEGPPAHLLSSALFPEEEAELSLFHHPLATPVTKASPLKRPAPPALYHQPYASLREHNVSPWSPASRDVLCDSRCKENEQAAEKAGDKKSTLSRALKGLPERGHMHLKKIPQGWGQNPTWKVIVSYP

SEQ ID NO: 923860 - protein, 514 aa, Homo sapiens
MSKGPAVGIDPCTSYYVASTDTERMTGDAAKNQVAMNPTNMVFDAKRLIAHRFDDAVVQSEMKHWPFMVVNDAGRPKVQVEYKGESKSFYPEKVSSMVLTNMKEIAEAYLGKTVTHAVVAVPAYFNDSQRQATKDAGTIVGLNVLRIINEPTAAAYGLDKSQPGVLVQVYEGHIEIDCLYEGINFCTSITHARFEELNADLFRGTLDPVEKALRDAKFDKSQIHDIVLAGGSTRIPKIQKLLQDFFNGKELNKGINADEAVAYGIAVQAAILSGDNHMTVLIKYNTTILTKQTQILTTYSDSQPGVLIQAYEGKHAMTKDNNLLGKFELMGIPPAPRGVPQTEVTFDSDANGILNVSAVDKSTGKENKITITNDKGCLSKEDIERMVQEAEKYKAEDEKQRDKVSSKNSLESYAFNMKATVEDEKLQGKINDEDKEKILDKCNEIIIWLNENETAKKEEFEHQQKELEKVCNPIITKLYQSAGGMPGRMPGGFPGGGAPPSGGASSGPTIEEVD

SEQ ID NO: 923861 - protein, 154 aa, Homo sapiens
MPPPSRQLLLPVPETREIHDQSEAPECLCQDNGDTDGHRARGHQKHRSKCLMPVEGAVNPRDTEKDRPCAGEAVVYGQRGDYKGIFGNEGKETALGNPEMNTQCIRAKPAITQERMILEASSPPWKLIERLSTEKMVSPKGEQFHSDVHSWLVG

SEQ ID NO: 923862 - protein, 137 aa, Homo sapiens
MTTVSAALKGTHVSRSSRKVTVYKGYIRNCPVTWLAVWTPGPSVNSALSSQVSHARVLAVQLNSSGCYHSPWKLGRQNSLARDSRACYISGSIFLTIVAFVRTLRSREGAAGREDGKARDLHWSCFTGRPGYQEIDS

SEQ ID NO: 923863 - protein, 142 aa, Homo sapiens
MGPGGQQTRGTILRAPGLPGTGSMAVAPNENIVSIVTMILQVVSEFPTLAKFLWELQGFQSSRVFGLNASTSWKNGTCPHTLRVMGQGEDGVGGEAQKGKGKWLYLSPSHFSNCAGFAGKNHTMSVSDFYFYSPICPLFLSI

SEQ ID NO: 923864 - protein, 119 aa, Homo sapiens
MKGLARSLLWVLMQQTFCDSLSIVDVHEREHTSARHKVGTQYTRVKWRNRQGGHGFEIIHAHAFICLLKPNGHICGKGGEIVNDTHGPGVFSMMLQHLGQLWLQINLCCKRSLGPGNVK

SEQ ID NO: 923865 - protein, 141 aa, Homo sapiens [sequence omitted]

SEQ ID NO: 923866 - protein, 219 aa, Homo sapiens
MQMLELQGPRECIKKGKWEPEPQPVLALVLELRLGPLPGLGLAWLEEHLLVPPVWPSCGERKPGRTMAVMFTPLTVKYVYCDTERIGVDLIVKTCFSPNRVIGLSGDLQQVGGASARIRDALSRVLQYAEDVLSGKVSVGRFLVNLVNQVPKIVPDDFEIMLNGLKGIRIHNRVEEKVINIISDLGASCRNQEMVEQKDQENPMNKSKTWYKNSEFIPK

SEQ ID NO: 923867 - protein, 135 aa, Homo sapiens
MLGWKKPNVSIIPDLTIGFSVSVSIPFPPHKTVNAMGWEPHLFKIILNLYVIKCLLFAKRKAWNTYRVEETARISKNQASPCPCSLHQHFSDSWQMLMSEKRVIQSQGWVPRTSEGHDLGDPESFLEKFFIETNA

SEQ ID NO: 923868 - protein, 156 aa, Homo sapiens
MEHKERDNMAALAQDNMASMLQGLFKRKNAQSCLISFMGRQIKPPLGTLHCIVMQVSPVFLSISIDKAGLVPSSSFSPSSASSRELTSPFSATDNLHQRESHFLCLSLINSLINRDILMVHMCRAVAPCSAHPTGQRLFPIISHGQRVQPYPVRKA

SEQ ID NO: 923869 - protein, 144 aa, Homo sapiens [sequence omitted]

SEQ ID NO: 923870 - protein, 161 aa, Homo sapiens
MTVLQSEHPLGLVEQMLRPPGSRLHLNKMLAVLHKEFETRQPSSSSKLLRVTVPLGQGPQSWSPRASPGSLCTWKPCCHVTSHEPGGVGSSGGLAGSRGPQGLSSPALHEKLPREPGPPPLTPPFWALAHPALCVHQQTPGAAGNAQDTLSTPLPPMGSSS

SEQ ID NO: 923871 - protein, 157 aa, Homo sapiens
MKYLRSGQEGLFTDTGFPPHPVRLVLILPISYSRWSCSGSHASNNVATGSENLSVYVLVVMVLLCVCVSQNRDIVFNFFVFPKCAKQALDKGPVTDAEFLTQGPPRVDKTVHIKPGQTHLDIDRRRINSGQGLSGQSSMDDSLSLEECQVQKDALGL

SEQ ID NO: 923872 - protein, 143 aa, Homo sapiens
MHAQLRPCTHAQPRPCTPSQLSLRWLFSWDVIVEGPAWGMAAWESEPRTFNATFQLLPCVSSPKGILQIKWIMFVLDTYECIHTCGFGHAVLANVLFLGGLKADVLSRACESSWAPLPSQDGCRRIFMRIPAASLPGVLKVTV

SEQ ID NO: 923873 - protein, 155 aa, Homo sapiens
MCAQCGGTVNVRSGGLGFIFSFVDDEFLIGKPSISLMPTTLKIKHPQGTARLVHPLGREAVKGRHRAHESLDRGSSAPLRAPAGSPQGPIFPMFTELDWKPKLVQPARAVRGWKLGGPPTFLLDAGAQSTALPCQSTCCDKGNIGGASITSGGEA

SEQ ID NO: 923874 - protein, 232 aa, Homo sapiens
MTVGLLDHPERPPTPASWPSSHQHGAFAMWVHRFRISKDPGRDISKQVWARTSARQNGVITKQGPGVFHQLQRPGWTLPSDIATPSTPEEKPVPSFLESPSSFGSRQESTKEVLENPLLQRKKGGCHCLEVKTMAAEFQGYMEVRVKGKSNVSEGMEGEEFKPAKEALINERVSRTTSSASPRRNPQEHKDLQPPKGGPAPSVGLDPKCSEKERLKCLVPKLNVASEGAILA

SEQ ID NO: 923875 - protein, 149 aa, Homo sapiens
MPSAHTEHQTLQQLRGLASNAQHIPRSLGRSRSMFPVFPDSLQHHSQGSLAVISSCNAASELTAGIFEKSQLFAPAPDYRFDIRATLKPIMLQQLDGALSSLINRKPFYELINKLEKSANSARSVLELLIKHIFSGTRQMMREDGVEGM

SEQ ID NO: 923876 - protein, 141 aa, Homo sapiens
MSAGPRLENTLQAFRLQRRQGLPSSPDSRLFVSILIQDENPTAEALSRQIFTGKREQERSLQGLLCNRSSGRQRPQVLNTEHMASPHHWTCNWEDEPGLGAKESGRRWGALFQCVTAPRRGVGCENDPCSGAMLFDAIFLL

SEQ ID NO: 923877 - protein, 207 aa, Homo sapiens
MTKGGKQPDKNQRSPKQPLQHFGGSQPVIWDAAESTATKREMRTLSTGMHSGAPGNHVLLLGEEHGAGVAMLKSNLLLVIDGAHGGSRGSFSEDSFEAPSSGLQHLPDSHFPSTYLWAIPCSQIHNKNMKNSDCGAVLVGEAAVQCLSLQNTAHLQDRIGCHVSCPRRREQGSRGENKVSLSLLVWQFALFRAGKKAWGRSHFGFSD

SEQ ID NO: 923878 - protein, 265 aa, Homo sapiens
MLASLQTRCSGPALKRLRSDMAVFQNQSQTAITLLLQLWVDQPPLRETETGFPEVMRHILWDLEKDIYPHSGEGTENLQRARLAQALASPVATPALHHCLLKGQVPRDSVAGMVPVEVREKARTQPTSLRMPKQLLSRVAPEPKPGVWHVPKHLMHFTLVAVWVSSGALCRDLRAPPREAAQGVPCHTEATVCDTVESHMETFIVHTGEEQGDYIPVPTCGPLQVSQELPGSTRGPQETRSQAAGAQQQGLRGKSCALSLLPGEA

SEQ ID NO: 923879 - protein, 121 aa, Homo sapiens
MVTTKMNDSCSLRVHTYTLASQSLLLSTRSLTPGFLGASGRARELLGHLESVLGGDPAKTIAREPDSLTANALSSTALAATSEHHFLTSSLFDALVACCALLLCHLNFTLFQGPAEISHPR

SEQ ID NO: 923880 - protein, 167 aa, Homo sapiens
MPTAPRLESLPLISCSFPGIFDTEDVKKSLLSAPESLCCMKVGGVHPPWAALRRWRVRVMDTDIRLFHVTSQFLWQNGYGLSEGPHGLRHQLLMVRPLGCPLWVDVLPLLLCALHPLIPASWEQIPHKRELALPTVNKIILGKPEGCHASLQRTLIPYSLRADCAEN

SEQ ID NO: 923881 - protein, 157 aa, Homo sapiens
MSPRGNPDPPVQAPLSTWGARGEGVGESWGSVGSAWGSRWGLGESVESRGEGVAELSGSRGGARGQHLGSALRAVGSTEGGCGGHGCVAPPGHGQETLGRRRCRKQRHPCYGRVPPIGSGLGGGHWIYSSGNKKRNHQPIYNSGMDEMAVTTGSSCA

SEQ ID NO: 923882 - protein, 202 aa, Homo sapiens
MGMTAEVLALSSYRCGLRPAGSREGSFYTSAVYLPQMLGAPLVTCPIPAGADLEIVCQWGQNEGGALKLSCYKLAFFPIDGLDYDQGIIQLWNRKESSSCGQMSHFLGEKPREPVTLDGTSSLESITSQSFRPKTYYSSVLARDCSCVNVAYFIQNRNIKTIRLLQDILIVCERKNSYFQNSVPVTAQAVYAFINIVTYFMH

SEQ ID NO: 923883 - protein, 140 aa, Homo sapiens
MVIFPTCHKSLSVSHGPYEIVTVLTSPDYCDDGTRWGARSSLHWGSDTMTQPCGPPPSPTNAQLGLLQTSPNPILAHYVPLWSLPSTLPHRAIAGSPMASFLLFLFTHWVAGDDPPRQGKAVVSALTPGWSGPLVSSFRA

SEQ ID NO: 923884 - protein, 135 aa, Homo sapiens
MDQLQVTHPFPFSGADGLRSSVSVGLLSGTALLSNTEKGPSIFRGSRENKWVQWEVGSRSSEAIRAADVHGAEVPGRAGFYSKGGHLWSQTSEKAIKVHLFKVDGSHAGWKAVPASVRLLGRLLQSQYGNWLPPE

SEQ ID NO: 923885 - protein, 263 aa, Homo sapiens
MSCIVIGQFRVVFQTLNVRGCKDNISRSTSLLPYVGLVSVAIVTSSLFYDMLVITEPMIVKKISGYKGRCHCKTSCVTNIQFPSRECGFCHSGRWGGETSRHKQHRAVVITLERAWESPGVLVEPQIAQLRPFRVSDSVGLGLDLNTCIPNKFLSCANAAIQGLDVENHFTMHHRKEELSTIAESVDLFYNAHDLSTEALSYHCPRHSKNWQRHLVFLPWFPLLSLVHLLAYSTSFEARRNILKENDTASSVLFAESSYSPHI

SEQ ID NO: 923886 - protein, 172 aa, Homo sapiens
MDPNQEEISGLPEKEFRSKWYWDNWLATCRRMKLNPRLSPHTKINSRWIKDLNLRGETTKILEDNIGQPLLDIGLGKDFMTNNPKANAIKTNITSWDLIKLKSFCTAKGTVSRVFVPKGGMLSSKPTFTGSIKWEGGCGQVDKACTIWVIYHQLCQAGNFGPQNPFPRMALH

SEQ ID NO: 923887 - protein, 153 aa, Homo sapiens
MAAGRERACAGKLLFIKPSDLMRLIHYHENSTGKTCPQEEQIMSYMVGSRQRERACAGKFPLIKPSNLPATPGCCKVAADLHSGVFFSKSADFLPAAPFCGSKGPQTLAQSSQQLQRTAAEEKYMGKTCPLDSITSHWVLPTTHRNYESYNSR

SEQ ID NO: 923888 - protein, 136 aa, Homo sapiens
MKDCGPLSSLHRNRRLSGTASAAPPWSVHTPTKPQLRSPKETSRQVAVSIHPLTSPVIRSHSTGSALSPPPYLQTWALSRLVHQLVVLPHPKHLESLCRFLQLNEVFSLQLQLNLPQLLSSIFNVSLAIGICSPPG

SEQ ID NO: 923889 - protein, 160 aa, Homo sapiens
MIVDPTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSR

SEQ ID NO: 923890 - protein, 140 aa, Homo sapiens
MRLPSGAFLLSLQGERDGSSFHEREEAGPQGEMGRDDGTSLELKMPKSKIMSKDMTASLTEISAVLGVCFWLCLCWTQGSGMSSGCGQPLNRCPGPSVQDTATLSVSTPRLSQLDVSKKQIIGHTIIHYVTINKLVKWMS

SEQ ID NO: 923891 - protein, 135 aa, Homo sapiens
MPGHLFEMTLDLNGMSSSHFVAVLKMDGYSNMKGRKQYLLNGPRMLLTYLTPSPHYSSRGVGLPDASGEVSPDLSEILKIIEMGTTMAEARIHQTQLTYWETYLATHAYGSCDLAVAQQEKQLTELTKYVGERYG

SEQ ID NO: 923892 - protein, 141 aa, Homo sapiens
MLQLVLHATACLSCYCLSCMLQLVLHATACLACYSLSCMLQFVLHATTCPACYSLSCMLQFVLHATTCPACYSLGKTQENVGPPKTVAPRVSSLHTSLHSASGKSTHCHLNIPTSIGLLCFRSRPSSSPQILELIGFFLQT

SEQ ID NO: 923893 - protein, 133 aa, Homo sapiens
MKSKNKYVQDNTTVNMILQCDMVAEKRDDILGILCGVSDIINASSVDGVLSGEKDVIMVPKSSMTEKSDQCARYDNAFIAEILIDRGVNVNHQDEDFWTPMHIACACDNPDIVLLLVLSLLSLDRGISHDTHN

SEQ ID NO: 923894 - protein, 141 aa, Homo sapiens
MWDAQKGKPGRAAPLDHVEQRPTASQQASRVHLRGMCWVETRQEHTEQEHGPALKEQQGGRCQQSRAQRESDWRSCNGCGLGLETDHGVAISRTLAFTYERRKAVGAFQIQKSRSTENNREENGVTESPSSTCGTKCVGFR

SEQ ID NO: 923895 - protein, 131 aa, Homo sapiens
MIRPHHRPAKSETGGLWHSAKQKNACPIPNASIISVEKHDEYDLIGTLPFLEYSGSFSAYCEQCNVRDNKRPRQSWLWEDPTPGRSGAALMSIPVILSRVGWEQLVMCGQCVIRTAAGAWATQTFCYRRFK

SEQ ID NO: 923896 - protein, 145 aa, Homo sapiens
MAKFLEHASWARSEVAGSTPGQLQWLPVVMVKSLEHPSWAWGEAAGSTPGRPQWLPVVMVTFLEPPSWARGEAAGSTPGRPRWLPVVMVTFLERPSWARGKAAGSTPGWPQWLPVVMVTFLETPSWAQGEAAEVLLLGGRSGCQW

SEQ ID NO: 923897 - protein, 147 aa, Homo sapiens
MLTLANTLQRLAVDSAALEGDLCVAVIQSGDWELPYWIERVWTLSPSQKLLVDSAALEGDLCVAVIQSGDWEPPYWIERVWTLSPSQKLLVDSAALEGDLCVAVIQSGDWEPPYWIERVWTLSPSQKLLVDSAALEGDLNKVTTGKL

SEQ ID NO: 923898 - protein, 149 aa, Homo sapiens [sequence omitted]

SEQ ID NO: 923899 - protein, 125 aa, Homo sapiens
MNGWVEEWMTENEWKGDSIPQRYEKPEAECDLPKVTHGLLTTHLPFTTMSDLTEPDMMGAKLSQQCRCRVSAVGLDRNRLCPHVEPTDGLVGSWAGLTSLFQRLSWKNVTLNGSGHCIDPNPRQA

SEQ ID NO: 923900 - protein, 147 aa, Homo sapiens
MLERPCGLLWPTHRATKPVAPRFFKKEHTNTFEEGNAKKALAIDGARGRGISSEEHSAEWHCGAWHGPGEHCLGGTLTGPAVGRSKPMGMLSHFLLFLEVPVQIPPIVLRYGVPGCYLLQAYCVCSVHRSGSVPTPEVHLRVKLLII

SEQ ID NO: 923901 - protein, 122 aa, Homo sapiens
MKIVPYVGLTFQLPSSQDLILNEVQENMLDSLSQVTWLSVVVASCKISGIGEAMHTSGIEHGRKVKALVAKHCPLDFLSPCLLPVPVSSPLHISPCHGTQRTSPRPWQPFAVICTVGGDGGH

SEQ ID NO: 923902 - protein, 159 aa, Homo sapiens
MPRGSHIDGSPGDTKGLQRHLAVGGGGGADLISPQKPATGVRTCGLNLRPPGREEALGLSPVSHAFGMKLCMETLERQGWRAPGCLECHHSSKRGPSVFQGAPPVSLFESPPHSGTLQSALVRLMQTPVGKQEVLNECWLVIERASWMATDLLIRTPPS

SEQ ID NO: 923903 - protein, 145 aa, Homo sapiens
MPPTQRLTCPLLLEQRGSISWLWGWEKGLGALNGVSLEFDDSVSSTPLTSCLKRHRCPWFLSCSVALGVSAGFSGLLSSGGTHFLELCLRQWLVPVCPHHPGLLNRGRRATSVEAESHWAWGPPRPLDHFLFVTFERKFVGNIGE

SEQ ID NO: 923904 - protein, 127 aa, Homo sapiens
MLKTAQNELCPRVPGRTYSPAGTVILALWALGWTWDCRTVSPRAALRMQATGAHTSTLCIDGACQIWPTAYFCRRRFMGTQTPPSKDNKMRREESFQQRELGMLEAHMQKKAVDFNTLSPKLTQNGP

SEQ ID NO: 923905 - protein, 119 aa, Homo sapiens
MPAGSGHLVVDIGSEKFTHVFLTLTPDRDLPTCCSAGVVCRSTHEPTLARTGFYRTLIASPELLLERRFANRRGDNLTQIFRDLCNDSPIRTCQMGPYSFSDNAGQCKRLGLVLNKVIV

SEQ ID NO: 923906 - protein, 315 aa, Homo sapiens [sequence omitted]

SEQ ID NO: 923907 - protein, 240 aa, Homo sapiens
MAAVGPRTGPGTGAEALALAAELQGEATCSICLELFREPVSVECGHSFCRACIGRCWERPGAGSVGAATRAPSFPLPCPQCREPARPSQLRPNRQLAAVATLLRRFSLPAAAPGEHGSQAAAARAAAARCGQHGEPFKLYCQDDGRAICVVCDRAREHREHAVLPLDEAVQEAKILGRLRDVPHGLGDVLPVCSEPLAWSASPQLSARGKSPAQPRSRCPHSYLFPRSGLCSKSPPRGTE

SEQ ID NO: 923908 - protein, 271 aa, Homo sapiens
MLGVEGHKHPCGYHYYDCTGLNLKSALHLVSPKAYTRGELPQALSWSRSAFQESEEAVDSPLAQGRSKNAIQPSSPGIRDPKSLFGSLTPVAVLEPKDWQWAPRWIRSTADTLLDLEGWKSAEGLRQRPTALVDGYNAIMHTKKFIFNVHGVIDREQSMQGNVQYSGFRYTQREKSSYRETNGNHYQGAFNNPLTFRKAKSEGRSETFTAALPITGPEVRREKFCPGPGSGPSCFVQNSVPCVPATAAPDMAKRGQGTAPDIASEDAIPKP

SEQ ID NO: 923909 - protein, 160 aa, Homo sapiens
MGQAGKRNLRIMNMKESDKNQAHAGLKSRGFKSSKMISFDSRSHIQVTLMQEVSSHGLGQLRHVALQGRVSLPDAFTGWHLVSAAFPGAWCKLLVDLPFWGLEDGGPLITAPLGGAPIGTLCGGSDPTFPFHTTLAEVLHECPIPKVNFCLGIQAFLYIF

SEQ ID NO: 923910 - protein, 161 aa, Homo sapiens
MGGLLAHCHLSSSHGLPSFTVSVQISSFHKDTNHIELGSTLNLMLISSGSCPQGDPSETSQKWLSGGPTGLLQLPPLPRISLGSPNCLTSSLALTVFGCLLGPAGTICFLQRVCGFSCLSWFISAVVLGAEVHNVSLHILLCLSQWELRFSPASYLPFFCY

SEQ ID NO: 923911 - protein, 156 aa, Homo sapiens
MALSKSLGPQGFILVEQLSYIGKVLGTAVSGKGYALKCVLTAKAQTYSSSYCWVSWTSMSETITSRSPSNVIAKSETYREMGIKSSHHSRCYKAFPSRCYRFYSPGHLQVEEQGSQSWLSPSPKTSKAGKPIAQPPVCGQRPESPWQITGACVTPL

SEQ ID NO: 923912 - protein, 178 aa, Homo sapiens
MAESNSPRHRFHTVESLSVDLDVMIINTVITESQRLREQKITFGKQSDDTVDPMAMISFKEISKLSSDSDVLAGRIASSKAKWPVATVARARATSTAIASSITTAIPTAVASSIATARARAIATAVARAIATAIAGAIATAITRAIATAIAGAIATAITRAIATAIAGAIATGVATFI

SEQ ID NO: 923913 - protein, 141 aa, Homo sapiens [sequence omitted]

SEQ ID NO: 923914 - protein, 139 aa, Homo sapiens
MGQDTARALASEAASPKPWQLPHGVEPVGAQKSRIEGIDAEVRKGERGIEGGGAACSQLNTDGLLLRIMSPGERDSEIKKYLKVRKMASVIQLPSENKVEIHPEVKTQLVRCLKIKKQTKLTVEQQTQRDFGDLETGSL

SEQ ID NO: 923915 - protein, 149 aa, Homo sapiens
MVTKNNFNAQTFVKIIEVSHCDSKKTTTAPAVVSMPACGAADTTTDLKKFSFHCNHHLHGWSVGMGGDAVDNRNARGTGPGNPDWFPWIQELPCLEGLSHQMCLNLFSLKKDECSLKNMRGSIFRKMSIHMLVYKTYMIRFYPVLVILQ

SEQ ID NO: 923916 - protein, 156 aa, Homo sapiens
MTQCPLLKFLCPALNNCSSCCLLDQERVGPVHIQVPKTGHSTIALGLRCILNHKLPWLLVPPITAYLDFLAGAAHSIGFIALPEWFVGQPGSSSLPHQRGLPEWPESCLYNPIKVRTCTQPNPIYSCHLGGRTPGNNIEPHSPSIARDTLILPPIN

SEQ ID NO: 923917 - protein, 143 aa, Homo sapiens
MQVIKNLLTKQVAFSEGVGCSPIGVSSIDLHSTLLSLWMQPRGARTCQWFILQMLRLCSGCGGGSKGLSDCRTALRWSRLHSWAVKIALCTCSYGVAWQGPEEGLAGKGTCRTNVSQSCGEVDPAISPVFSWDLSLSERNRQP

SEQ ID NO: 923918 - protein, 153 aa, Homo sapiens
MDNEIQGEVVSDGDEGLVDNWSKSDSCCVLAKRLVAFCPGARDLWNFKLEGDDLGYLAEEISKQQSIQEETWVPLRTFSFKRVTEHKSSKNLQPDNVIENGSVEGKCWVEAPTRVPTVALPSGAVRKGPPSSRPQNARSTTSLHCVPGKAADT

SEQ ID NO: 923919 - protein, 151 aa, Homo sapiens
MNQVPQLGMQKSPFDLRKSIYAIHHINRIKIKNHMIISIDAEKASHKIQHHFMLKTLSKVGIQGTYLNVIKAIYDKPTINIILNGEKLTAFPLRTGTRQGCPLSPLLFNIVLWVMGLYREAALQYLNLHPKLILAGSSSTLIWKIPGSYKI

SEQ ID NO: 923920 - protein, 171 aa, Homo sapiens
MTFQGSWPPHPNILIMQMQSLLGWSHVARSLLYVWLAKRREDGAAILDMASSRDEADLIVVDKLFDMLLDSVCQYFIEDFHIDLPCIGLEHAPLARRRELEHCSGRSTALFSAGRRECLNLLKLCPPPPLPPGALSQGNGSFIYKPLSGAAAFLSEMPCPERRNPERRFRV

SEQ ID NO: 923921 - protein, 139 aa, Homo sapiens
MLPDHSSSPAMEQSWIENDFDKLTEVGFRKSIITNFSELKEDVRTHCKEAKNLEKRLDECLTRINSVEKTLNDLMELKTMARELCDACTSFNSRFDQVEERVSVIEDQINEIKKRSLEKKEKCKEHHQDTPREKQPQDI

SEQ ID NO: 923922 - protein, 139 aa, Homo sapiens
MCSLNTSCSHPGAQRGVSTPAVKSKERGQRSGGMGERYPSLQEVEARLEVAPNSMDSGGRKCGKKGSKLVAAKFDAGPAPSGHITRSTPHSPFNTLRRDKEKAVPGKAVITFIDEPRASIHGTLRIYLFYFSNRFPNIE

SEQ ID NO: 923923 - protein, 162 aa, Homo sapiens
MRNPRTQRYAKPGNGNAKTIPKQGQDLGTECAQMHGEELTQFSRAKRNPRKAMGIFHRHLPQEINHMKCEEVMIQDTGNLQGTWKEEFNRAGELEAIKTKRLEYGKWRGSLSSPRSQQASGDSVTSIPSCCRTVRLNPLAFRGHRGSSERAFDLTCKGIPTG

SEQ ID NO: 923924 - protein, 147 aa, Homo sapiens
MLNKSGNPCLVSVLRGKTKSFIFSPVHGDRGHQVGQLSVLGGVHARNGSSAGCESGTASGPGSVPAGFPALGEASLLCCTACSLRYRALCGLRCWGYSCTTGSSCGCGIAAYCMSVMGRGKCSREVEMQRLLGPREGCTVAVTLFSK

SEQ ID NO: 923925 - protein, 152 aa, Homo sapiens
MELTGIAEVVPSAAAVVVTTSDVTPVVMKVTVEQEATLNKSSQCQFMSSKLASPHKVFQWTPSMMSDEAPSPGSFGSSLMPFSRVFITGRSSVWLQTPYSQGLLTANPGLFPGLSQLSVRSGDPELICTDDSGKQANSCRGLYLSVGMFPLF

SEQ ID NO: 923926 - protein, 134 aa, Homo sapiens
MPSLLYMVHFDGRVELNFMIHYFTRKNEEAGRARAERAAGKAAEKSSEMQEMVVGAMDKADESSCVPDTLDIDGSLGEPMWRVRKGAKTNRWSMKLRGWSLNRGEIKELCPCLLKHLQFIAMKGKQQRRLKRNS

SEQ ID NO: 923927 - protein, 148 aa, Homo sapiens
MVLSLRQNVSLGLHSRSQQDHEPTGRGKHLLKSCNTHREVRGFILEVGEAKKKLRTHLKKPSPDTMGSKKSVTIFKLESSERSTCSKPDCKAVNAEKKGRASKLLRAESPESSSLLEVRPENRKEMTELSMPSSFSQLLRQILGQFVT

SEQ ID NO: 923928 - protein, 137 aa, Homo sapiens
MHFYFMTFFSLGGINFTLAWDNKPWKFNRIYFRNTVLNVYRGRDMVPTTRHILLDLLLLKTNNKLILQSVFEGFFLLNERLLCTPLMQVKATTMGQCWISEKCDVGVYGNAGNNHDSSSKTDLLCGVEEKSGLESET

SEQ ID NO: 923929 - protein, 143 aa, Homo sapiens
MFRQPLLMSLLIAHQSADIVGCNEQQGRRDHQGNDGCRRAPGVSTLKAELAKYECGPCPEGWRTRQVPKQSCVNSHDLGGFSLHVASHESTGACLWNPGKLPPVNTAFTQAQLYCASRTVVSNQPEIPGPLPGAAFTQQVYEG

SEQ ID NO: 923930 - protein, 140 aa, Homo sapiens
MGGPRRVTTNSHSRQRKWQHSPQPSGAPWPEGEALLGTLPPSAQDSIFLLLPFMVLGLGSNPAPRSEWVWGVERGQAVRADTPEPAGTGAAGAAAAATPGRADPTCSQLSQEYREARIHCCILGGCSPAQEGGASACSVE

SEQ ID NO: 923931 - protein, 150 aa, Homo sapiens
MRFERGQISKLCQLVMFQSLCVELNAVCKAGWEVVEEKMVIIRDKSAPTFFPTLDPEKVESLSLEISRDSLIMLRIKFHLVHAEKLGIIEESRAIRHETLGRLSSLKSLASLNITVPLACLFHFPEDCGFCGSKPAGPVKASRRGERTRE

SEQ ID NO: 923932 - protein, 208 aa, Homo sapiens
MSKKLPEASQEEKQMPVASFYSLQICFGFLHSSILDGEFSQAPGRSRDAVWEPGIAVKTLQEVYLVSYSTVTRLAPKPQDKILHTLPSPFHKQRGLSLWPLPPLTHGEFCQTTTSVHLRPKGSSVSCDKCCQAWNSPLRVVKSPLAQCRSRNAIQEPGPGDPKSPLVLYTMAKLIPEAGMSESHSRSTAYCLCIAVGYSGPMGSLVSR

SEQ ID NO: 923933 - protein, 140 aa, Homo sapiens
MECNGMEWIQLERNQMERNGMEWNGMEWNGMEWNGVEWNGINGMEWNGMDRNGMERNGMEWNGREWNGINPSGKEWNGKEWNGMEKNGMQWNAMVWNGVNPSGMECNGIDCNGMEWNGMEWNGMEWNGIKTGGNEWNGME

SEQ ID NO: 923934 - protein, 231 aa, Homo sapiens
MEWNETTWNGMEWSEINPSGMQWNGMECNGMEWNGMEWNGIKPSRMERNAMEWKGMQWNGMEWNGINRIGMEWNGMDWNKHEWNGMEWNGMEWNRMESTRVERNGMERNGIERKGMECNGMQWYGMESTRVEGNGMEWNKMEWNGMQRNGVEWNKHQWNGMQWNAVEWNKHQWNGMEWKGMEWNGMDRNGMKWNGMEWNGMEWTGMEWNGMKWNGMQWNGMEWNGQECNVM

SEQ ID NO: 923935 - protein, 226 aa, Homo sapiens
MDWNRVEWKGTAWNAMESIRMEWNGMEWTGMEWKGMEWNGMEWNGMESTRLDWNGMQWNGMESTRKETNGTEWNGMEWNRIEWNQLEWKGKERNGMEWKGKAWNAMEFNGMEWSQPEWNVLEWNGIKWNGMEFNGMEWNGINTSGMECNLMDWNGMEWNGMDRNGMEWKEINLIGMEWKAMEWNGINWKGMKWNGMEWNGMEWNGMEWNGINSSGMQWNEMEWNGM

SEQ ID NO: 923936 - protein, 142 aa, Homo sapiens
MGKKQNRKTGNSKKQSASPPPKECSSSTATEQSWMENDFDELREEGFRRSNYSELPQSSKASQHSDSGNTENATKILLEDSNSKTHNSKLSFISEGEIKYFTDKQMLSDFVTTRPALKELLKEALNMERQNRYQPLQKHAKL

SEQ ID NO: 923937 - protein, 1716 aa, Homo sapiens
MERMECNGMGWSQPEWNGMELNGMKWNGMECNGMERNGINTSGMEWNAMECNGMEWSQPEWNGMEWNGMKWNGMAWNGLEWNGINTSGMEWNGMEWKGMEENGMESTRVERNGMERNGMEWKGMEYNGMQWYGMESTRVEWNAMESNAMEWNGTEWNKHQWNGMEWNGINPSAMEWKGMEWNEMNTSGMEWNGMEWNGREWNGINPSGKEWNGKEWNGIEWNGQEWNGMEWNGMKWNEHEWNGMEWNGMEWKWNGMEWKGMEWNGMESTRAECNGMEWNRMEWNGINPSGMDWNGVEWNGMAWNAMESTRMEWNGMDWNGIERYQPEWNGMNGMDWYGMDSNGMEWNGMEWNGMEWNGLEWNGINSSGKQWNGKEWNGMEWNGLEWNGMEWNGIEWNGLERNGMEGNQPDWNGIESNGREWNQLERNEMEWNGMEWNGMELTRGEWNGMEWNGMEWNGMEWNGINPSGMQWNGMEWNGINPRLECNGMDWNQPDYNPTEWNGMEWNVKEWNGMERNGKNWNGMEFNGMEWNQPEWSGMEWKGNEWNGMEWNGTERNGIGMEWNGMEWNRVEWNQLEWKGMEWKGMEWKGKEWNAMECNGMEWSQPEWNGMEWNRMKWNGMECNGMQWYGMESTRVECNEWNGMEWNGMEWNEQEWNGMEWNGVEWTRMEWNGMNSTRLELNGMQWNGMEWNQLERNQMERNGMESYGMEWNGMEWNGMEWNGREWNGINPSGMEWNGMDYNGMEWNHTGWNGIELKGVEWNGMEFNVMETNRNVMDWNEINPIGMEWNAMECNGINWKGIKSNGMEWNGMEWNGMESTPVEWNGMEWIIMEWNGINPGGMEWNGMDYNGMEWNQSGWNGMEWNGMEFNVMETNRVECNGRERTGMKWNGLESTLFQCNGMQWNGMEWKGMEWNGMQRNGMNWNEMEWNGIMQWNGVESTRVEWNGMDCNDMEWNGIEWNQTEWNGMEWNGNEWNGINPSGMDWNGMEWNQPEWNGMEWNGINPSAMEWNGKEWNGMEWNRMEWNQSEWKRMKWKGMEWNGKNGMQWYGMESTRVEWNGIEWNEMEWNGMQWNGVEWNKHQWNGMECNGMEWYGMESTRVEWNGMEWNEMEWNGMEWIGVEWNKHQWNGMEWNGMERNGREWNGINPSGKEWNGKEWNGMERNGIQWNAMNAMEWNGTEWNKHQWNGMKWNGINPSAMEWKGMEWNEMNTSGMEWNGMEWNGMEENGMESTRWNGTEGNGMERNGKQWIGMNRMEWNGMERNGMEWNGINSSGMKCNGMEWNGMEWNGMEWNGINRSRMEWNGMERNGMEWNGMEWNQPEWNGMEWNGMEWNGIEWNQFECNCNGMEWNGMNGMEWNGMETTGMEWKGNNPSGMEGNGMEWNGMELNGMEWNGMEWKEPDSNGMEGNGVKWNGREWSEMEWTEWNGMEWNAMERNGMECNGMESTRVEWNGREWNGKEWKAMDWNEPNGMEWNGNESNGMESTRSGMEWNGMEWNELEWNGMEWNGMEWNRMESTRVERNGMERNGIEWKGMECNGMQWYGMESTRVEGNGMEWNKMEWNGMQRNGVEWNKHQWNGMQWNAVEWNKHQWNGMEWKGMEWNGMEWNGMDRNGMKWNGMEWNGMEWTGMEWNGMKWNGMQWNGMEWNGQECNNGMEWNEINTIEMEWNAMEWNGINRKGMKCNGMVWNGMEWNGINPSGMERKGMEWKGMESNGLESTE

SEQ ID NO: 923938 - protein, 136 aa, Homo sapiens
MPRASQVIGVICKEARTEVAVNPYGFAAGNSDTFHWDSWNQVTCGQDSFPSCLHPRVDFTISDSFPPEYGVWDTQRQQFSSLHYSSFITFHGCNLKNWEKSSSRLSSCEVSFFGPITSYSIVKLQELGFSGPSQCA

SEQ ID NO: 923939 - protein, 243 aa, Homo sapiens
MVSTRISGRLRRLLSTPGVPWDHHRKQKSWNWFQANRPTNAPKPEGSGVVTEPFSGQPDTCVFSPVAVLIAFKWPTDEKDEPIEIPSEDDGTVLLSMVTAQFPGVCGLRYRNPVSQCMRGVRLVEGILHAPDAGWEIWYELRQFFCQYGEVVDVVILKPFRTFAFVTFADDQVAQSFCGEDLIIKGISIHISNAEPKHNSNRQKEVEDLVVIQVALGIRVNVVIVEGVELFWETIKVVIWVVG

SEQ ID NO: 923940 - protein, 170 aa, Homo sapiens
MINLSSIVNDTFPALYLYSLSVLHLLPSEGFCISKNHTAPPGPANQELTQPVLFGYNSSLGKRDSRCKGQTTRKLRWHLTERFCVLGHLPNPPVKVIGGERKRGVKWEEGMKTLLCKSELVPLAKGKGCSVLGPLQCLPASSPYRVRHPFLFETNLEEKKMHYSELQAVI

SEQ ID NO: 923941 - protein, 165 aa, Homo sapiens
MKTMGMKTFKIHFNATNKESAGPVVQRLLYAGLLWWCPSNKAGSQTGKMSTLSAASRTQCAAQGSTEGRHQVPTDHLWIRRLGLPKQLLGVVKPITLSGDLAELMKTTEKSVEVTKASLENENYRYFDILLFYKVISTSNSSTSYSTFKTDFKSVDFVAANTAQS

SEQ ID NO: 923942 - protein, 179 aa, Homo sapiens
MGKSPGSTSGFYSYLMAGGGGLLITAGWGWEFQLFTRSPTLPSQLGGIRVPHYCSPHGVYVPLLLGESGPSSGGLLEFSGGPLQTLFAWVSAVVAAEQWILVNRKCCCLIIPLEVSYQRSTRPFEVSVHPYCFFAGGERLDQGQASTPTPPQDAQCIVSKAKNEIDVLFHKMPFLFFTP

SEQ ID NO: 923943 - protein, 175 aa, Homo sapiens
MGATIQDEIWVDSANWLHFQKILECQCSAHNSWTECSNYGGLVTGSDFVLWLPEVRNTLYCWCQGPLLATVHPVLLLVVLVQSWGAGGFRSVCAFCVPQIPPHQTLWAPYQLACCPYHFSKQLSLPSQVSMVIERSPPAVVPEACGKSGRASHKDRGHEQRSVTGEKTCFGLHEF

SEQ ID NO: 923944 - protein, 184 aa, Homo sapiens
MTADSGPSKSIRGTQVMAPPGPILEITLVGKIPQSPGEEYKEAVKQPFGGEICVTKRELSANRQDNGTKALKAFQKHFRLPFPSQEGSEENRKMWESLELPRDLLNGFNQNTDNDMDNEIQAEVASDGDEELVGNWSKDDSCYVLVKRLVAFCPCPRDLRKFELERDHLGYLAEDISKQHKFKR

SEQ ID NO: 923945 - protein, 213 aa, Homo sapiens
MGFAAGVPGHFRYNTDVRLCLARRESELKPKKLDSVVLAFVQIFCALKAAEIGINKKKPSDNIKDNGQKALKPLQRPSQQPLPHSPRGQGGKNGFMGWTKGPATLCNLRKVLLHPGCSSSSHDSKGPRLQNGRFTGSLHLSPGKAPGIQRQPMRAAVATVPCKATGAKLPKVIGTHCLPKCALNKGPLTRKQIKEEERDAEKMEDVMGVYKAY

SEQ ID NO: 923946 - protein, 144 aa, Homo sapiens
MAWINIFLVNPEGTVLKRPLTQGNRLQHQLADFGKVVGYPSKEWDWEQLQPPSHGSGPRHLCVLGDPGSPCPLRLKSACSHSLASPSSWHPLWGKAKLWLSLATVVIQLGVCALRMVLTCQPPAALVFSRLWILTNTGGRLRRG

SEQ ID NO: 923947 - protein, 313 aa, Homo sapiens
MNNKVQAEMVSDRDEELVGNWSKGDSCYALAKRLVVFCPCPRDLWNFELQRDDLGYLVEEISKEQSIQEVTWVLLIKVFSFIKEAEHKSLDNLKPDNVIEKKSPFSGEKFKPAPEICISSKKPNVNPQDHEETVSRPYQRPSLQPLPSQAWRPWRKKWFHGQGPGSPCCVQPRNLVPCIPAAPAMAERGQCTAQAVASEDGSPKPWQLPYGVEPVGAQNSRIEVWEPPPRLQRVFGNSWMPRQKFAAGMGPSWQTSARAVQKGNVGVPTRAPPQHHLVELWAVGHGPPDPRMVDPPTACAVQLEKPQTLNASA

SEQ ID NO: 923948 - protein, 142 aa, Homo sapiens [sequence omitted]

SEQ ID NO: 923949 - protein, 143 aa, Homo sapiens
MVGAEGPSHPSDRATACPRRPQRRSRESWESLVSLPEGRKWGFVRGMVQQPPHLLLRVAGEVWSGSPGPGGAPHTCVLKDPHQDNGHRRAPAAALASSETGREPSQIARFLPPPACPHREGCMQVSSKQGGFGGAGGCFERHP

SEQ ID NO: 923950 - protein, 133 aa, Homo sapiens
MNNFPGPKIVHLLLFHRWAENVATNKPGVGGGISNRDKCVIEMEDSWREENRNRQDVHGQQEVAVIPAKHVFSFVKRGLERTRTPDVIKSHPLTSVGIPCAYFWVLWRNGRFNIRDKFGTSCHISQQRNCQRR

SEQ ID NO: 923951 - protein, 1407 aa, Homo sapiens
MEWNGLKWIRNEKNVMESNGMELNVLESSRTELNGMASNGMETKGMELNGLKCYGIKGNGLKENGLKRNGLEWNLFEYNLIEWNAIVWNGMESNRSERNRMQWNRIDSNVMDSYVIDSNGMESNGMQSNGMECNAMEWNRMECSGREWSGMKWNGMEWNGIERNGMESNGMDWNGMDSNGIEWNNMECGMESNGMESNGVKWNGMDAKGMDWNKMKSNEWKAMEWNALDSSAMESIGMESNGMIWHGMDSNGMDWNKMQWNRDSNGMQWNGNGMDLNGIESNGMESNGMNGMQWNGIEWNAMECNGVEMSGMESNGMESNGMDWNGMDSNGMDGMEWNGMELKGMEWNRMEWTGMEWIRMESNGTIWNGTEWNGMEWNGMEWNGTEWNGTERNGTEWNGMERNGMEWNGMDSNGMKPSGMESNGMELNGNEKSNGMASNGMDSNGMCSNGMESNGLISNGMEWKGMEWKGIVPNVIDLNGMESYRMDSKAIELNRTECNEMERCGIEWNGIEWSEMEWNGRERNGLEQNNGMDRYGKTSNGMELTRMEWTGREWTRMEWTGMEWIERNGLERNGLEWKGNEWNGMEWNGLKWIRNEKNHGMESNGMESNGLERNRMERNRIDSNVMDCYVIDSNGMESNGMQSKGMECNAMEWNRMKCSGREWSGIKWNGMEWNGIERNGMESNGMDWNGWIQMESNGTIWNDIEWNGMERNGMEWNGMERNGMEWNGMEGNGMEQNGMELKGMERNGMEWNGMEWNGMDSNGMKPSGMESNGMELNGNESNRMEWSGMECSGHKWNGLEWNGHEWNGLEMECNEMERSGIEWNGIEWNGIEWSEMEWNGRERNGLEQNEIERIECNGIEWNGMESNRMDLNGIEWNGMAPNGMEWNGMEWKGMECSQIYWTQMEWSQIEWTRKEWSRLEFIRKQWNRMECNNGIQWNVQEWNGNKGNGIEWNRPELNGLEQKYGMESNGMESNGLERNRMEQNRIDSNGMVPNGMEWNRMEWNGMEQNGMELKGMERNGMEWNGMEWNGMDSNGMKPSGMESNGMELNGNEKSNGMASNGMDSNGMCSNGMESNGLISNGMEWKGMEWKGIVPNVKDLNGMESYRMDSKNGMDRYGKTSNGMELTRMEWTGREWTRMEWTGMEWIERNGLERNGLEWKGNEWNGMEWNGLKWIRNEKNHGMESNGMESNGLERNRMERNRIDSNVMDCYVTDSNGMESNGMQSKGMECNAMEWNRMKCSGREWSGIKWNGMEWNGIERNGMESNGMDWNGWIQMESNGTIWNVTEWNGMEWNGTEWNGMERNGMEQNGMEMKGMEWNGMEWNGLEWNGHEWNGLDGMESNGMESNGVKWNGMDAKGMDWNKMKSNEWNGLEWNGLNGMHWRGMDSNGKDWSGLYSNGMETNGMEWK

SEQ ID NO: 923952 - protein, 142 aa, Homo sapiens
MQKVPPSLSPLFFHCTSFPHHIPLPRKKNSNVQGTAGAQTVAILASSRRLLCPLARIPEHGLDSSVGPLVLPDSHTEKEQQEYTDKYSTYKVGPGLNSQLSDGINLCFDPVSWKHYFCRIYDGTLQIPLRTVVKKLISHDKN

SEQ ID NO: 923953 - protein, 134 aa, Homo sapiens
MAVGAQDQAVGSSSIQGPQRGPSKWNTQRRHGKRPRREARRNAVPFIRGCSIQGTILGAETRPLPDTKPASTLILDFPAPRTIRNKFLFFKIIQSLLFCYSSTKETTTKKKGKKSWVGEVLKFGSVAGQAALRR

SEQ ID NO: 923954 - protein, 195 aa, Homo sapiens
MTIPLASTPGAAFHMTVPLASTAGAVSTLPYRQPPLLEHFLHYPTASLHTWSSFYSTLPPASTPGAVSTLPYRQPPHLEQFLLYPTASLHTWSSFYSTLPPASTPGAVSTLPYCQPPHLEQFPLYPTTSLHTWSSFYTPLLPASTPGAVSTLPYCQPPHLEQFPLYPTASLHTWSTFYTTLRPASTPLTYLTICL

SEQ ID NO: 923955 - protein, 167 aa, Homo sapiens
MERSAGGLALLGDPVHPPQPLAWVLSPSLLGASRSGWLLRVRGPPSPRPPGTPAGPQAPPAAPVPARASPSTPPCKLKEWAPALARKWLPQCSGGLKGSSNAAKVGAQAGEVPRASEGSEDCQHAVTSHYENALKCNRRRCEDTKNKCVVTHGYQNTLKNPHCFPSI

SEQ ID NO: 923956 - protein, 137 aa, Homo sapiens
MLTDSFPGNCVPIPILNIVNTPADTGHWRSRPPFALVKGNFPEREGFSHRFQDIYPPPAPCLPMPTVVGASDNQNAPTRFQILPKKVRALPLWLTQSQIKGFTGCLRAYVTWNLITLRSQLQQRLENLVLSFPASSC

SEQ ID NO: 923957 - protein, 160 aa, Homo sapiens
MFGECAKEWTGLSLPPVQPAFIPLSGPTHILLIGPFYRELIGPFYRELIGSELFPRRKAAETGENLRAARAGGSAGGPGTPFTAAGPGAKALTARRSAALRAGPAEPVPTRNFRWPASAMDSPSSCLCLFLHTSRKQGEPAPALASPERGSHSAFLWVPP

SEQ ID NO: 923958 - protein, 169 aa, Homo sapiens
MKSGFYMTTGDDQLSGWTEKFQSPSHSQICTKKKVMFTFWWSAAGLIYHNCLNPGETIIPEKYAQQIIGTGQHKGPGSSPQQCLTTCCTTNASKVERIGLQSFAFSAIFTLPPSNQLPLLQACRQLFAGKILPQPAGCRKCFPRVCRIPKHIFLCYRNKQTNFLLAKMC

SEQ ID NO: 923959 - protein, 135 aa, Homo sapiens
MVQQVKESAGMDWESERHPMLKATQGSKYSQTQSVHSVSSVNHQDSVLGIMLSGGLRGEILHKPFMFPCPCNQARFVKPIRPVQDPWKWRLTDFLQQLNGVNHPTSFCSATTAHSIFILCNSSQLKDHTQLTQLK

SEQ ID NO: 923960 - protein, 175 aa, Homo sapiens
MERKSPTAFWYSLARKASSPSSKRWAIGFPQQQPGHWGGGGTGSVLIPAGLRPCGPGAKARSRGDELLLGTGRRERRHSLRLQNQKNGFKNLFFFFNYTLSFRVHVHIVQVSYICIHVPCGCAAPTNSSSSIRYISQCYPSPLPPPHHIPQSVIFPFLCPCDLIVQFPPMSENMR

SEQ ID NO: 923961 - protein, 190 aa, Homo sapiens
MPSAQSPWLHSSQCPRPRTLGAGKGRACSSHLHRVRAAALEATPDHAPTPARRIPGPDAAQRLIQVVRPQLQEGGNRPLSHFLGAALYPVPAHPALGSGKKELTLGCSGNLHKARSSSCGKLRPCQCHQQCGPLGQKPPQRLSQGVGPQLQEGRNWHSAPPQRLHGAQSQGPALLAQVVEGPGATQAGGQ

SEQ ID NO: 923962 - protein, 150 aa, Homo sapiens
MSGFHFSLVPTSSISLGSLHVALGLQVHRNQELRYENLHIDFREFVEMSGCPGRGVLQGQSPHGKLLLAQSGRELWSQAPSGALPGGAVRRGPPSSRLQNGRSTDNMHHAPGKAADTQCQLMKAARKGAVPCKDTEAELPKVMGAYLLHQ

SEQ ID NO: 923963 - protein, 1676 aa, Homo sapiens
MRHFWVTLLKTDTESIEEKNSSQDKHSDPRSSVPESYVRDKNSEPSSSVLEFCVSDKHSELRSSVLEFYVRDKHSKPRSSVLESNVRYKHSEPSSSVLESYVREKQSELSSRSSVLEPYVRDKHSEPSSSVLESYVMDKHPEPIHCLLESYLRDKHSDTRRSVLESYVRDKHSATRRSALKSFVRDKQTESSSRVPESFLREKHSDPLSSVLESYVRDIQTLIAVFWKPMDKHSEMSYSVLEFYVRNKPSVPSGSVLESYVRDKHSEQSSSVLESSVKDKHSDPSSSVLIPYVRDKHSEPSHCALKSYLKDKHSEPRRIVLESYVRDKHSETYSSVLESFVMDKQTEPSSSVLESYLTDKHSELRSSVLESFVRDKHSEPSSSVLELYVRDKHSEPSSCVLESYCSGILCEGQTLRSSSSVLKSFVMDKNSDRRSRFLESKVRDKHSEPSSSVLESYVRDKHSEPSSSVLEYSVREKHSDPRSNVLESYMRGKHSEPSNSVLESFVREKLSDPRSSVLESYVRDKHSEPSSSVLESCVSVKHSEPSSIVLESCLSDKHSELRTCVLECYVRDKHRTEQQCSGILCEGETLGTQQQCSGILWTNIQTLSSVLESYVREKHSDRRSIVVEFYIWDKHSEPSSSALESYVREKHPEPSRIVLECYVWDKHSEPSSSALESYVREKHPEPSRIVLECYVWDKHSEPSSREPSSSVLESFEREKHSDPWSSVLESYVMDKHSEPSSNILDSFVMDKHSDPSSSVLQSYVGDKHSEPSSCVLESHVRDKLSEPSSSVLSVLESYVREKLSETCSSALESLVRDKQTQLSSSVLESFERQKYSDPRSSVLESYVRDKHSEPSSSILESYVGDKHNPATDSSVLESYVWDKHSEPSSNVLESFVRVKHSDSQSSVLESYVRDKHSDPHSTILECSVRNKYSDPHSSVLESYVRDKHSDNHSSVPETNVRAKHSEPSSSVLEYLVRDEHSDNLSSVLESKVMEKHSETSCSVLEFYVRDKHSEPSSSVLESLVNDKRSDPRSSVLDWFVRYKHSDPQSSVVESYLRDKHSSHSHCVLESYLKDKHSEPLRSVLESYVRDKHSETSSSALESFVRDKQTEPSSCVLESDLMDKHSEPSSSVLESFVRDKHSEPSSSVLESYVKDKHSEPSSSVLQSFVRVKHSDAQNNPDSPVLQCSVRVKHSEPRSSVLKYYVRYKASELSSSVLESYVSDKHSETSSNVLESFVRDKHLDSQSSVLLSYVRDTQIQQHCSRIFCDGQTLRDKQTETSSSVLEAFVREEHSDPRSSVLESYVRDNHSEASSTVLESYVKDKYSEPRINGFLKSRSSTLESYMRYKHEKPSSSVLESYVRDKHSEPSNSDLESYMRDKHSDPRSSVLESFVRDKQSGPSSFVLESYGIDEHSEPSISVLESFVRDKQSGHSSSVLESYVRDKRSDPRISVLESYGRDLQTEPSDSVLQSFVREKHSDPQPSSSVLESFGRDKHSDPLSSVLESYVRDKHSEPSSSVLESYLKENIRNLLEVFWNPMSSVLESYVKDQQSEPSSSVLESYVRDKNSDTRSSDTECFLKEKHADPHSSVLKSYVRDKHSEASSSVLESFVDNPSDPSSSFLETYVRNKHSEPSSSVLESNVRDKHSETSSSVLESYVRDKHSEPSRIFLKSFVRDKLS

SEQ ID NO: 923964 - protein, 376 aa, Homo sapiens
MQPDLVTCLEQRKKPWSMKHPGLTIPERIHTKERPYKCEECDKAFKQSSRLNKHKKIYTGDTTYKFEESGKAFYYSSGLTQHNIVHTGDKPYKCKDCGKIFKWSSKLTIHQRIHSGEKPYKCEECGKAFKQSSKLNEHMKAHTGEKFYKCEECGKAFKQPSGLTLHKRIHTGENPYKFEECGKAFYWFLSFTKHMIIHRGEKPYKCQECGKAFKWSSNLTIHKRIHTGEKPCKCEECGKACKQSLGLTIQKRIHTEEKPYKCEECEKHYKCQECGKAFKKSLDLNVHKIIHSGEKPYRYEECGKFILKRLYKCEECGKAFKWSSELTIHQRIRTEEKPYKCEECVRVFKHSSKLNEHKRNHTGEKPYKCEACGKAF

SEQ ID NO: 923965 - protein, 164 aa, Homo sapiens
MAVEETPRVSRRPGPLRIVTGALTPRQVSPPGRASADDPLGTSSSPSCGAGSALPGPNFTGLCRGPGVPDFTGLCSGPGVPDFTGLCRGPGALVASDSHGLFMATPALGKLHHEGRSWRPKVNLSELSANDLRQVVLRSVPLPDLSAEMKQVPGQGVSWRTRHT

SEQ ID NO: 923966 - protein, 221 aa, Homo sapiens
MRFEHPNINGLPAAGNRRRVGHRAGRGWVQSRNPVGQSPGPRGSYALETLNGGLLSRLDVVLPVRKLCHTCMSCGWKRWTRALRQSLSAVLQRCARAVRLWVETLDQSAQAEPLHGAALRPQALGYGPRHAGRTIVSSHCVTPEEMLDQEPMEGAAQDFLLYHERHTVPHRAAVRPMGANVCEDAGAVLGSQQVLGKRAIAADFLRDENDGCKTTATKHTS

SEQ ID NO: 923967 - protein, 141 aa, Homo sapiens
MPQLVDASPQSLPAPSKGRFCTLKTLRSLELAEKLSITDRPNHLLSGTDQNPVMIAWRVDAGDRHRPCWSQRSRLHAVSPRMTQTSPSHLRQGPGTPPSRSYGAYHPWCLRLCLSCVEPGVACMGVWVLLPEAVLVTSNPC

SEQ ID NO: 923968 - protein, 144 aa, Homo sapiens
MEAVGLMASVETTQGPLRSGYLDLRKEPSVWGGWSQSLGIHWLRFPPHFDGNFNGGSHHPFGQHGTCPAPPSTASTTHGGIRLPFTNPTLSTRYPRTCGPYSPLGPSVPRAHNARETFGGGGASPYWLKEKERDNGPLPRLLRV

SEQ ID NO: 923969 - protein, 169 aa, Homo sapiens
MLVFGVEDRPYSCLGSHIFLMTCESPWIPDLGCAVPDVSSPTMRALGTVAALSALGASTVYTVGAQSMPMKWTQVTASNTATQNGTGDLKCCLCLVASVRGVITKEMERGSVLDPRKSCEHNSLTSWELWEVQVSEPCLIWRYKRERLLGPRGVDGLMGEKRKWGEFEK

SEQ ID NO: 923970 - protein, 164 aa, Homo sapiens
MAPLLLQDLANHSKGLAYPSGNPAPPTAAVLARADHDKGWHIPVATRAPPLLPSLPGLITTRVGTSQRQPGAPPPRPTAAVLARANHDKRLAYPSGNPGPPTAAVPAWANHSKGLMSLECTLMFMLIYLSKWSAIVIIGFLSWWTWTPWKPELPGASLGQHCFA

SEQ ID NO: 923971 - protein, 217 aa, Homo sapiens
MSKRSSRTLSAGCVCAQKPPVGPDSGQHPLPPGEGLLAQGGLGMGAGVWGNSWLHDASQFSGNVDGRAFLTPAAAGTSVHWIKKTRNPRKISTRCSQSTPAFKEEASSGVSGTDSRHLQQHRTCGQRDSQLRHTPAAIGLLCGDSSTCREKTEGSESQKEGSESRGKRQRKKSLKAWCTRRLCVPACGGFRSRILLMPSSCVCMSYPHGLSFGAQVH

SEQ ID NO: 923972 - protein, 124 aa, Homo sapiens
MVLFDGSLRSPLLLVVHLGPTSTKTILIKNKFGVQEPNLHICAFHNCEEEGYDYCRIRYFKNESLTLTLPSKVGKSLKWIMMEGGKREWTLVVMRMGAWLTKNPSCCTLEFISHICTEDKFLTD

SEQ ID NO: 923973 - protein, 159 aa, Homo sapiens
MIGDARNPQRAPKRVSQSWLGEPLGLGSPKGHSSSLLLVACNVVNGGYIVALFVLQLFQSCIWWVLTSCPTFGKNEVCRQLEGVPGKRTIQLAKWSSMKFSLLAADFTWNWQPSPQPSGRPWPEGGVSLGTHHFPPRSLSAFYMPSIDPRLSVLRGTHG

SEQ ID NO: 923974 - protein, 143 aa, Homo sapiens
MVKSTGNLKDVPGGGSTEEWQCENGLIQGLLDAGSKLTLIFNDLKSNIGHESERQLVQRRLLAAHYVLLEKEALTVPELVSLPTLLFCVPRVMEAMTHTFCMAAKASLIPDGPNLYLPVYPFYGKWLASPQFSILSDSMVLKE

SEQ ID NO: 923975 - protein, 348 aa, Homo sapiens
MNPREGTKKFRCAAFKSLEKKNPFSEEKFMAAAEICMSNKEPNVNSQDNGKMYPGHFRDLHGSPSHHRPRRIGGKNDFEDEGVWNFLETLNGFDQNAENDVDDKVLVEVVTDGDEKLLGNWSKGHSCYALTNSLVAFCPCPRDLWNFELERNGSRSSVYPPDLVPCIPAVSAPAMAKMGQGTAQAVASEGANPKPWWLPCGVGPVDVQKSRIERMYGNAPMSRPKSAARAEPSWRASARAVQKGNVGLETPHSVPSGALPSEIVRRGPLSSIPQNNRSINSLNGSSGKATGTHGQPMKELPTALGAHPLHQCALHVRHGVKGDNFEALRFNDCSTGFWTCMGPVATLF

SEQ ID NO: 923976 - protein, 138 aa, Homo sapiens
MCIFWQEFLRVKLKGWGVREIFEGWIANTKKALSKKKEEEEEEEEEEEEEEEEEEEEEEEEEEEEEEEERWKALRVDRGKIQKLGEGGGSREPWTGLLCTGTHCWLPIIPGELAKNNLLTPLHSGTLEGGDPLTTRDN

SEQ ID NO: 923977 - protein, 152 aa, Homo sapiens
MLITEKMGTMSPGYVRGLHSSPSYHRPRGLGEKNGFVCQAQGLTPLSSPGDIVPCVPAMAKRGQQLRLLLQRVQAPNLDSLHMVFGQNEKSNLLKANHGLIASPFLLAELNDVTKTLVPLLSDVLCAGLMLNQDTLNAEPFSPSQSFPCRRR

SEQ ID NO: 923978 - protein, 172 aa, Homo sapiens
MSIFFEKDLEFIENSENFSDQILLGNYYTFPSNLSYIKLLEPESEIILLVEWLGVIHLPIMGRFHVFRHSSELLKEFKASISTFLSSGKLALLDTPLIFSVFITSTIQSIYHLTFLKSFLCYRIKCHTSRQILSSYTPIIDLDFHYKLLQKYLPITVIPLYHYSKMTFSLSA

SEQ ID NO: 923979 - protein, 185 aa, Homo sapiens
MITSFPVLYFHVRAYSKRQQHPRGQGAFCILGFLRWCTGKIRSHVGLENECKVSLNDGSSPQQIDGEPEGVWSGKVVFYWSLTPQWPDSPATTPAKFPLASMLFCWLMACWLLPVPVGLLFRSSAPLDIQLPVCSSASVFLSTPGHLCVCHLGSWLINTSRLQMIQLKGHTVTCPLWLGVICLHC

SEQ ID NO: 923980 - protein, 151 aa, Homo sapiens
MGTSPNSQCFSNKLCNIYQDSREDPPAPRYLQRGSGVTETAEPGKQVLRMPGDLLGHVAERALLHQDLSTGRVSSAPNAGGLPEHRAERAPPTRSLQRRAGVTQVVVPGKQVLQMPGDLPGCGAETVWLYQSMSRKGWAAQAAESAILAAD

SEQ ID NO: 923981 - protein, 330 aa, Homo sapiens
MTSVSSTQFNKGPSYRLLADVQNRFLSKYDSQKENWYQLESLSNLLKAMVSYSMNPVDLFETNDLFESGNVRQVQVSLLALARKAKTKGLQSEVDIGEEYSEKQEGNFDDATMKAGQCVIRLQIINKRASQSGTTPPDGYKQVCQPGGHGGSWDPVAHLRHEAGNHKYDNSSTTLKMGYTLGTNQSSQVFSLGRQIYDPKYCLGAQWPTGLPQVQATARGQRRPLNISLTTKRRPATEAPSTLSPHMVSLSGCLGLSHRAVGEGIKAISRCVSGEGPRWRVQAVGLAVLGRRDLGMEGTGPRRFPVASPLPPFVSRSVCGFCTRKSFKKY

SEQ ID NO: 923982 - protein, 676 aa, Homo sapiens
MAARETVKARTKDLRTAVYNAARDGKGAAAPEAAQQPEPGGTGRADWLGGRRGDAAAHRRLLRPPGRGGVPGGPVRRERGGRWLGALRWRDHGGCAAAVGADHLDVVRSLLRRGASVNCTTRTNSTPLRAACFEGLLEVVRYLVGEHQANLEVANRHGHMCLMISCYKGHREIARYLLEQGAQVNWRSAKGNTALHNCAETSSLEILQLLLGCKASMERDSYGMTPLLPASVTGHTNIVEYLIQEQPGQEQLIGVEAQLRLPQEGSSTSQGCAQPQGAPCCIFSPEVLNGESYQSCCPTSREAAMEALELLGSTYVDKKRDLLGALKHWRRAMELRHQGGEYLPKLEPPQLVLAYDYSREVNTTEELEALITDADEMRMQALLIRERILSPSHPDTSYCIRYRGAVYADSGNIECYIRLWKYALDMQQSNLEPLTPMSASSFLSFAELFSYVLQDPAAKGSLGTQIGFADLMGVLTKRVREVEWALQLLREPRDSAQFNKALAIILHLLYLLEKVECTPSQEHLKHQTIYRLLKCAPRGKNGFTPLHMAVDKDTTNVGRYPVGRFPSLHVVKVLFDCGPDRDSRDFDNNTPLHIAAQNKLPAIVNALTEAGAHMDATNAFKKTAYELLEEKLLARGTMQPFNYVTLQCLAAQALDKNKIPYKGFIPEDLEAFIELH

SEQ ID NO: 923983 - protein, 174 aa, Homo sapiens
MNYITQLRGCRKMKGDTHRQFCHESIPNKGDRVIYNLMHPPYCCVWFPLAGMGPHILYVSQLFSNLEFFKRVKGRGEQRKEEVTCGMLRKESQILVNSMGQPTLLYVLLPIALLLIDGVESVSPVIGATDPPIQTFLVQAPIGPYLSLSLFCPSKSLLVFIFSYLSLDCPYGSL

SEQ ID NO: 923984 - protein, 137 aa, Homo sapiens
MVYCHLSSELQLTHTVVDVTCYNPLFGALQFLVSPNFGAPPCSPCPDPGSHSGGNLRYVWSSHSLSQSWCLCQHLELPILLQLACLAVHSGRTLHLLTHMPLTAPRFLQIKSKQSKPNQTKKAYSNAEFGLFLLQSQ

SEQ ID NO: 923985 - protein, 328 aa, Homo sapiens
MLSPALPFLPLLLFSLLLPIYVNTSKGSPEMSDTKPPTASEGWNKFRLKNIKIGEAASANEEVAAPFPEAEEGSEEDRKIWKSLELPRDLEGSEDRRMWESLELPRDFLNAIGQNADNDMENKVQAEVVLDGDEELVGNWSKSHFCYAKRLVAFYPCPRELQNFELERDDLRYLAEEIYNQQRIQEEAEHKHLENLQADNVIEKKTNPIFWGEIQASCTNLHQKKPLDVTDTWTEVRSYQALEVMVMDNSMINEKILECFKEVYFCLEGPYDKFYSIRCEQKFHIASYRYQYECWYYVIQKSLFSSVMATSNVYDSSYDTDVNCEVLQ

SEQ ID NO: 923986 - protein, 152 aa, Homo sapiens
MWVGPDKGIKAGCPNQQWQPCGNFVHSLFAINLAAACSLGPHCLYELGSRHKSLESLQPDDDIEKKNPFSEEKVKLIADICIINKEPNVNHQDNGENVSRTYQRSWWQPLPSQVQRPRMKHGYMGEHAGDHGGWEAELDCSSGQSSGWGLTL

SEQ ID NO: 923987 - protein, 152 aa, Homo sapiens
MCIIQKEIKGENLMPNITEIDVKYTNHSENNIVPHGIEQNKAPDQLQEQTSNPKRTHRPSEKSGLLLQDLGDTPNTVNAPTVEVGKGDPSLRTHTSTGEAEAEAEGLFAGEGKFSNLSRPPPGNRLRAVAGGPVGVRPALQFVWKLGEACDC

SEQ ID NO: 923988 - protein, 204 aa, Homo sapiens
MAYEARQGETVPCDPATPAIAKRGQGTARPTVSEGASPNPWQLPRIVEPAGTQKSRIEVWEPSSRFQKMFGNAWMPRQKFAAGSGPSWRTSARAVQKGTLGLEPPYRVPTRAPPRGALTRRPLSSRPQNGGSTDSLHHAPGKATETQCQPVKTARRGAMLCKSTGAKLPKTMGTYLLHQGDLDVRHGIKRDHFGALEFYCPAGF

SEQ ID NO: 923989 - protein, 139 aa, Homo sapiens
MNLIERAVSSPFLRVHADMEGPLKAMNISRFWYDALADKMNSCDLRRHLNLKAESGSHSKIGEWSHALRASKMLLCSQKGVVKVTQDCLFYNYREEISSLEKSGVVRHEAPWEEVRQLADVKYSAELAAKAQASTAGWS

SEQ ID NO: 923990 - protein, 168 aa, Homo sapiens
MSAPTKVTGTQGCKYGRRKRGCSSLSPSCTPEEFSVKSYLLVTPAIIFDMGLLCPHLNLILNLTPTIHTCCGRNAVGGNSIIGVSFSHAFLMTVLPVLPEPNVTPMIWLETGTRVCRKALNFVHSNVKVFFLRRTYYHQMKRLIGVKGEIKEALQSRPGEQEQHKKMC

SEQ ID NO: 923991 - protein, 140 aa, Homo sapiens
MCERSADLVLEYSGAFQNGYSSAPPDRSMRRFFSDIHCENLATFLEQKQAVFSLIFIGTIGNDARLMYFKTHETTKGHCHQKVYENKVNQRQTEQKCLVEFTSEGIRSQAFTCLETLHYGLHLVTCYWSTQALDFFIVQP

SEQ ID NO: 923992 - protein, 143 aa, Homo sapiens
MAKHMTPDWKNNIDSSLLPVAGQVFHFELSDSFTSFCCYFANNAIMLSCPKKTFTKQHINIGFKKKGPEENAVQQTLCQGSEFGICCFLNWKKPELRVSPASVTQQASARRGAAGYLQRAFSLSFRVQRFLSPPLKMQLVIYL

SEQ ID NO: 923993 - protein, 136 aa, Homo sapiens
MIVKPSQPCGTRSGALLKRYLKMWKRLWNWVTGKGWNRLEGSEDRKMWESLELPRDLLNDFDKNADSDMNNKVQAKVVSDGDEELLGTEAKMTLVMFQQRLVAFCPCPRDLWNFELKRDDLGYLLEEILSRKAFKI

SEQ ID NO: 923994 - protein, 150 aa, Homo sapiens
MQSPSQLGLGILSRPRKSSYGDFCGGLLDPFVPMLSSGPAYLLIFCLDDLSNTVSKVLKSSTMIVLEYAGRRLVPPEFKGNGMADSVNFLFASAPLVLQGYSFIAMLNGLTQIIGTKEWGIVIKIPGNVEEVLQLGNGQRLEESGEKTER

SEQ ID NO: 923995 - protein, 141 aa, Homo sapiens
MRNTGNLSTNKFKIVKGPFYSLRQCEENKIKEGPLNNVGNSEDDDDDDDEDDDAVSAATKDDNNKRREEFQYEDAREIIDNCQSKVYEKDEVCNIQSRTVGSGNTKSIGIAKCKNLLFLILSYGQYLDAEGTLYFPVVSVI

SEQ ID NO: 923996 - protein, 185 aa, Homo sapiens
MNCGNSLKDVNMGVTHLDVFPEWMTQSTKGYSVVSGVSSFWWDRGLTDFRSEATDLHSPIHLIHSCAWRCHSRRLENSKDECLLLLLGPVTLRVTNLIPVLSCIGCLKTPFGSSHPVGRHKEQDPFNRALCPLVELMCFPGGNPTHLSCLDSSELPGGEVKSIGPQTVATPPPRGSGPGRTGLCP

SEQ ID NO: 923997 - protein, 143 aa, Homo sapiens [sequence omitted]

SEQ ID NO: 923998 - protein, 144 aa, Homo sapiens
MTLSFTIFGVFYPNPNGHRCIHWKGGQGTAPCSFPFQLWNMIFLATCTCSIQRLHTAGMNHSHCHCPEPRMALGTHAPRGSKGATPLAAGCSLMRDTWDLMSPCTLEAVLLSQTQFQAQVEALRKKTGSEGSRGGQQQKLKDSR

SEQ ID NO: 923999 - protein, 253 aa, Homo sapiens
MLAKLVGRPVVVLTKCQVNISIFMMWKVTEMFDTSLADGQQVQRKGSDLAWRLLLMDHFVGTGDLQTVTRVTVHCGKGNDQTFRELLDTGFISPVPECIIGTGILSSWQNHHIGPLTGRVRAIMVGKAKWKLLELPLHRRIVNQKQCHSLGEIVEISATIKDLKDTGVVIPTTPPFNFPIWPVQKTHGSWRMTVYYHKLNQMVTPIAAAVPDVVSLFEQINTFPGVWCAAIDLANAFFSIPVHKAHQKQFAFS

SEQ ID NO: 924000 - protein, 147 aa, Homo sapiens
MTKLFYVILSILALLAPLEVLRLVQRLQDMEGYNIFSNLEPNKVKIREGNEYHPEPPRTVIRQCFLECEKQYDVGYEFVMDGSYYFETGDSRRNGLSPQYKSQLQPTLENSLVVPQKAILHVLNIHMWLLTITLNNTGLKPYCTSMR

SEQ ID NO: 924001 - protein, 242 aa, Homo sapiens
MSTGNGSVSTGEVSPGPGHPFGVGIVCGQCHKGLIYHGAAQGCWWPGQLRVGGSEKPVPEGSRASEGIVAKDLRGPGKPLVHTQQEYFASFNPIKLTFNINHHSAHSMMDVVQCNQAATRFVVSLASGVKLQTLMVSVTVHKGGTLELFIPPIGFMVSLASGVKLQTLAVSVTAHKDGVDLKNVDLVDILELVDTTEQLTEYDPMERHAFNLVLDNEEEDSTQCEANEGEGLYDVTLSLNEE

SEQ ID NO: 924002 - protein, 136 aa, Homo sapiens
MAEEEANMFYFGNQGTGETNGLRGGETKKGKTTPARPTYSFPNGKHKHQFHGGIQWEAAKYPEVFVEMELCECAERVCRECAATPRSLHSKRGSSGSPVKFNTFLLTRQTVFHFLTGEVTCIFLGTAEYSSTIDRY

SEQ ID NO: 924003 - protein, 159 aa, Homo sapiens
MIWNDLCERAKKPWQTPGVSPRVQKLKNLELDDEGRKHPAQEKDKGRNSQGLSVLGKRQLSSKAPVAWSFGGQWPEDTTGVQKLGKYSHSNLEKLAKTKGYRPYASPKSSNCQGLGLAPSEATALALCLPLSATAGVTGTQATKFLACKQHGDPDTVHW

SEQ ID NO: 924004 - protein, 155 aa, Homo sapiens
MLAGSRAEGVLLHCDLCTGKVSRHRLLIQLRLLVQASVRSECLDICLDVEWRGPQWIAILREQARACSNDTQRPVPGHQAGPRPVIGESTIPVPTAEAISTVLLWRYQLHCKASAPIFGLRLKCLHSHAAGLPKSDRTLKVRPLKDARSLEVAGA

SEQ ID NO: 924005 - protein, 139 aa, Homo sapiens
MLITKTMKKMSPEHFRCLQGSSSHQRPGGLGGKIGFKCQAQGFASSYSLKTRCPASQPWLKGVKLKFKHSLQRVQPPSFSSFHVVIFALYISPFLYCYEEIPKTKYFTRKNSFDGLTVSHGWGGLTIMAEGEGGAKHKA

SEQ ID NO: 924006 - protein, 174 aa, Homo sapiens
MIRKLSSPQNQSGFTEIPGVPSSRNKFIHKKRSDCFHSSHCHLKPQKHACHSTSLPVQNEQGDIVSHKKAHISCQDLVSKYMKKVDELTHISALAVENKNKLAAGLILDQHLLLVLAHINSYTLGPATPHLQGLVVFSNFLPCPLLCPAYPNVEQLDFDVATAVVAGPRTGALN

SEQ ID NO: 924007 - protein, 173 aa, Homo sapiens
MDVFPQCLLYRKHGSFCLWGSLWKLTIMEVEGKAGTYYMPECEEEIKRGEVPHTFKQPALMVTHLLLQEQYQGDGVNPFMRTLHHDSVTSHEALPPTLGTAIELEIWVSTVGVINPKVRFLPITSRATSKLGEKEDLWPIVYSYSMTAITYHNKLGGLKFQKCILSQIKHPEA

SEQ ID NO: 924008 - protein, 153 aa, Homo sapiens
MGTHLLPQHDPDARYGIKRDHFGALRFDCPFGFQTCMGPEAPLFCRRLRFKHHCGIIEPSGPRSRCLSKFRESKAETLAASEEEDERGHTYEGVKPGLGTKDAESLWRLLRAGLGVAWEPRVGEIKLKEDFVTEDRKGYKRFTGYYEPEKLLG

SEQ ID NO: 924009 - protein, 156 aa, Homo sapiens
MTPHMARFPSETKLPEERSGSNICCSAIFAVLQPPLLIPRQTGSGVDFQQTPTDLQLRVLTVRRKTNKQKGHPHQNPICTSPSSKTKEIWDCVKRPNLHLIGVPESDGEKGTKLENTLQNIIQENFPNLARQANIQIQEIRECHKDTPREEQLQDT

SEQ ID NO: 924010 - protein, 135 aa, Homo sapiens
MLSHKVIHPTTYCLLMAVQFILEPLHDTGLSKHRRISPRCVSGLYISLVCQDQVLNSVPGAVSQTVRISVTQKSNTLHWKKDVTCSKDPLKMLKGPRRGPKASLLEKVVLMKERRHPILERLEIWCFTSRQGIFI

SEQ ID NO: 924011 - protein, 167 aa, Homo sapiens
MLVPAHHCQCLSLTGSSAAGLLEFARGPLQTLFVWVPVVVAAEQRIFMNRECCCLIVPLEVLFQRSTMCKTLYFLRCQSAPTGGCLPVRLLRGQGSGVRDPREEAVCPFSDLQLRAGRTTALFKAVRQGHLSLQRLLLSFCLSVPCPQRWSLQRQAGLLELWWAPPS

SEQ ID NO: 924012 - protein, 205 aa, Homo sapiens
MTRTVNIRLMTNAAIQWLLQAELRMSLILSRIQEFKRANLQSSHTGSDEKAVTFSTRQQKRRQWENMQWAGDSPKVKILGPHHKLSESESLSRNTIVNCACEGSRLCAPYENLMSDDLRWNGFIPKLYPLPQPRLWKNCLPQKWSLVPERLDTAALGCPESGEHCLLSSTFQLCLLRISAPPSSPLIHLPPAHAPCFLMKLRVLL

SEQ ID NO: 924013 - protein, 227 aa, Homo sapiens
MKLQEEGSDSNICRSAIFAVLQPPLVIPRQTGSGVDLQQTPTDLQLRVLTVRRKTNKQKGHPHQNPICTSPSSKTKIDKTTKMRNQSRKAENSKNQSTSSPKEHSSLPAMEQSWMENDFDELMVMELDKTFNKEHNQSFCTICLAGIRPFYITTYNYPTAIAARVTKASNMTQRRSTGKASDTNGLHIVSYCPVQLLFLIKGFDGKGNRLATDLLQVTLRNRRHSHV

SEQ ID NO: 924014 - protein, 136 aa, Homo sapiens
MVISVHRWRSPANKSEFISISQINIFDNILENFILEGYHPPDLSAVDIKKLTATTTYLWSNPNFNTKTKQKTLQERKFQTIISYEQRCKNPEQFNNKNEIVGCGTILKQFIIYTIGISEAVDRKKTDKIMTKNIQI

SEQ ID NO: 924015 - protein, 136 aa, Homo sapiens
MLVHPAMAHADCFLGSSWFWLQVLPSRKNCSCSSSPPASGLQQGTAPFQCLLLRHFPQFWLWRPLPHCNLWPEGCSNLWPETNVSVQPHCWVPKEWLTLYAPGLKMASSSRSWVCENACSFFQCLSLSEPPSLSPS

SEQ ID NO: 924016 - protein, 143 aa, Homo sapiens
MRGVHSAGLDKWGKALSKDMVREKVYDERKGVLWRKLGGKLFWLVGKNGKQIVGSVWTIYVRSRTRCFRSCSCALGGRGKVLRLNNLVLALLINSARQEELWFGKVLALGVSDLVSAVCRLPKDLSYMHPQNPGEGGCALRPL

SEQ ID NO: 924017 - protein, 182 aa, Homo sapiens
MENSRRATLRAVTLTAKVRSFTPEPPRPRTPPEGRDSEHIRTSEGTNSGHAAFKNCNTHSEGIKQHLNCLQGKAFSALQRWSLISQYFIINMCEVFQYVLRTYTGFSCVMRIMEIKTCISALEFDCLMGIKLCIFTAHESYRCNTKGVIHERKRMDKLAFAKTESFCSTKDTAKIRKRQATD

SEQ ID NO: 924018 - protein, 164 aa, Homo sapiens
MIFRNLTCELLPRSLSLHFQVKFSSLCFLCIVQASVRSCSLGYISCLVWQYALEKELIPRPLFVNPQMSSKRGDGGQKRMESPRYHRNPGADHPLLLLHQTTQGVHTDDDDDLVYPWKDGTEEEACTEPINEIRAILIPGIWSRGDAWSLVMALRGDYVTRVEP

SEQ ID NO: 924019 - protein, 273 aa, Homo sapiens
MGRNQSRKAENSKNQSASSPPKECSSLPATEQSWTENDFDNFTIRFDQGGERVSVIEDQMKEMKQEEKFREKRVKRNEQSLQEICDYAKRPNLCLIGVPESDRENGTKLENTLQDIIQENFRNLAKQANIQIQEIQRTPQRYSSRRATPRHIIVRFTKVEMKEKMLRAAREKGWVSHKRKPIRLPTDLSAETLQARREWGPIFNILKEKNFQPRISYPAKLSFISEGEIKSFTDKLMLRDVVTTRLTLQVLLKEALNMERNNWYQPLQTHAKL

SEQ ID NO: 924020 - protein, 141 aa, Homo sapiens
MYGFWNVHRVPTGVPPNGVVRRGPPSSRPQNGISTDTLHCAPGKATDTQCQPMKAAEREVVPCKVTEAELPKTMETYLLHQHDLDVRHEVKGDHFGALRFDCPAGFWTCMGPVSPLFWPIFPIWNGCIYPMTVPPLYLGSK

SEQ ID NO: 924021 - protein, 140 aa, Homo sapiens
MEEGEEGAKAHLTWQQARDNESQVKGKPLIKPSDLLLIQVSGCSRCMEICLGTERRGPDCTRSLHRKGGTTQAASQCDQSGPYSKSHRLGKTEAVAALLLHQPLPKLAPEFKRQSALPQPGLLRSPVESLPVTSLIPFCC

SEQ ID NO: 924022 - protein, 143 aa, Homo sapiens
MLSLCQKEYICILNGSKRQAGGFVFPKVYMSKDYFVVIFLAKCVNLIQQHILKYLSIIWDVCLKASPLNPPEVIFQVKCSQQVPFIGEQTISLVTISYGGKTLPYPEARQLLLLLLRLAAAAVSSSYSYRASSFHWPELECKL

SEQ ID NO: 924023 - protein, 143 aa, Homo sapiens
MTKFLGRILSEMGAFGRFEWRGSTRLEMLPSRRAGSPWSAAKLPLTAGILLPRGTGIEQNRAGPDVSKQEHGFGDMDEAASHYPQQTNAGTENQTWHVLIYKWELISENTWTEGEEQHTLGHEKPVLVTRQGTIKFADTSKEA

SEQ ID NO: 924024 - protein, 140 aa, Homo sapiens
MITLPYLIATAWDNFPNHYLHASLDLTLLCGEPKKTSGKKRLYADEESKRRNSWSERVMFVFAFSAGLLKQSCRGGWLFSATHTSQRLQPRLTAKASQLYCTLFLEFEKAMITAETECSLQHLQDLLLLSLSLIQDLALQ

SEQ ID NO: 924025 - protein, 1139 aa, Homo sapiens
MGHSEGRQLSSAITARKWALSVPCGAATVSTPTSTVSTPTTVSTPTSTVSTLTATVSTPTATVSTPTTVSTPTSTVSTPTTLSTPTSTMSTPTAVSTPTATVSTPTTVSTPTSTVSTPTIVSTPTTVSTPTATVSTPTTVSTPTSTVSTPTSTVSTPTTLSTPTSTMSTPTAVSTPTTVSTPTSAVSTLTSAVSTPTTMSKTTSTVSTPTATVSTPTTTVSTPTTMSTPTSTVSTPTAVSTPTSTVSTPTSAMSTPTTTVSTPNSTLSTPTTLSTSTSTVSTPTTTVSTPTTVSTPTTTVSTPTTTVSTPNSTLSTPTTLSTSTSTVSTPTTTVSTPTTVSTPTATVSTPTATVSTPTTVSTPTSTVSKPTSMSTPTSTVSTPTAVSKPTSTVSTPTTTVSTPTTVSTPTSAVSTPTTAVSTPTTVSTPTSAVSTPTSAVSTPTTTVSTPTTAVSTPTTVSKPTTVSTPTSTASTPTATVSTPTAVSTPTSTVSTPTTTVSTPTTVSKPTTVSTPTSTASTPTATVSTPTTVSTPTSTVSTPTTVSTPTTVSKPTSTVSTPTATVSTPTTVSTPTSTVSTPTSTVSTPTTLSTPTSTMSTPTAVSTPTTVSTPTSAVSTLTSAVSTPTTMSKTTSTVSTPTATVSTPTTTVSTPTTMSTPTSTVSTPTAVSTPTSTVSTPTSAMSTPTTTVSTPNSTLSTPTTLSTSTSTVSTPTTTVSTPTTVSTPTTTVSTPTTTVSTPNSTLSTPTTLSTSTSTVSTPTTTVSTPTTVSTPTATVSTPTATVSTPTTVSTPTSTVSKPTSMSTPTSTVSTPTAVSKPTSTVSTPTTTVSTPTTVSTPTSAVSTPTTAVSTPTTVSTPTSAVSTPTSAVSTPTTTVSTPTTAVSTPTTVSKPTTVSTPTSTASTPTATVSTPTAVSTPTSTVSTPTTTVSTPTTVSKPTTVSTPTSTASTPTATVSTPTTVSTPTSTVSTPTTVSTPTTVSKPTSTVSTPTATVSTPTTVSTPTSTVSTPTTVSTPTTVSKPTSTVSTPTTTVSTPTTVSTPTSTVSTPTAVSTPTTVSTPTSTVSTPTSTMSTPTTVSTPTSTVSTPTSTVSTPTATVSTPTAVCFMTRGSRLLLSSLSAFQEDESETMMLRVSVI

SEQ ID NO: 924026 - protein, 160 aa, Homo sapiens
MLKGLAFSRGRAVVAFLEVAGRRRVFLPSCLLPCESFLTAASLAPFQSSSCPLIFVETTLTMISENLLVLCQIQGFPLPPTHTLALLLPGSAHSPTCFCTRGPSGEKQMSLELKKLQFTQAGLSWRLWARERGRGRVFLHAHPEQPPLGFAAHGWHLECQ

SEQ ID NO: 924027 - protein, 142 aa, Homo sapiens
MKEQGKTAPRSDSESQLRNQPIAWTALLPISMTVSVSRSAPGPSCSSVWNEQDDFVAEMHGAPRLTFPCASEYLWHAREKAYQDHRRKHRPFTGVGLGYSQVFLIPRGRISDYHMGRNLGQYPAFKGRGPCGFLQCIVPLVY

SEQ ID NO: 924028 - protein, 135 aa, Homo sapiens
MYPCILCGSQPGILLSNADAHQKLQPSAWALLPTAPSRRAFFLEGAGPYFSHLVCSCLLLRLNPREKIAIVPTPSSRALRFCPEEEADPQLIHKFNKVAEYKINTQKSIVFLYTCNEQSEEETKKTIPYSKVSKE

SEQ ID NO: 924029 - protein, 201 aa, Homo sapiens
MDPTPAQTPEPQTPPLDKLKDHRPHPCGSSKTMNPTPAQALGSRIPPLWKLQDHRTHPCGSSRTTDPTPVQAPGPQTPPLDKLQANEPHPCTSSRTMNPTPMEAPGPQTPSLWKLQDHRPHPWTSSRTTDPTPVEAPGPRTPPLDKLQDHKPHPYGSSRTTNPTPGQAPGPQTPTPMEAPGPQTPSLWKLQDHRPHPCTSS

SEQ ID NO: 924030 - protein, 180 aa, Homo sapiens
MATEHVNGNDTEEPMDTTSAVIHSENFQTLLDAGLSQKVAEKLDEIYNKSAFLCGVMKPYRQREKQGTKVADSSKGPDEAKIKALLERAGYTLDVTTGQRKYGGPPPDSVYSGQQPSVGTEIFVGKIPRDLFEDELVPLFEKAGPIWDLRLMMDPLTGLNRGYVFVTFCTKAAREAVKTV

SEQ ID NO: 924031 - protein, 143 aa, Homo sapiens
MLADRGLLERHVWFVCLSHSYSTHTTYMLKPLAAIIKMVPTRKCAKRQDSEVDPPERWTKDILLFASSLHRIESVPTPVSEACISGVLSDTGARRPEWEEFSSLIWDEALAKSFVPGETTKRSSSGSQKENMVGFLEGKFMKV

SEQ ID NO: 924032 - protein, 213 aa, Homo sapiens
MCRWSGKPTACSCLLLPPPPPPPPPSSSPSSSSSHIFKNNDIPGPLAGIWIMSVTGLAWLCQRASVFPRWLCLTWAPSAETTAPAVLSLPPSVSLIPQPYQARSQRGPRSFQISSQTTWEAQVGSSRKRDLPVAPQYYPHLSHTPHLSNWENFPHGEKHQGVSHYIAFFPPPAFHSTFWKSKTGKCFNALPSCHSSGFQTLLKIIVAGIAGAP

SEQ ID NO: 924033 - protein, 140 aa, Homo sapiens
MGSTRADRGAKEAGRGYLGQEPLLWFLWEGTGKIEAMKLGCWIVTLRLIMKGRRNKGPWLATGSYRTGRIAVWQRVGISEDLQGVKEHDVYHLFSNGLQKIPFREKGENKWETISVSPNLDVDKKYLGGVGLILATSLEG

SEQ ID NO: 924034 - protein, 157 aa, Homo sapiens
MIGTLGLHALTLGDWDQAHSFVLWLLKDPVSLEGLRYSQSTGNNPLKGACWQKYFTGEVAVSFMLSITNEVVQEGCEQKHTGEAVWAAVSRCMLGVAHLQKLSDDLVVSASEDMAVTTGKCHSWRSQTALLGEASRQGALRSDCPHPMSRQSCSTHV

SEQ ID NO: 924035 - protein, 146 aa, Homo sapiens
MVFALKVWKSYLLFVSSLLNSSHHRSQHSLSLEIRKRDGRVQVLFHGKGNSGKEFGGRPVLSGEKNSCLEAALGGLRLQFQLREKLRLRWKDCLSPEGTIAELFQEAPSLCCNPEIFSVQYTEPGIPSKSPVSFNRRTVLETKYGH

SEQ ID NO: 924036 - protein, 147 aa, Homo sapiens
MFLEAAMVAWWRVHISWVRYCQKWGYSISTCTCTSTEDRVTSVCAHIHTISCGDRATGVCELVHNSGNCGVQRVAESPPSMHVFIPAMTVRLSAHTLVVWGGSMLLHTSSSSGVYMQMCNGRAKMRSASTCLLLILGQQFLTVLKAL

SEQ ID NO: 924037 - protein, 176 aa, Homo sapiens
MLLVRAGWFPALMVPGEKERERGQRKKERKKRKKERKKERKKERKKERKKERVRREGGREGKKERKKERKKERKKERKRKKERKRKKDRQTERKKERKRKKERRKEKRKREKERKKERKREKEKERERERERKRERERKKEKEKKEKTLENRYTLRTIANKLGIIKFRGILCGNIP

SEQ ID NO: 924038 - protein, 166 aa, Homo sapiens
MPATAEPQGVLTAFPRGVLRSEPPGNATAPLLSFPPPMAWLIGACYNSGSGSPEVWTLFTPIVRQMGVCHSAFHSCCPQLEKPDRSMLQPFFAPAVQRFRVLVHNQEERSYVDTGEVTVHWGKGNDQTFQGLLDTGSELTLIPGDTKRHCGPPVEVGAYGGQAHQK

SEQ ID NO: 924039 - protein, 138 aa, Homo sapiens
MPCETGTVNLKMRFIFLAAVSLTLNTKLSILKTLSDWFQSFKELADSFRLNAAVLIWANATKQQQMLWRNLSQKEESVNVTNSIVVLKILLQPFQYTAANTLISQQPSTSRQDLPPIKSLYLSKGSDGHKYVLARKYF

SEQ ID NO: 924040 - protein, 192 aa, Homo sapiens
MEPKPLHYTIYPCNKPAHALLESTNIKKISIKGFGPLYLRVCDGIDIEKDSWKNFTYEEEYQKYLTKTSMFCDQAVAYKSEAYSQESYKPLLNEIKEDTNKWKNIPCEWIGRINIVKMAILSKDIGMGKDFMTKTPKAMAIKAKIDKWDLIKLKSLCTAKETIIRMNRQPTEWEKIFAIYPSDKGLIPRIYK

SEQ ID NO: 924041 - protein, 140 aa, Homo sapiens
MTLAHHVAGDEKEGKKGREQLQRQSRPRSFLREPRPTSSLSQGCDTLFGAVRFLKSPSFRAAQVSGCHRIPGASCGSCLQYTWSSCSLTKSQCRELPAPLQPVCLTVCGGWTPCFLAHTALAAPLALVPSKRDIQNCNYS

SEQ ID NO: 924042 - protein, 153 aa, Homo sapiens
MGTHLLHLHDPDYVVTTLLGGRIFEPLVVLHMFLDGPIEALSTLLPGSFLRVFYTVGILDRGKRHSFLEEDQIQIRDDSLGSSSKRSYTCGEVVPIFNGKEFRVHLVDGKSTKEVQVSLWLRAGLPPGIQKPHPAPQKLGPVQYQDSTMYVFE

SEQ ID NO: 924043 - protein, 159 aa, Homo sapiens
MGNFLYTWRETMILMAMSQRVYTPFVILFRISRGEENDVTPNIAGGVHPSVILWGEDDITPNIAEVVKPLRYFSYNLGGEDDITPNIGEGVHGHCDIVPNIHTLTDNGITPNIAEDQCENRLIQKVSADIDAYINVFINGFKKERKEKEHVTVWLAKLE

SEQ ID NO: 924044 - protein, 157 aa, Homo sapiens
MVSKDLCNFELERDDLGFLAEEISNHQRVHEEAGYKSLKTLHPDDAVEKKNPFSGEKFKPAAEIYINNKKLNVNHQDNRESVSRACQRSLQQPSHYRPRNLGGKNDFLGWSQGLLAVCSLGTWCPPSQLLQRPRERECGYYVKDLYGAAPERASIIL

SEQ ID NO: 924045 - protein, 137 aa, Homo sapiens
MGPAEGCRCPQRKLCAVHLVQPQPCTELPVPPQQPVWLAVGSGWNPCLLTHTLFDTLCLAHPWQAKGAICHVEIPFCGLEGSGLHPIAPLGIALMETLCGVSNSTFPLVIALGKFLSGAFISMVGFCLGIQAFLHVV

SEQ ID NO: 924046 - protein, 202 aa, Homo sapiens
MDFASLILDWNHSPQVQTLECGVCPLSTVRHAGCHSGEGSSKYRHGHQFSVRLRLDLAHCKQLPQLPPGNAVVPGSLEIPGTARPQRRSHIPGLGSSQVWGSPKDYSSSLLLFTHNVTIKGVFSPVCVTALIAMPFSQSQVLVLHAGRMSIQALPGLKVEPHQGPVPFHPKPCLPPAATHGVQAALRANQGTSNIYLAGFQN

SEQ ID NO: 924047 - protein, 163 aa, Homo sapiens
MGPNPGSQAALFCGPHFHSASQFKTHWLGIQLANGSRLKSTFDGSNFPGATTKSVVWSTQPLQPAGFGEYSHLLHVHVGQQQVSPLLGQSFQRKELVDIFAVLKPSFVVPPGMGETEATGVWSKSPENCSSPMRAEFTGQSTIPQFKEREAPPKQQDCKRLIT

SEQ ID NO: 924048 - protein, 169 aa, Homo sapiens
MTAESGYTYDLAPKSYVWPVKTKRVPTNSDRHWRLEIESLLKGQTMPVISSLSLHLIMVLFVENSAMMSITILCDRRENNSWVNACMSMSGPHMQLAAYFLYFFLLSGREAMINLVSCPRSEILGSHLPISLKLEEKKKKIDSPSSRRKLFLPDCFEVEHLSFLAFGLK

SEQ ID NO: 924049 - protein, 149 aa, Homo sapiens
MKFLSSSEIYCPPGTSMYFSSLGRSSLKGSSPSQGLIDKTPISLGWSTWRKGWLWSSFSRLQRSCLPALKRAAHLPAQRSSSAKGQTASSSGSLTPVLPDGEIHPSRGRQTPHTGELWLASGGCPSGTKLPEEAAGSNLCCSTASASDT

SEQ ID NO: 924050 - protein, 178 aa, Homo sapiens
MHGVYVGRYTVLLRLQHQEKWEIKLWGLGAAAGLLDFAGGPLWILFAWVSSAEAVEQQILQNSKYCCLILPLEASSRKGTCVYEVSVSPYWEVYALPPEVESTEAAGLAELRWAPPSSSFHGCFVYLLKPQQYQTPLPPPGCILTGQSQTAVLVVLKAPWAWDPLSQARDVISWCAIC

SEQ ID NO: 924051 - protein, 144 aa, Homo sapiens
MSFLQACTTGSLSCPLPCPYSIPPAAKGGLRKRGYEPTFHNAPTDDDRKSYSQQILMLFILGFQFLVPLLATVKYSSYPYLLGMNSKTPNGCEKQPINNMFLQICWSIQEGNVDQSHLSQHTDLQEKAKLGQSSQSQVDSPRQA

SEQ ID NO: 924052 - protein, 177 aa, Homo sapiens
MGQYIDTAYKIIKSGTYHQAVYKSFGIHSIRYGHKLHKNLGSTVVAATKTPDAAGEAWLGLRATRSPWEPEQVGAPPSSELVGCPAIVVDLDIPVLSGLRKPLDTAGVGVPASAAWPLPAPGVCSDFGAKFGPSLGAITTPSGVCALTAVLTCQPPATSSLSGIWVPTSMRGRSRGC

SEQ ID NO: 924053 - protein, 137 aa, Homo sapiens
MINCCCDQGINSFSRVFYGSCIKVQLKKCGNRLIQKIGTRKVGIAIKIPENVEVILELDFRGCVETPECPGRSHLQGWSPFGEPVLGQCEGEMWVWSPHTEALPNGALRRRPLTFRPQNGKSTNSFHSVPGKSYRLK

SEQ ID NO: 924054 - protein, 345 aa, Homo sapiens
MQKHKNDIMDFGDLLGDVEREKVFASSSPSAIIWVRGLTDFKNEATDPRGWSNDCDQNCDSAVDSEVQTDEFLDGNEEFFGNWNKGQEFKHTVEINLSKVEPSANSQDNEEKDLKVCRIHESRLGSLQLDFTRCMESLGVQTEACYGVEPSWRTTTRAQWRGNVGLDPPHRVPTGSLPSGAVRRGPPFSRFQNGRSTNRLYHVPRKVTVTQCQPVRTASEAEACKATGVELLMALEAHPSDQCTLNVGHGVKKDYFGAFRFNNCHSGLWGFCIGPVAPFLWQISPLCNESLYLMLVPPLNLGRRSDADRNAMVDDFRYVHYTFSAELLSSEFLMASNLGQNFRNK

SEQ ID NO: 924055 - protein, 146 aa, Homo sapiens
MLPAGYSPFGSLRSSLAQGRSRNAVLEPRPGFGDPNCLLERIHLHNIKVQGESASADREAAASYSEDPDKVIEKSGYTKKLTFNVIETASYWKIGFNKNNHNQMPKKTDKIEKETEYKNLWSYETVDPKLPKSELLNFLMIYCCLC

SEQ ID NO: 924056 - protein, 173 aa, Homo sapiens
MYENAWVPSQTFAAGAGPSWITFASAVWKGKVGLEAPHSVSTGALPTGAVRRGPLSSRPQNGRSTELAPCSWKSCRHSMPAREISQEGGCTLESHRGRDGRRPWEPTFCISVTWMQWADPYVTQVSKLSAQPQSVVGAIWENLDWVALPTGPLMAGTVSSMQLHRKVAKHLEI

SEQ ID NO: 924057 - protein, 149 aa, Homo sapiens [sequence omitted]

SEQ ID NO: 924058 - protein, 165 aa, Homo sapiens [sequence omitted]

SEQ ID NO: 924059 - protein, 162 aa, Homo sapiens
MFPFLCPCVLIVQFPPMSENMRCSLSLLDIRRLYGNAWMPRQKFATGEGASWRAPARVVQKENVGSEPQHRVSTGVLPSGAVRRGPLSSRPQNDGSTNSLYCVPGKAADTQHQPMKAAMREAVSCKATGVEMPKTMGTHHLYQRDLDVRHRVKGEKKPALPI

SEQ ID NO: 924060 - protein, 187 aa, Homo sapiens
MPSPPTASYRAGTCISAWSCRLRRRQPVHWAVRSGWTLHSPTHTPLTAPRLAQPPPKRDPGQKHEPTYLHMATFLHLQSQQELCSYGFGRLHPCGFAEYSETDRWEGVPGETPTSLPTEVEPREVHYVCSREEPDPSSSVWNLGFNQPVSSSSSLLSPVCWELDTWPKVARMADWCFPSSWSLSLPR

SEQ ID NO: 924061 - protein, 183 aa, Homo sapiens
MLQALIITVFWKIGTDKIKRVHKTQGCGPSARLMPGSLQHSAESGSSCPHYPGRSASTYFEGEVESPWVGKYLMTLARLPRQKDRTLSSLGIQTTQSIMCLYCLSVVQTRCGPRGNDLVGVPATPEATEVTTHGSLPLVLRLGKMSLHEQIEGWRTWRILLNYESGSPWAGELKRRRDRQSYF

SEQ ID NO: 924062 - protein, 144 aa, Homo sapiens
MGCCGNVILLLIILFRMGTAVSGAPIWASHHNSYYLIDQELIVKVALAINPSWNFWHGYDLTVSLPYQLYKANCMEILLEYWKKFCPMGNYSPWHFYATCDSSFSRLFLQEYLHNFQSTTKMSVGKVIYQNSIMKFMIGDLKGI

SEQ ID NO: 924063 - protein, 138 aa, Homo sapiens
MVLRQNTAVIKKAKSEVHRKQSNFYAKGRVSQLHLPLYPWEHPTPPGTEKIQLFPYLSQPLGNLPFQLMAKNPSFLTEGSCVRWPLVQQINIQRLGIEQRQGLTFVHTAKEGWPSSDSKPAGQVSELTEAEQRQLIIL

SEQ ID NO: 924064 - protein, 152 aa, Homo sapiens
MHSALVANRQPICESKGNALKEIYSATPVNSRMIRRQNSLIANMGKQFSGTIEDKTSQNISLSHSLLQIEDLTIFSSMKAERGEETAKEKFKAINSRDCFMRFKKRSCHHNKKVQGEATSDHVEAAARIKNLNGCVMKIFFHFWELKNTIAT

SEQ ID NO: 924065 - protein, 164 aa, Homo sapiens [sequence omitted]

SEQ ID NO: 924066 - protein, 168 aa, Homo sapiens
MKLRSLACPSPLAVQLGSYSEAQNKRLVKSCTSIVPCISEEVKQREVEQQLSGYSVAAVSRPQMRKTCRIVHPQPEPAFVRVLPNTVTQAQVGWKLMPPLPLVLLIRKTSVELNLKELESNERFANRAAPRITADSETLGVFRGQTRFIDKKSKVSYKFPLLLFVFGF

SEQ ID NO: 924067 - protein, 168 aa, Homo sapiens
MLINFSSSNALFCCLMSQAEIRTLSCRSVGVYWRSTPDPVCLGISSGGCRTADIGEPQMLLPDRSSGGFVSEEYLAVSQAAWWENHYSLQSCQTGTFKSAEVIAVFCLSVPCPQRWSLQKRAGLLQLCWAPPSSSFLAALFTYSSLSNGGCPSPSLAATLQFDLRLLC

SEQ ID NO: 924068 - protein, 143 aa, Homo sapiens
MNNSRRATLRAVTLTAKLKWVGEQESEASLNNTGSHFLADWFGRRRDLETLTKLHRKQQESGKGACGMGKIFANYVSDKGLISKIYRCLSIYDGVMSHPHNSATCPYPEPEKTSLRKANLRCRNMSVSRGLSAINKRIFTWVA

SEQ ID NO: 924069 - protein, 135 aa, Homo sapiens
MLGGYQSQCWLLRISKGLDLKGLRELAAATLVLVTPPSKSSAGLSLVAVENLQGSTVGTLGPSCMDSPVGSSDLQLRQNLMQCKVLIRVTACRLFYVPLVARKSRCPPSLKVRVLNKGVNHRSYILAPFISSSII

SEQ ID NO: 924070 - protein, 204 aa, Homo sapiens
MTKLAKIWWYYEGEFLCTSSLSVPAAIDVRCDLFLLAFCHDSEASTAVWNCESNKTFLLCKLLNLRYQKMCGNTRISRQKFTAEVGLSYRTFTRAVWKGNVVSEPPHRVPTVAPTSRTVRRGPLSSRPQNGRSTDSLHRVLEKLQTLNTSLGNQPGGRLYPAKPRGRAAQDHGNPPLASVHMQKSGSPANGTEKWPKDMKGNNL

SEQ ID NO: 924071 - protein, 192 aa, Homo sapiens
MCLASPSLSAVILLQLQPWLKGAKIQLGLLLQREKATSHGGFHTVLVLWVHRRQEVRFGNLHLDFRGCMETLRYPGRSLLQGQSHHGETTRAMQRENVGWEPPHRVPTGALSSGAVRRGPQSSRPQNGRSTDSLHGVPGKAAGTQSQLVKAAVGAVPSRATGAELPKALGAHPLHQHALNMRHGVIGDYFGA

SEQ ID NO: 924072 - protein, 141 aa, Homo sapiens
MSHRVPAYFNFTVKLKRSNQPQRSLKPKPNSEHGTHSLKFCEGCESHPRALMQMYKDINVFISVNTISILYSMDQGVILNFMSCILRNTFCKALASIDNDFSDGSEQTKLETFWKEFAILDAIINICDPWEEFKISTVTEV

SEQ ID NO: 924073 - protein, 147 aa, Homo sapiens
MPLDLLCELPGVLQIVGVHQFPFHDHEGHIRAGGEVKVCDWRQGDRRTGFVFHTLKLHHFNVEIVSFPYCMMWLVLVYDFTRRHCLCRVWLVRSSTSESSIQLTLYQSPRIIYGNSTSAQCHAEEYSYFPKPSALWSSTAETCDKRS

SEQ ID NO: 924074 - protein, 167 aa, Homo sapiens
MFTYATNLHIMHTYVCLCTSDGYTEYSTLVGEVLLDNILKSVFKLGSVLPATFRDALPREEESREAVWLQWICRAVVGTAQFELPRGFVYNVREKAPNQASVMADTPLLTKLELPRSTSDCYVVKVSQDLPFYPKSDPFYTKSDSVVGAKIDGTGNLPHHRPSARNI

SEQ ID NO: 924075 - protein, 131 aa, Homo sapiens
MLYNVVAMEASACPLRFALIVQSCSSRNSSARALYPYISQALWCLMMEKFLLKNHIIPFNYSICTETEIECAHHTRQSNKAPSWKQRAAFTKHQYQCLNFGFSHLQKDKNPGIATAMKTNIIGKLYQKKEK

SEQ ID NO: 924076 - protein, 198 aa, Homo sapiens
MGPKGVVGNDEYVHYLHCADGIMERVPGSCPTTKRNKVCRHQRLNQFYQFYLKNLTIIINIVKMATLTTEIYRLNTIPIELPMSFFMEFEKNPSKIHVQQIWNWSELPHRNNTYTCKALTAGKGIKHTDYQGCFQIMGQRQVSGQVATSLSKLFIDNCNIRDLQQVLPKLERGYAFRVLKGHASSFRPFSMMLTVGLP

SEQ ID NO: 924077 - protein, 149 aa, Homo sapiens
MVPRCSEVMIFTDQAKDECGNFWVIRLLPWKGGVTSRCCHGNGKPMWHTGAGKSKICRVGQQAGNALSIPQNVAMTFAVDGRCFLMSANQKGCSKTHVQEPLSQTIALLQLGHGDTFWIARPRYPLPSDHSKFSRYSGTPLSKDTYDIS

SEQ ID NO: 924078 - protein, 145 aa, Homo sapiens
MGRNKSRKAENFKNQSASSPPKEDSSLPATEQSWMENDFDELREEGFRRSVNTNISKLKDDVQTLHKQAKHLEKRVEEGLTRINSIEKTLNDLMELKTIEQELRDACTSFSSWFDQLEERVSMIEDQTNEMKQEEKVREKKSKNK

SEQ ID NO: 924079 - protein, 158 aa, Homo sapiens
MRPFHVGAVGMDIFILVLLEKPYNPYVDPPPVISEINLECHRLLKTITSSAISCQLAIHFDLNANHQESSATEHLNNLPPELEHTLWWTWRCATHHPLQGLVPASGGVVAGQPSAVTPFGDSPHAMTNQGGGRKPWPLAHRTTLMDHFSSRNGANGLA

SEQ ID NO: 924080 - protein, 162 aa, Homo sapiens
MVSPQIKTLSFTLWISTCSEVVENENLLTVSEHARTQSKGWSNTGTLGKMDERTLATSTRAVPNEVAVEEQVSQTGILAAVRSPEKTSQNLESSALGVPGPPCKRFKTNWFSKCGAQTSSIRTTLEMQDACPILDLQTTEPLGLGLHSLCVILVHTEVKLLI

SEQ ID NO: 924081 - protein, 170 aa, Homo sapiens
MGDDAWKVMLNGMPAIENAITRGLTLKLPALAPLNHRVKAPIFIASWKDRVHSSPEGASSLTVHLTSAPKALPSFCSRHEGLLVCSLTCLASFHLGLSHLPFFSPDTHKANSITSFKSLLKSHFLHEAYSDHSSYHCNPPLPAELHHKLLYSTPNPSVYHALRYLLVSWG

SEQ ID NO: 924082 - protein, 198 aa, Homo sapiens
MIVPRSLHLALCVHLCFVSWSIILHSLPFIRKCFSVSSSTYEPLQFLFVTYYQTFLTKIIYVDFMDPGGSSRNTCGKQKISCPFPSDMHSLLIGQNCVTWPPLSSWAWGSRILLDLTESIILNKIGVCKEGKGMDIGGHLISKGICPLGLILLQSDEDAACGKQGAGATGHLERAAKCYFGFLLLGSPRSEDPMTWIP

SEQ ID NO: 924083 - protein, 156 aa, Homo sapiens
MNPVSLLELVGNLVKQSKCELSFPHLCSRASVLVPCTAAELPAKLPGNGPLFILGGMAAPQAPSVQGSRQDQMRGKHQIPYSKLASGAQQWPSDPPLPLTHQNVIEAPSKKLWSWGSYQDEQGHDRVLSTLRNTCLGEFHLEVKIRKGSYSIIQLK

SEQ ID NO: 924084 - protein, 136 aa, Homo sapiens
MGRCPQKSALNQHILLQASSLNIIPSPSQLPEIHRPFCSIDAPFPPPLKLTYSILFFFVVIRMAFWWTGENIQVPMALTPDLNMQEVHFLEDHLSPNISANSREVYLDLLTECKLTLYPHFYGIYYHGHDVRAFSI

SEQ ID NO: 924085 - protein, 210 aa, Homo sapiens
MTNTRTESRKRERKERSRIQGKKKRENGGDSLAKQEEVEQTPLQEALNQLMRQLQRKDPSAFFSFPVTDFIAPGYSMIIKHPRDFSTMKEKVKNNDYQSIELKDNFKLMCTNAMIYNKPETIYYTAAKKLLHWGMTILSQERIQSLKQSIDFMADLQKTRKQKDRTDWGGWRQSGEDEGCWPRERGLWRCRSTSLPESRQRKLKYRQRYA

SEQ ID NO: 924086 - protein, 145 aa, Homo sapiens
MLVMVNLCGSAATSILASSEERIRLKGIRQKSNKKGSTSSSTWQHRRAGSCYTGLVFSRHVWEVPFEEQLLGGITGPGCSQNITLSNVNVKSSGPGLLVHGILEDPFFHLIKLATETCACVTKFSCHGFQLHQVIYGLLYTVYSS

SEQ ID NO: 924087 - protein, 164 aa, Homo sapiens
MKPQTFTVSVTALKDGVSGVSSFWWVCGLADFKNEAADLCSQCYSSYRWFGPKETSSTCVGTARSTEACSFPLSPLLQVYSQPTRHYFQSLQKPNIHGALKSWYLGACCSLLLCISHGEHAESKFSQWRGFFSTLARSFTPSWLSIEIEVIWATDYEGSNFSNK

SEQ ID NO: 924088 - protein, 159 aa, Homo sapiens
MDTLPDPEGWKSAVGLRLRQTAVVDGQQKLSSSPFWAKPFNKSPGSSKLSHTFLSSSKPSKLLQPLPITQFQRCFHIFRYLFSSTSLYRYQFSVLVCFHTADKDIPETGQFTKEKGLVNLQFHIAGEGLTIMVEGKEEQVTSCVDGSRQRELVQGNSHC

SEQ ID NO: 924089 - protein, 137 aa, Homo sapiens
MGNNSTPSPPMAFKKLAYWIKKAGKSKIFRVGCRLETQRRAGVVLQVQRPSAAEFPLAQGRESGSLSKSSDLGVNIHQVNIRGSQAQSRESLDVGKKGRFRVSKALNEFGDLQPVEGERVVEGQVENMFQDGHYDQL

SEQ ID NO: 924090 - protein, 139 aa, Homo sapiens
MDIGNNVTGGMYTFFDIGSNTILSPRDCRRNIEEVLQRHSTGSPSQSNQARERNKNHPNRRDKVKLSLFKNNKILYHSLCPKAPGSVRQLQQSFRIQNQCIKISNILYSNNIQADSQIKNPIPFRITTQIIKILRNTAN

SEQ ID NO: 924091 - protein, 161 aa, Homo sapiens
MQAIAWWLPSGGTSQAFLCLVILTSISALHLGAIVKWKSKSPMKSIKMKKCGTKLTLKRKFGYSMSTEIRMEEEILRLLITPGPGNVRGLEFKKGSLSKKPEGKCGMQIEQTNTGTDNQTPHVLTHKWELNNENTGHSEGNITHGLVGGLLSYNFESEKGS

SEQ ID NO: 924092 - protein, 207 aa, Homo sapiens
MPALFLSSAVTLPAVLLLLESPQFQSSRYFNSREELKEEENLSAAIPKSRSVAYKVEDAQELFICVYTLSLRGHWRLLCEIGEGVVCFGQLQSSTPARGPGMIRFHAANKDIPETGKKKRLMDLQFQRTGEASQSWWKVRRSKSHLTWMAAGKERVCAGKFPFLKPSDPVRPIHYHKNSTRKTCPHDLITSHQVPSKNMGIVGYNSR

SEQ ID NO: 924093 - protein, 145 aa, Homo sapiens
MIQYYLALWQWSGYFVFPSLNSFPASSSSPPETTSAWTALSISLSAFWSKLFNQSLRSSNLSRIFLPSEHSKSLGSSKFSHIFLSFEPSKLFQTQPVTQFQSRFHIFRNLKWGLKNCISKKFLYDADVAGSETTLRKTLMKENIN

SEQ ID NO: 924094 - protein, 152 aa, Homo sapiens
MKLCKVECSITVQVHCGDDGLMASKVRKPCSLSQLKTETLQRQGQLACLTFLSVENNKRRGNERKIKFLRRDVSSKFNAGAIFSKQRTFCFYRLGSVKTCSTSSLLCVFLFICVSCHKQSECRAIKRYDFLNGPIKSGSAHETWISPEIMER

SEQ ID NO: 924095 - protein, 297 aa, Homo sapiens
MASWGVPYDQLTEEEKTRTWFTDVPNSPVAETNTGTLIWHHSSGDQPATWWQVDYIGPLASWKRQRFVLTRIDTYSRYRSAYPALYAFAKTTIHGLTACLIRHHGIPHSIASDQGTHFIAKTVLPCPVIKVNGKLQQPNPGRTTNGPDPSKMKVWVTPPGKKPRPAEVLAESKGNPEWVVEEGTHAVLKVCSYPSAQLRCRGGGLLDQREFPRSASLLGEQQKDKNANIEAPTITPNPCCWAEALCSFLAVDQRLSSIPCQVGLSQMATCLSKHENQEGDKESLLARHKSQSFVIYL

SEQ ID NO: 924096 - protein, 154 aa, Homo sapiens
MGCTHCLTSPNEMIQDSIQDTSLYVELTLEQHKEHIFNGTSDEWVTGHWGYHGVPMCLMELDPEGGRKGSNRDLSCAFEDTWATWQEARYYYWMENVLRLETASPTSKSKEKQEIFKQAGTFKPVQCIQIQIYDCSVFRCKLSTKRKPSLDFIR

SEQ ID NO: 924097 - protein, 154 aa, Homo sapiens
MLSPSHTPHCSMPGLPLAGPARPSGQNKLSRPEQKSSKGTTGHRDFQPEKQHPKDPITIAKVAAHSPGLMAQCDWDLGVMGDEPIWGELVGSARLRYLGAYEQVGHDSVSHSYAWNKSKDPALHYTNANVGRTGFFTTQRAQWKVVFFVSAKLK

SEQ ID NO: 924098 - protein, 162 aa, Homo sapiens
MFGASVWETCMARMSQTGRSRPFALLCSQHLNVGSFEASDVPHVNVFSVCWHDILIHRHLLFYHVLLETQGSNQVTSVENALHPLDLHLAGGPDKGHGKSQGLCVFPAESGEGAWCSSSQAWVGSATACFLGANVSFTTDPATLCLLIGQFSPFIFNVIIDK

SEQ ID NO: 924099 - protein, 156 aa, Homo sapiens
MRVYLHKPRWHSLLHTWAMWYGLLLLGYTPIQRVTLPNTICKWNTMVGICVSKHRREGRFDGIAPGEDYFPTPFPFQLPFLLSTTFISNKTPTFTISNLFTCCHGATWSFTPASTQKHSPRLLHPLACAPAPARGGMKQDQVNGVHPCWHQHTCAL

SEQ ID NO: 924100 - protein, 136 aa, Homo sapiens
MAIDPLWVYLQGFPMSQSSRCQPCRLLAAPPWASDLSSLGLSFLIDSGKEEVRAAMADTSMLGPLRAMAILGLTLARQPKGCMILAAAQATFFVLPQKATPHPLKFDHKIAIHLMGLIVVLLLFLPHLQLLPPLRF

SEQ ID NO: 924101 - protein, 164 aa, Homo sapiens
MATLHPGEEGESDESVDSTRSGPSVAGLLEFAGGPLQTLFAWVSPVEAAEQQRLLPVPSSGRFVPEGHPPDASSGDAAPWPIFGADVLKDREEEKAVVPHQSQAAPLRGGLMGTRIPANLTSCSMAPAFPQAPAEEKSRGSGPAAGGSGESLSGNRLACAPVLA

SEQ ID NO: 924102 - protein, 225 aa, Homo sapiens
MTWILSLCCQRNVVKMEECSLNLGYMNCCRFHVDLLEHFKLPYKKCKYPEKAYSMRKPKFVIQKEHVKGKRDFVQPPLSQSFLAQIDQTSYNTPLNQCLIQNKALSLYNSMKAERDEEASEEKSEASRGWFMRLKKLIYLDHIKVQGEAESTNIKAASSYTEDLAKVNDEGGYIKQQIFSVDKTAFYWKKVPFRNFITKEKSMSGFKASKDRLTLFLVVNAGGDF

SEQ ID NO: 924103 - protein, 152 aa, Homo sapiens
MERGWGEHQGVAYTVAVCLWGLPTVTDLEDYKAFCGSSVLLPAVAEDWISITDYKPLLDSETTNLTGDIRPQMVVDIEAIPEGKPGKQEEATLPFYVICKLSKASQKALKILQFLTATQELDCNSSGCCGGASWPELPKLIKHFCSIWYSLT

SEQ ID NO: 924104 - protein, 196 aa, Homo sapiens
MCEKATKSLPWAGLVGDVWDFWWKSQSPRADRGMEGRERGSWSLGNKRSAPCGTENNSVTGSKSSHLYEYRFPLLKMEIIIMAPLLLQKGYAEKQEEWAEVAKRRGCKKRDAFLSWAKRERIHFSGTVVRIWGGWGQGGAYSSLLLPVLRPQPSEGLRRFKGHEEPAREPQTRQRRGTEIDAHRKMTTEKYIQRGR

SEQ ID NO: 924105 - protein, 135 aa, Homo sapiens
MSQELVALQVTLLHNLRTIALFFFSICQLNGENFEDLEDSEDKMEPEWKCGDFEKKKKRRRREEEEERRRRRRGGGWGRGGEEGEKEKEKKKKKQKQQQQKQKKQQQHSQKEQSITKNPIHGNSKNTELILKDFK

SEQ ID NO: 924106 - protein, 158 aa, Homo sapiens
MTILIQLPSWTHTPAVELKHPSYSISPKPQPCWVMRARRQNLILLYPNLDYCNLVNYANSIPGLRDEGEEDGKKKVLDEFWWFAVTETWAYWRHRGLMVRKPQLPQSQGKLCLRPSSVTWRPISESSTSWKDYQGVKVSSLLERGLILLVQKSILIHL

SEQ ID NO: 924107 - protein, 136 aa, Homo sapiens
MVDAFLCTWKLSDSKNFDDYMKLIGASFAIRQVASMTKPTTIIKKNGDIITLKTQSMFKNTEISFKLGMGFDETTADDKKVKSIVTLDGSKLFHLQKCNGQERTLVPELSDGKLILTLTQGTAVYTRTYEKEVISY

SEQ ID NO: 924108 - protein, 152 aa, Homo sapiens
MSSLTTKASFNLISPTLGSHAAPNPARSSPEKHRPLSLHTAPQNFHCPNTLPLFHFIVLINIRRQECQASEPKLSHHIPCDLHVHIQMAETRSLVSLNNPRPRPQHEQWLSAQSWLTSLPASLRRSHHATHSVPPGLHKDKHQVTQEEIFCG

SEQ ID NO: 924109 - protein, 164 aa, Homo sapiens
MINDEEPDTKWIVPLTSTLFEGWELELLTSLSLPLVTSCKREPMSKQMWEPEGTNAGTSQSLLSGRSRLCAVPTAASQPLPSQHPTYKSPLGKSRQGTECVLGTWAQDIRGTWQGCCVEQEALLKVALPLLLINKTALWNLLLTKSKVIFCPLSLASLSLVICS

SEQ ID NO: 924110 - protein, 137 aa, Homo sapiens
MASLSDKTPGFSPSCHVFPSPRRFCCEPDCQPLFPGVRLLPREDPIQKASQAKSVPAECTLPLNTQSIGLFLKAAVFLDHDDEAKAEAPYSLFCLFYEPSTIWDDIWLLNLTKKTKLALDEVITLQISDCHSEFSVI

SEQ ID NO: 924111 - protein, 273 aa, Homo sapiens
MEMHLFPNAFALLKLPHTLLVLSHDLALYRFKTLFKTFPSQLLEPLLLSICKPSGYCRSPLEQRFSVCFLDQWHQQHPKTCYKYCSHALSRSTESDSGSKVGPSPLSFNKSSRAVQKGNVGPEPPHRVPTGALPSGAVRRGPLSPTSQNGRSTDSLYQVPGKAIDTQRQLVKAARREAVPCKATGAELPKTMGPQLLHQCDLDGGPSPCPPCAPEFTAFIAQLFHFFWRPFQEARDTWGAPVSSLPPPWGTTNFTSSVKANQGLSENTSKQNR

SEQ ID NO: 924112 - protein, 115 aa, Homo sapiens
MASLPQRISYTDVKVLLTPEVTFTPHSHFSVILCVPSSLFSRGESKVSEIGFFVQMFTLPLELDSPITVPSCPLVPRMDMHRCEFLHYIWHMGTGQVLIFVAELKCPFFAYGGLS

SEQ ID NO: 924113 - protein, 164 aa, Homo sapiens
MTYSSIFNQLPMWNVGTGAVILRYEMEAVLRMLGIRSFHPWVVLPRRRDIYQCLKTFFLDINEASSVKARGATKQPPMHRVAHIAKNYAAPSVNSAKVEKPYFRDKRSKDRVEASTLVPWGRPLFAKGTESEQGQGLVLQLCPSDVIEPWNSVPFLEGLRLDGD

SEQ ID NO: 924114 - protein, 287 aa, Homo sapiens
MAQAILHPHHFQARMLHWKPSSSSTPANRPHCNDPKDHLTQTWMRKVDPGNPGLGSWPAVGSAGISVDGGLWNGGKSWPAVGSAGISVDGGLWNGGKSWPAVGSAGISVDGGLWNGGKSWPAVGSVGYLLMEGCGMVEELAGSRISGVSVDGGLWNGGKSWPAVGSAGISVDGGLWNGGKSWPAVGSAGISVDGGLWNGGKSWPAVGSAGIAVDGGLWNGGKNWPAVTEQMYREKPDSRDWASLNNTCHGGMVFSHLRASISGCADHREREKDSLETEQYVKPLRRI

SEQ ID NO: 924115 - protein, 244 aa, Homo sapiens
MVGLACLECHPLTNKSLDGGFSAVAVLLSWTISVCCGGCPVHCDMFSSIPALHPQGYSSTPTLNHDNQKWRSKLWLPHCCWSSEASTEDKALENLARASRVDGGIRAPRIAVTAVTWLDTVMDSQGGVWWPRKSNCHVDNSGGMESKSLLSHIHSRKLTRSSNGGRGKGVENLDSTGRGSTLALVKQAEPQAPPAASLCPGDPAAQKGYTDFPCRATQRISFLYSVLKQRLLLPSVRRPLPWHS

SEQ ID NO: 924116 - protein, 168 aa, Homo sapiens
MVTVPRENVINHDIHSFCQQAFIDWLLYAATPESQQLNTVGVSVLAPGAFQCLFKQAVFYKGIQDPDSFHLRLHPFLRPPSSALDPVCVAAEGRRRGHVEGFCGPDEAAKPKLIEPLDYENVIVQKKTQILNDCLREMLLFPYDDFQEMAAAKRMLRGDLLHLNNLAV

SEQ ID NO: 924117 - protein, 131 aa, Homo sapiens
MIFLNDYVQFFVNSRCFYGHNTLFSLRSQVVQLKAKFSDLLFRSGKKREGSMNFIEFTYETLCSVNKHPVLGGREVGPNKRISHCRLQVTGAVPHTWCPWACASDSKQQTSPFLGNIIGKHGIPMCSENMV

SEQ ID NO: 924118 - protein, 136 aa, Homo sapiens
MRLKDLPTESQPVSGTVRISHVCSHSVVLTPFMLPCSESLSHEFSESGKQMEFASWLRTWGNFAEKLPNEGVEEREEAGCGGSFILWSKESTILRDSGEEEPDQKWPFNCESYMDLGYAVSSTRFIKFYFCFTYQV

SEQ ID NO: 924119 - protein, 152 aa, Homo sapiens
MRFGWGHSQTISWMNDGMSACGCGEKQDCPRFVTVVATGGEAEEDRNTWKSLELPRDLLNGCDQNADSDIDSEVQAEEVSDGDEELIGNWSKGHSCYALAKRLAALYPCSGDLWNFELKRDDLGYLVEEISKQQSIEDVAWLLVKAYAHLGK

SEQ ID NO: 924120 - protein, 177 aa, Homo sapiens
MNKGRSNGKCSEVIRSTLYKTAAALLSENPRGCKNKLSVITSISGVIRTFKFHSTWYSMERIPNAKEESSNRENNIKIWKHYAIEDVIIFIENAMKAIKPEAAIMKEIVDVAKKREVRGFKTDLGEIQELIDTTPEELTEDDLMEMTASKPAPDNEEKDLEEAKNRVTSDNLTERYC

SEQ ID NO: 924121 - protein, 214 aa, Homo sapiens
MRGSRDVKTSKEVHSLLVEGDPANDQVIKILLDKSCYRDYGFGEKAATIPKLRQFLGQYLVPGKSLKYVLNQCLALNCRHHVGLQWIDWTLTGSSYLEFLMRMQSDGGWTGAAERKLQTFAVNATAHKGGMHPQSEQQQDLLRRVKEQTLHMIERDPSGLLLLARVEEVLVEQGQQQWGYLKKQGKKGAGTEMAGVTAVGFLDGPSMGWMQGDR

SEQ ID NO: 924122 - protein, 152 aa, Homo sapiens
MAAPLFQREEDSCKEEAEEKAGGAVQKPQEVGENITSGSCKRLSVSTKDKGESKVTQKALQQAMVLFPGGVTHTFIPEGPRQGSRLCAAIMLDPLLLLKHRHIIMHLCLPKAESLHIKKAGKCYSYPYNKKNTRHILSQQLSIKPSENEVLR

SEQ ID NO: 924123 - protein, 138 aa, Homo sapiens
MLPLLAHLIITETHTYNLCTWCCNSISQRHTESYINKGIFPRSNNRCGRSEGVAVGAQGRTDLLHTKQVNPMPRQNRPKGALGPFHYVTTQQDVTIYESENEYSPNAEYASMLILNFPASRTELMWIIEVVFNKTMEE

SEQ ID NO: 924124 - protein, 249 aa, Homo sapiens
MDADELRPASDEVCVAPGLHFAARKVKIGVEVPSAMLVGCNQSGIDLWSFELQRDDIGYLAEETSKQQSIQEVTWVLLRAFRFIKEAKHKSLKNLQPENVIEKKNSFSEEKFKPTAKICINFRGCMEMPGYPGRSLLQRQGTHEEPLVGQCKSQMWGQELRHRVPTGVLPSGAVRRGTLSSRLQKGRSTNNFHCLPGKAPDTQCHPVKAAGREAIPCKATGVELPKTMGSHLLNQRDLDLLHIHEHVAG

SEQ ID NO: 924125 - protein, 162 aa, Homo sapiens
MADVTGGGAQAVLVLQRAIKSGFSTAINCCSKTHFSHLMRKVILQKKVNGLCAIAFSPSNLHSSSIKCLEIDRVDIMFALDTFRATKCDTALERKGKNDSAMAADDARLPPALFCIPTFLPADAAGANLAAQGESLATCVFTHFAITQQQRFLPIESKDPSI

SEQ ID NO: 924126 - protein, 159 aa, Homo sapiens
MQSSPILQATILSHSCQFDPDGKIKGPSHHGTTVILVHQRFLPHAVFSQLIFKFLLGKCFMNNDMYSVAGGSIFLSKLMEKRKVVCGHDNYILPEKVEGLKIPRTESSDGAASHPFTPTVPRYYRSVCIKRECIPSMVFLPPATVGDDINFNKITKNTR

SEQ ID NO: 924127 - protein, 136 aa, Homo sapiens
MSVCSFSWCRVQTSDESTIWGSEGWWPLSHTHSSTRGAITKSCSVADLTNTLSHSSGHWRFKIRGVISSGSSEGGEEEIPSFPPSFWCSQHGLDTEEERLIVSSACLPSCHGAAQSIGFSSESPHLEVRISLSLDI

SEQ ID NO: 924128 - protein, 157 aa, Homo sapiens
MRQVINDPVSFVWCTLLAKLLAKSNAGADLIGGRAQGKQWGARVNTYEASLTGLSLPSCCVARFLTGHGPILFHSLRVGDPCRVSEAGRWAVTHMPVSLFNSLGREWSTNLAVAQLAVRPWMSFKQMLCLLGQGFLLHSLQEKCHTSEKGEVNDTKG

SEQ ID NO: 924129 - protein, 161 aa, Homo sapiens
MILIKVLFCVDFNSICCFCHFKKLGLLCAVVKSTVFWSADMQTTVPSPPPVNSQVCTIPKGCCAQPFLRSETQILISYELHSNIYYRGSMPVVVFSVEFLKTDSDNSVCVCAQVTRYKNCCLRIKFPENKVPDITLFTFICLLMDYNFNPWLKSGSSVICD

SEQ ID NO: 924130 - protein, 135 aa, Homo sapiens
MEYEEALGILKLEGPALLRSLFVLLIRVKMELDKRIPRGGPLGATLLLLCLHHIAMAVTHPDDWDQLRLQQWNTGLQEESSHKEEEHLDTQSLNIHAELHQHKHPAGIGDITRYFRIILYVCCLCPKMCHFCKDP

SEQ ID NO: 924131 - protein, 144 aa, Homo sapiens
MVCRSQTLREIFVFHMRLHHIEMTKTIKSHQSKSAERRGSGSKGEVCQEVGKVTQDRKSATSEVGSYKDMATLWLVVEKGDNFKHLAIFGDVFDWHDLDVEEELPSCNIFVQVKMETKSSPAERIILKDLPNKFFKITYVETQR

SEQ ID NO: 924132 - protein, 139 aa, Homo sapiens
MTAFVFIVSHHLSIHPSSMDRAAPLCQALGIPKLPASVGRDQISPRDPGCAFHLLNLSAQLWPPGIRLLLTYEHCHYCGHTTVMMATTTVRSMMISPLVIITSPMTTAHMVTATTIATGIATVIAGQRLFNSTYHRMAQ

SEQ ID NO: 924133 - protein, 170 aa, Homo sapiens
MAKRGQGTARAVASKGASPKPWWLPPGVGPAEGKCGVGVPTQSLPWGTAVIRGPPSSRPQNGRYTNSLCSAPGKAAGTQHQLVKAAGGAVPCRATGVGLPKALGAHLFHQHALDVRYRVKGDYFGALRFNDCPTGFQTCMRPVSPLFWPISPFRNGSIYRRPVLALCFGS

SEQ ID NO: 924134 - protein, 126 aa, Homo sapiens
MKVALCSQVAVGLEKCGQFRVMIRSQSTSHGQESLNKGSAKDDIQQVPIFWINEPPSLSRLFKTGYSFSKPKSILTHILPHAELMTPEAGIRVMLLQAKEHQGPPNAGRDKEEFSLRGFQVTWNLG

SEQ ID NO: 924135 - protein, 207 aa, Homo sapiens
MRCPAWRSDTAEGQEGEGDGVSWQQWGPAGAMQGEEDVSAISKLMRVQGACHRPAAVHTDLHNRARASGRHPETLKVIEPPMVPALLPLALAKRVSLVAAVGGEWRRGDDSGHCWYWILGAGHGRGQYSWKEAIDGWQSVPRALCNYSVTPACGRLLERKPTASLLAKNQLLRYGCSGGKETWAPGRTMLHSKERRLEADSFSDGDP

SEQ ID NO: 924136 - protein, 157 aa, Homo sapiens
MVSSLRCWVTLGISKSVVLAARTSTPVSKNSGKGQEEIEEHLANPVILKKQQHCLSQLIYQKQFLQLTCYLLNSFTIIAIYHKYKILGIWEVILPERPNSILTTSIPYCETNVFIVYRFHIAANVHTEWSSCQRHPIQPSECASASCQRGGRRKRRW

SEQ ID NO: 924137 - protein, 138 aa, Homo sapiens
MHDFGGPRGFPFTMAMCLEWHLQAKEWQRLWANSRSCSRYGKLPPSTIRESVALLTPDSRMNSCDPLGPTQIIQAPPDLSQGPQCGPHLPSYFCHTTEHIRRFWGLGCGVLGGHHSAHHADRQYLHSSPVSEALWCPC

SEQ ID NO: 924138 - protein, 151 aa, Homo sapiens
MGRDQRGNSRYQQAMSEAYVMPVKPCRTALEMKALSTDWEFLQQYRQPLSAAAPVLGQNTHDKMPLMEKGVCGNSLQQQWETYRGTKVGKDEIANEMAQRVTGVRVCPGVLGGKLVKRIVRTERPSRFKAHLNHRKPSVRGQRMSDLGGIL

SEQ ID NO: 924139 - protein, 148 aa, Homo sapiens
MFTYLVHFLIKKIAALFLVYDSFFGKNHLQVDLNFLLNFRENSSSAWPSRTLTPTEMDKKVGRCQSDERAEILTALEGCQYEMAVGQAVAACWREAALASGSQAFGLQDLLQQLAEEEVGGIQMRAVVCQDQSSAAHAKESNSQTLGA

SEQ ID NO: 924140 - protein, 157 aa, Homo sapiens
MCKMTTSPNMKHPKAPCSPLLISVPHQEWELTWQLLGVGVLFIVVPTTYGGKWEHPADHLLLPQALSWRQSRALGPVLPGGLLSRAIGLKRRHLLRTCSWTFSRSCWRSGSELRKELGPVSHRHSVASGSHPHPLHRGVLLRERATSRCSLGCHQLP

SEQ ID NO: 924141 - protein, 290 aa, Homo sapiens
MCLEMSSRRQVLDQSPHNCDWYPILLWLSRYPRYKTKSSPPFPLLSSSRRKGSLLEPQAVQPGVRGGAMPVLPCLPQLVSQTALSSVLHNCCALPPLVPRDALHTTSQRFFLPLKLKPGLLEFAGGPLQTLFAWVSPVEAAEQQILLPAPSFSSFVPEWHLPEVSWSSSAERLSLLKLDPQPPLPPGALSQADGNFTYQPLAGAAAFLSEMPCPERRNLERQSGPRYFAMLRLTSYCCAGSENFKPVDFSLLDFVGMGPAVREDLASWLQPPFQGSEWFCLTGVPGTAGV

SEQ ID NO: 924142 - protein, 254 aa, Homo sapiens
MVDPLTACTVCLEKPQTLNTSPGGGIENHLLLRKYFRMTESSPRLHTAPDAEGNILRANFKGNGTQRGETKMKVKTTDIVAKGTVTGSSTSHCNRNSTRVVAHSHYSLKRLHAACEKKQIAQSEWLEKAKPCGIQTKNPYLVFIEISNNYSNKKGQSNHATQEYKNMNIDSMDLHKGKYGYSSKQMKAALEVFKGFDVLAYRPHTMNNNISHFHPAFQGENFKQRQHSVSHIVEIKVPRIRPAIPIQECSVKFQ

SEQ ID NO: 924143 - protein, 135 aa, Homo sapiens
MNEMGIQDLFLVGDDKITPEKRTKEKTILDADFGKGFNEKVEVILGLEGRLRFLEAKAVLGEGLKGGEVRKRRRKGGGEKGGKRGGKKEEKKGRRDKEKEAWLFETADLTFWSMYLLSSIAERLEWSQEEEEVEL

SEQ ID NO: 924144 - protein, 144 aa, Homo sapiens
MLEPIHWMLPGFSPFGNLSWACKAQQAIGGEGLVEIFKEETHVKGKSVLDHVKSHNYRGQQTLKAGQSAHLPSWRVSRRGLSRLISMNGARGQLVTHTSCQSSRGCRPALLTKDAPGPHCQTQPPPLRGAAFPTSLPTVSITHC

SEQ ID NO: 924145 - protein, 147 aa, Homo sapiens
MLCGKTCLSPSTMTVRPPQPWGTSVCFNHHLDQFCNTYRPCTYIVAVLSEALKTVRWSIETHDSTGYLDRPPGIKSSMNNVYRKADFGVKAKATAEISISFVHKSLPIYQGSLEGLWLGENIARPGFQPHAFPQPGVCAKHDLHNPI

SEQ ID NO: 924146 - protein, 168 aa, Homo sapiens
MQKDTSPANEYEGLSLQMKRRHRSLKSQIIHFDVEFPNQYIQERLMIDAEQPVYNIHRLRILDGEPYVLEHTFMPVHLVPGLKKEHLLASIYDHLHQELNVHFAGAYRAISADKSDEYDQQYLNCAENDPVLEVQQVVYLKDGQPIEYSSSRNRFDVRNYSVLDVRST

SEQ ID NO: 924147 - protein, 143 aa, Homo sapiens
MTVDYPKLNQVTSIVAAVPDVVSLLEQINTSPGTWYAAIDLANAFFSIPVHKVHQKQFAFGCQGQQYTFTFLPHGYINSLALCHNLIRRELACLSLPQDIALVHSIDDMMLIRSSEQKVANTLDLLTSLKDSSEGKSSQWAEV

SEQ ID NO: 924148 - protein, 130 aa, Homo sapiens
MAQCLLYFVWILLLSIIIFSLIFVESYSTASQFLYPSIPLLMGIRVVSRFQLLKTNFNTTFKAPLILESTSGAGAAPCLFHFTDKDHSEMVINKNCSVGTQEETWAIVLHLSLCISVLCIDTMGVIGWMQ

SEQ ID NO: 924149 - protein, 215 aa, Homo sapiens
MGQVWALAHSTLEPFHTDDEEEGEYNELTEDMTEQVSFPPKAKVAKEGEVCPYPSAPPHYFEEKEWPDPPDLSFPEDTRKGKSPDPLHFLEPQQLGLDLAGPPPGSLMADTNTSAKKEYTGWPPGTQRDGTERALMHYNLRGAGWCTNDTCQSVPGCEATPGCKSCHTGKTATIAALLLPQASKRVDHNFSAHCSGTFHSSGYGGPYPTPEKIPV

SEQ ID NO: 924150 - protein, 199 aa, Homo sapiens
MSPPGGANNFRCATLRAVTLTAKVCSFTPEPARPRTHQKEETPNTSEHQKEQTLDTPPLRTVTLTSRVRSFILEVIRALFSRSAGVCWRSTPDPFFLGITSRGCRSKDCCLLLPLEALSQRGIHQMPARALLYEVSMHCPERRNLKRQSGYSGFAAAVVVPPSVNFLAALFTLVLAHFHAANKDIAETGQFTKERDYEI

SEQ ID NO: 924151 - protein, 146 aa, Homo sapiens
MCVMFVWVASFLGNWGIGNSSRICTHQYNITLKVKEESAEAEYLRGRGRGLGLSVSASDDYTGRTDSKGKNTTDPYCSSSEHAARKSGEGNEERWPKHMGTHGFVSKYSDLEFKPDSLLAASYYSPLANDACPLKGCFTLFSTYGF

SEQ ID NO: 924152 - protein, 147 aa, Homo sapiens
MGLGSLEQGVALVGEAPATQEPMEWVGGSGMAGCRSRGRPCGKAAKARREIKHSAGGPALLGDSVHPPQPLARVLSPPLPGASRAGWLLRVQGTPSPRPPGTPAGPQVLHTAPVPARVSPSTPPCKLKEWAPALASPERGSHSAVGD

SEQ ID NO: 924153 - protein, 127 aa, Homo sapiens
MPTVQRGLSSCPVSRKNEVTQTTREPLFCRSAGICWVSTPDPICLGITSGSCRTATIAACSFLWKFCPRGSPVRCQPELSCMSVCQPLIGGNLLVCGLQKRWEKCSIWALSFTALSFMALSLTASLG

SEQ ID NO: 924154 - protein, 175 aa, Homo sapiens
MVSALGPPLLAEALKRQTIPEGPRRSYSRKPGHSEGLPTTWVEVTFTPMGGTARGCQDSGKKERKKKGAAYSLSVTYPWFLLEERQTKGCFSPLPDGYSKLSMIDQGLDENPIAFLERLRGALVKHTFLSPDSVKRQLILKDKFITQVDPDVRRKLQKQPMGPDITLDNLLKVVT

SEQ ID NO: 924155 - protein, 148 aa, Homo sapiens
MGLEPSAQLLHLSNCMLSLLYGKAFFLGNTYCLSDWLSVLRAAGLDQSPCVLVTDFGSLIGKTLLVAWLLWARSPRSAPKQLPTQFRLEVSFCLSLAPQALTLTTFLIALDELTLKFDICIPIEAYLRFPSKKGAIVQGSTCIPFGVS

SEQ ID NO: 924156 - protein, 150 aa, Homo sapiens
MPVIPALWEAKRGRSLEFSRFSGRLRKVPPVFLILMIKCERRGDKLNKEIVHFSSKVQRKYEEHRMCCVRNIIPVLSMLLTLREIQKKTSRWVFWAEHLSLQFTALQIKAIHEEIHQSPSSTSGCYLNKEILDLEFLPNAFMKGGFLSYI

SEQ ID NO: 924157 - protein, 216 aa, Homo sapiens
MAPLREISSSNATAIPLQFDIEGGCHCLVLPANLMSQAPQIGKLSCRLQTHDLEGSRNHHPLFLVVGRWDAVRHLETVQSGLASLGLVGQHTSHRPPEDAAGSPEVVGTSGRAGVHPLAEESQVVQLVSVEIARNVDAFAAYDHHLPAQQYLFSHDGRQAAQEMASTIKHQDLHLRHLRQPLGKASGSYLVNHLLLPLLLLTTTDMIFLLDIFLLL

SEQ ID NO: 924158 - protein, 167 aa, Homo sapiens
MGDGAVKAILFLVPPTTGQHLCYWKPKGQPHGSPMVVVLEAALHSHVKSHQEDDYETYSIAQGPTTDNFPLFSTRSKRAFLISIRNVWKLEFLLHFLVVSVKFLAKVVKERASDCWRSKGGNSASESQSRDRTVTQRTATAENHYYLKLKDYKTGGAHCPKSFKVTW

SEQ ID NO: 924159 - protein, 135 aa, Homo sapiens
MVYTLPSAVSPESSAKGDPSRSYGLSAASSIPVFHLALQIDSAPGNVGNFSCKQTFSFSSGSVCSGEKDLPFLLPRLGYSQVWGGLPGLVGAVCFIQRVCGSSQDCWFVVAVDLELKFTINTGIPESKFIFHFWF

SEQ ID NO: 924160 - protein, 180 aa, Homo sapiens
MGAHLLLQRDLDVRHGVEGDHFETLSFYFAQAIGLGYYVPRPAWRTVQALFYEVGVLSCGYVPAHASTDSPKPGDNKIKAYEIAKMANCLFHWELCPRELQISYWLNSHSRGWLEMETQARRTHQEGRYGIEDLHNKESDQFSIGLRGLLQSLVTLDFLISRDINSENCKITKMVACPFL

SEQ ID NO: 924161 - protein, 138 aa, Homo sapiens
MGISLLASRKLIHIVTEIPIQVLYLITQALAQGFVSTVTRIPTENRLSKNTYILEEKKGQNNWNARKNGMKSGGKHENLEEGSYTTQKCLFKDLGAHPLKQKHAGRWLLLSNLPIPVERKIKPSFTLKSLSATTVEGE

SEQ ID NO: 924162 - protein, 135 aa, Homo sapiens
MGAVQSATSRTQGTRDAGHRGPTAATATPPLPQLLLAPPLASPHCSQCDGGGSSGRLATAIIIKVVWMPEFLVKQELNTVELLVMLGPHSESPEQPVTSEKKQKGKTQKVIIYMEPRKLLHIKSVVFCYISTNEL

SEQ ID NO: 924163 - protein, 139 aa, Homo sapiens
MMAEGDLSDMNISQTEEEEECGCKSVIIDSYQQQDLSSFTRVHSNGSTAACMFIGCGRLLMASVLASVWVFTAKALAAWLREDVTGNCAYICASSDVSTGAGHWKARDCVCPLCAFMWMTVVTQGGGGSTVLCAVLHWQ

SEQ ID NO: 924164 - protein, 155 aa, Homo sapiens
MLHWVHAQVCYIVCQKVKDYRKQRRILNIRMEHFNNRLLCLYPSMWPSTLPTYVAEPVGYTHLPFKPDKAQRSRSMASWERRYTRRIVINNDIVIETKDLSSYQDPDSSGNYRIEWRAERQAYTVYPLVVLGSKIEINPLPSSSSICQPIVQYIV

SEQ ID NO: 924165 - protein, 150 aa, Homo sapiens
MFYGLHNNSILRLCTLIMRDLGEEDQIFPASLIFMTIDVYLKKSGHALTRKIVQKKSVSNEKQWLIGILSSEKDIVIYGAYTYRMSTGSTILHKVGELESIVKEHTIVRSLHLGVPLNAAEQNMTRVHCTWVQIYTFPSCVTCRKPLKCS

SEQ ID NO: 924166 - protein, 150 aa, Homo sapiens
MPPPHERGEPRIRQRMGGQLEPSLFWTLVKKIREHSPSRFQATSDHAGPRVRAIGADSGGFCSRFFIDTRTVSISTGAQAIHSNLDEFSMKDSGKGDSELNDSHLDISREGFKKTSFQMIAKQGAQATVTGEIIDSEALLHNKRVFQWLA

SEQ ID NO: 924167 - protein, 135 aa, Homo sapiens
MAHKALHGLVKLYLEGFVFIHLLKLYGLAKMNALKLPEHTLFSLIPRTAPLNVVTRNPKFKITYKACIYDSRYVSVRLHWYGVYCLAHLVNEQTGRWIYVKGDGATWDGTPYFKPMDSVLKEPCAPVSIFPGIKY

SEQ ID NO: 924168 - protein, 182 aa, Homo sapiens
MVNPTVFFNMAVNDEPLCHVSFELYADKFPKTAENFRALSTGEKGFGYKGFCFYRIIPGFMWFMCQGSDFTHHNGTGGKSIYGEKFDDENFILKHTGPEPSHSQTNYLSMANAGPNTNGSQFFLCTAKTEWLDGTHVVFGKVKEGINIVEAMERFGSRNGKTSKITIVIHPPQPPKVLGLKE

SEQ ID NO: 924169 - protein, 125 aa, Homo sapiens
MILLIVICQGGFFSSLEEVSGAFPVLGPVSGPLDSHRVMGSLHGSSFTCRSWTRCSALQHLAIDMILLVKMRNVGSDIKVMVISNSPHDTLAKRISTVKVVGHSPAQAPALAHGRSSVFVWLGNT

SEQ ID NO: 924170 - protein, 166 aa, Homo sapiens
MNNSRHAALRAVTLTVKVCSFTPEPARPPTHQKEETLNTSKHQKEQTPDTPPLRTELSPIQPHGSPTVVSAPGLCETNFSFCLNQLEQIVAKQPLMKASVNCYFSPLRVCVVCVRVLREGLFDLIPKAFPLVYGDDKFFLTIRSCVTHQQHKPWGIISETPQKPFA

SEQ ID NO: 924171 - protein, 134 aa, Homo sapiens
MYHVSKQYIFIVEGTEKNWDFFITGAGITLGVTRWHLNMRSKRKEEKKERKRERQKRFHSELKLRNTEFSRLHDCRMLQAFNMLSFSGFCQMVSKVVVQLHFHQLCLRVAVVLLPCQHKFPPFSSWHSDGCTAL

SEQ ID NO: 924172 - protein, 179 aa, Homo sapiens
MTANDPQHFVSEALLFHKNCVTNANFLAGTISSRFAKGERNNEGTSVGSLVCVITEANREVRKQTISTTKRRKGRYSDGSTFKRGLSPEVRVDVSCTSEKMMSLQGEEMKRSKIEESEEVLVSSQRQLPHKAPLKGPDINALSPPLHLSCKHQYQHLKILEMLQLLDWSNYVSDTVEFP

SEQ ID NO: 924173 - protein, 169 aa, Homo sapiens
MFRYTNTYHCVTVAYSIQYCNMLHRHTPHQGRAATGSLTPENNKPLCWGEGMGGGTRLERRLGRGHRNLRSTVRPEECKWKVGLPLMRSCRKEAQRMGSRFVQGYTARWCEDRAALWSLGPLSDVVAVSALVLPNGSVVCPDVRVGLEHFQPGSLDVELAGLWDFSVSH

SEQ ID NO: 924174 - protein, 191 aa, Homo sapiens
MISRRSRNKLRYTSKEKHLKDWAPSINPRKENLFDGAPSNASFYLMAEDKGWPRGGVSQAWDTNNFSAVLDVGLLGVVHRAILAQDVGTLLLSWPGWCLPGEAQGAASMTQDVGTRLLGWPRGMSSGSSPWGSFSGPGHGHSWLIGWSGGASAGNGYRNVSRAHERLHSCLVGLGVFLRGVAYRAVPQAGT

SEQ ID NO: 924175 - protein, 143 aa, Homo sapiens
MDTEFLIQYWLILNTRESCTEDTRPETCVILAAEPTPTSSERQWRQKQSGFQGLRVPEFESLPEWPRGGENPICDMEEIAADKEQWSPGQKGMELMEHGLVPHRPDLCQHVRHNNIESRPFNKSMRVSKCPSERKSQKPLTLN

SEQ ID NO: 924176 - protein, 140 aa, Homo sapiens
MVELMYSPTNSSGPFAAGLLEFAGGSLQTLFAWVSPAEAAEQQRLLPVPPLKLGPRGALARCQPELSLMADNPPPSKLVHPRSTSDCCAGSENFKPVDLSFLGFLGVGFAELGHLAPWLQPPFQGSEWFSLAGFPGVNGV

SEQ ID NO: 924177 - protein, 137 aa, Homo sapiens
MAQSLMASLGYGREFPHSLCFPGEVMPHPASAHPPWAAPTVKGTTRDREAIQGSGAAALPTPLRERVEEGTRARTQKEESVESTALRAPATTQVTLQGGDPETNTLTHSPLSSSFLHSTSYFLLPLFSSTFASFKKL

SEQ ID NO: 924178 - protein, 134 aa, Homo sapiens
MSHWRLPEAGVSFTWLAGWVPSTVVLECLHNTAADLPQSKSYLQNQGGRFNAFYDLASAITHCHFHSPPTNTLQESFTKGKCDCILTVGQLNQINGRSFLPRKVTQVAQDVLAAKWQRQNWTPGQMSPVHIQET

SEQ ID NO: 924179 - protein, 139 aa, Homo sapiens
MRIPVLSVHPSWAQQNCSTQHCTHTAALHCVHICPQLPNAQDIQAPCSVAQNTPNTSLHVPPECDSHYLSLLCLFKCLASHSTAGSIRTAAYSLCPQSSEDLSASPAADHLCDIRKPLSQLLNALSPKSDCMEEDSTQQ

SEQ ID NO: 924180 - protein, 183 aa, Homo sapiens
MQTVHNITPGVAHTVIDVNGIPGTLKLGFITVKYHRYISGLVIVDQHSDSLTEETTPSPLDELWTQTAWDRIPALPLTSIVGVADFIWVKCEYLNCRNGRSPQPSPHLNQSQFQPLKDQGEDIGVQCGLQQPLTNSTLASVSCFGIHSHTCVRHQARARSWTGEALLSCSLCFRKETANKPNK

SEQ ID NO: 924181 - protein, 152 aa, Homo sapiens
MGWLCRKNEFKRAIVQREILSRISHGFSRGQPGPREVGTQGKHYCFQGPGCTLSMRTSPTQCWVHARLHSVPKETFIEWMVVPLTETRMAKVSLVMSVKALMNRLHGDLQEAAGPQSCSFEGIGERRPTACLRSGFLPILMCPFRGGEFLNI

SEQ ID NO: 924182 - protein, 154 aa, Homo sapiens
MAASRRLMKELEEIRKCGMENFRNIQVDEANLLTWQGLIVPDNPPYNKGAFRIEINFPAEYPFKPPRITFKTKIYHPNIDEKGQVCLPVISAENWKPATKTDQVIQSLIALVNDPQPEHPLRADLAEEYSNDRKKFCKNAEEFTKKYGEKRPVD

SEQ ID NO: 924183 - protein, 137 aa, Homo sapiens
MLGPPVELRQTHIGGRRQERLDIERTSRGAHLHTIDQRNEAECGWSTCPSRGLSSGTLKKRATPSSHVLRGRQGNFSGFTSAWLELALKHPFPSSLREQRGKAVITAAAECIWVSFQERTCCSALKNAVGQQPPAAL

SEQ ID NO: 924184 - protein, 155 aa, Homo sapiens
MTRRSDGFMYSTTVLTAMSSRRWETSFAHLQRAASATKEASGAPVMTSAFQMEREKVGEVGKEKLSHKSAPWKLRFYHALECGQSRCHTASVLWSVQLKLYSEMRKLLLLQMLVSILSWFLDTRMLLQKPKPKPKTFHSAPHQGLPATAFEAATR

SEQ ID NO: 924185 - protein, 142 aa, Homo sapiens
MDSQFHMAGEASQSWWKANEEQSHVLHGSRQEDMCRGTPLYKTIRSHETYPLSQEQHGKNPFPFSYLPPGPSYNTWALLQFKISSEAAGAAKPMLMGLIFVSPVLKVVLPEGKILLEGNKRLTKDLKEKIGNDMSPVNFKKL

SEQ ID NO: 924186 - protein, 159 aa, Homo sapiens
MRNLLGTGAKVTLNVLAKRLMALCLCPRDLWKFEVERDDLGYLAEEISKQQSIQEVTWADNVIENEIPFSEEKFKPRAETCISNKKPKVNHQHNGENVSTGSAEGKCGNGSHQQLAPYAQKSCRHSVPAIKAARSGGCTLESHKSGAAQDHGDPPLASA

SEQ ID NO: 924187 - protein, 154 aa, Homo sapiens
MEIGGQLQIRPSWKASLMKQYDSFTDDGFTDEAYAHEEGVRGRGGKGQQKEDKRSTELEGTEEQTHVEAGTGDEGHAGHAATYTMESQLEGCCQGASRIVAKGMDWFMTYLEDIIRRRQFLSNEKAEQERGDEDISHPFGNWKDGDSSSWTMEM

SEQ ID NO: 924188 - protein, 330 aa, Homo sapiens
MLNSKLENDTVNFDATNLKDKHILSQPLCKAESKFSSLEIDLHHTRDALREKTLVLESVQRNLSPHAWHQRDDLGYVVEEISKQKSIQELTWILLKAFSFTREAEHKSLENVYPDYAIGKKNPFSGEKVKPAAEICDSGPHGEPMLVGKGNMRSEPPHRVPTGAPPSGAVKRGPLSSRPQNGRSTDSLHHASGRAADTQCQPVKAARREAVLCKATGEGLPKTMGTHLLHHCYDSGEPVFLGERYGYGLGTGGYSYITGGGGMVFSREAVRRLLASKCRCYSNDAPDDMVLGMCFSGLGIPVTHSPLFHQTKNCVDRLQGNVLNQDCYPV

SEQ ID NO: 924189 - protein, 179 aa, Homo sapiens
MLSSNDYRMNRVCAKCCGRDVQDAVRTCCREIDGFCLDWGDGSQQGAILHPREQSGVLLNILQRHRTVPPHHRTINYRIQNANSGKLEKLWGKGQGRLPRGCDVRAQTRKGSRNQLNEVKDVKWPQPVVKIAPFSSLEFLSSCPSQCVSDFSTHENHLCVLKKPVFVKMQIPAFQLQIF

SEQ ID NO: 924190 - protein, 150 aa, Homo sapiens
MRPTHIGESICFSHSTNSMFIPSRNTPTNTLRMVSDQISGQVDIKLTTTELKPNQAKQNRYLTGRGRMASQKRQRGTGEDGVRSLAKMENRSKKHSLWVRMKGPRLLGAKTKSPKVWHGICLEKHGLVWRNHNNLILPFLGLVFILPCKK

SEQ ID NO: 924191 - protein, 168 aa, Homo sapiens
MGLVMTKSLSICLSVKDFISPSLTKVPQLQVCWNSLDVHFRPCLPGYHQWKLQNSKYCCLILPLEASSQRGIHLYEVSVGPYWEMPPSQATWGIPGQSHTAVLAASKDLWVWDPPSQARGESPGLLVVKTIGKAQYLGRRVPFLQVRRHPALVQLALHGLHPLSNQSQ

SEQ ID NO: 924192 - protein, 146 aa, Homo sapiens
MHQGHDVQDEPRASTWIDRAECGDSHYQLLLQDEYAKKAERIHRPFEGSGLLLQDLGDSPNTVSVQTVKVGKGDHLPLNAHPHWGTGTGKRLQGEGNLQLNFVTIPNECEVSWQNLGEGRIQCEDMTGRRRRSPACFLGQEAGSLG

SEQ ID NO: 924193 - protein, 139 aa, Homo sapiens
MRCHREAITNTARGLARPWRASFPCDWLKSDPHPLRTGEAHGNVDIILSNDNSLNLPFWCSKSTTKVACYKEWTFGHIGKASLSSWPNTVFQGVAHCDTSAEIAPVQGSRELGEAVGNYREHSPPKLPVGGTGHLTDTV

SEQ ID NO: 924194 - protein, 139 aa, Homo sapiens
MKISCSDLLLQGAKLMMVPADSLLDLLLLTCLPQAGEESGKDNQEERTECSSYGVMQRYKLIGDGLVLDQSWVNQSGGIVGIKITWSCQAGVGVIFWPSSFFRAGCFLTLNIGLQVLQLLDSWTYTSGLPGALGPLAID

SEQ ID NO: 924195 - protein, 157 aa, Homo sapiens
MILSIHRKQAAGHSGCSGTHFYFDPWVYQFMLIRILLGIPCSPQIAGTLSGKAVHFSSPYVQTVSQQFLTKQNILLPYDPAIVLLDIYPNELKTCPHENLRMNVYSSFIRNYQYVEEIKMSLNRGIVHVVLCPELVPSYGFLVWLTSIMKPRTPAKD

SEQ ID NO: 924196 - protein, 173 aa, Homo sapiens
MGRYVFPLLRCQERSDNCQKDPRGKRRQGQNRRIRKLSIPLTNSHQQSNCAWERLLTRNLEKYMDTKNSSCTHVPQDMMIPMNFLGMKMINLFNFSTASLISMQCLPKARGEHVLRRQPCLGRLHSSVARMPPQTFPCDSISDLRLVIPSPVLNSINGQPESLSKQLMTNRSH

SEQ ID NO: 924197 - protein, 160 aa, Homo sapiens
MMNMKAEKQQDSHAMGALMPLVEVDWEVAFCNAIVIPSPVPDVTVEPLNETAAPANSRTAAFSDILSQINPVKLLLNSWPIGTIRRWDLLGGDSVMGVEPSQMISVLLTHLSLPSCEDIARKPNCETGPHQMLDLPEPYFGLPNLQNCEKYICVVQKPPS

SEQ ID NO: 924198 - protein, 136 aa, Homo sapiens
MIFLRPRSWIDAFRNEPNVKDKCVKLSLGWYEFTHAVHRAVPAKSEALDKTSYDYFYYLLNDERRLKIASSEWKTLHHLLFLETRRLLLGPLVTMTLESRAGKFKDDVVHEAEMGHHSFCTILFSVCFDGLYFYLI

SEQ ID NO: 924199 - protein, 147 aa, Homo sapiens
MLSNSDSVKCGSWTRVSYYIVCTGKPISPERNETTRLTPLLEEQGFPKDQEEICSTLSYSPAEFWLSQCSSSMAFTRSDSMRNGKVTLFILSRYFWTIVAPDPSASQASDPSGTPIYFPRARRTFTGDCGKMATWKCYFKSALPVTT

SEQ ID NO: 924200 - protein, 135 aa, Homo sapiens
MCVLFETTNFLVICDSSYKRAIQMRGIRQLGLELRVGLFRHLPHFCVVNASSCANRKGIPGSQACSTWKLHLPFSLSTMCAVQEQATWHRPGHSICPFWRIRKKAPFWKQRATLTRDGSADALILDFPASKTVRR

SEQ ID NO: 924201 - protein, 155 aa, Homo sapiens
MAALWNRKGGKVGKRLRNRMRGFTGFFLFFFLFISFPRAHNLLLLLVSDFWCLNHRLGCGIIPFLSLILYGEALSLCLLPILLSCGLRNLIKERTITDPNPQKYYEWGGKLTFRTRVLPQHRTMATRDSVRGIIFKISKSSFKDAPKRGVRQMSC

SEQ ID NO: 924202 - protein, 194 aa, Homo sapiens
MRKVDASSNIHTEYLLFLLNSPTFDPVHGLPALPLFPFVAIAVHCFITPYPKSPFQKCPSALPIEVRCQEFLMPYERGLESGIESKESKKLPPMNENARDTLCKIIFLSEEIESYQKTQSRENSRETMTSRYFKCGIYDWRVVSKASQPFDLNCGRIKVPFGHFPTPLHAFEFLPKWKNSKLMVADPIAIASSE

SEQ ID NO: 924203 - protein, 143 aa, Homo sapiens
MSNYLSSSLLAESGDFMGWAMGDSGKGNIQVGKHGCKLSLWAKQIHQSGHKHPLPIRPLKRTHVHLTASSDSNGVLPVTLSFGKCKKILKKKNQVGGIIVPDFKIYYIAVIKTVWHWQRDKCIDQWDRTENLEINHTHMLNRF

SEQ ID NO: 924204 - protein, 141 aa, Homo sapiens
MGLLCQSPGTGKWSTHGLVKGIYRQQYRTPFFQSSLRLATFRILLIGAFYRVLIGAFYRTLIGAFYNPLASYRALIGAFLQSADWCVLQSSCKTGKFSKSPLDPGSPAGVISQKDEARFLLPAAEGMWFQDSHSESLTLIP

SEQ ID NO: 924205 - protein, 138 aa, Homo sapiens
MDLFSSKKNFSLNIFNTFCSEEEEEGEGEGEGEGEEEEEEEEEEKEEEEDEEEEEEGEEEEEEEEEEEEEERRRRRRRRRRRRRRRRRRRRRRRRRRRRKKEEEEEEGEKTGAWSSFSLCHLGRELYIKNDTMRKFLP

SEQ ID NO: 924206 - protein, 152 aa, Homo sapiens
MGDTPNGGPAPPSAARRRVVVVVLLLLLLLFLAKNRKEETGINSSLSYPHLLGTQDLYCLRLRKEESVCSRQKNTCKGTEAESVVHLRNCQFLYFFYEYLTSIGVEGTGDAKRDKTETQGYTSKIEVSIKSIKSKGFLRTPKMDLNLSFFPY

SEQ ID NO: 924207 - protein, 170 aa, Homo sapiens
MDTVTCKSTEHLGHHNQRVMVGLHHRAPLLPEASSSKQDAKGTFQALKHNEKDRADYNKKASAARPEAQWCMSPGAPSVGLNSVMGLKSHCVWAPASCGRMSKYTEQTISTFMSELPHWGAGDTLPSDPRQAGVTSDLLYAMLLAFHRQTRAQWGALGGDREAGAEAEAF

SEQ ID NO: 924208 - protein, 130 aa, Homo sapiens
MTASCLGCPDHGVKLASHSLSFPAGLDLVDGQEVMHVQKLMHLQEKNGEFERLGKKDQCAAMQEAKSDNAEQSVTEVEKESYCLLVSHTQSQESILSSRVTQYLKLYAAALSCMHKFPPGHFCIHSCRES

SEQ ID NO: 924209 - protein, 146 aa, Homo sapiens
MDDDMSPVALCSAKDPGSLRLLALHLWSLAFILKLTSWCKMEGASAAIILEESHYLDAACSYSPPRHGVIQAKLLLEKTVLGDLGRRANKVTQEAAQLPPEVYYFYQDCGKWELNPFSQLSFMSHWPELPLPKPHPGREKELPQLA

SEQ ID NO: 924210 - protein, 216 aa, Homo sapiens
MENHGALWKGVVKGRSSEYKKARKTSAQAIERETGMSEFEGLGVKHFQLASRGLMKEKPAVGGEAQGVFLQDTRKVVYKEAEKAGDGFRACGTFHQILIQLVQKATKSGISTLWDNLGQPGLVLGGGQNRRRPVETGEWERQPTHLQRGETIAGLESCTEPLLFLGGETGEGDDSPGSAMLEVTPELPFITRTFTNDSSLSFFTFSRCGFEVYSDS

SEQ ID NO: 924211 - protein, 139 aa, Homo sapiens
MFQLPGLYSVGVRQKIRLTDVGLGEAGGRQPTAQFVTPGLKAFESQAWCKGGRRSGKVVMEHEVVIAAANCQVGTYLSVVDVLNSQGALPGPPVTSHLISIQKDTLSTLEIPRVLEALCQGPGTKTKYYNKRYSYHSGS

SEQ ID NO: 924212 - protein, 166 aa, Homo sapiens
MNEIAVFLSHFVLGVSLACSVWLALALGSEHGSVHGTVLPAPSLHVAVITNPLAQQSQDLDILKQVSDDEAHQPSVPLEDFRLSAPEPPTVLRTGSQGDAGFWRPAFVFLGSLRLHTRPMKIRISGIEPAHQDYFNFSGLSEEQSWLKTTSAPPGVIPGPCHLGAC

SEQ ID NO: 924213 - protein, 192 aa, Homo sapiens
MFFGVEHSELVLPVPEQNARLSGFTTETFLTVLTLESSWRPRTTAHPWHSRREKSKTISPSLDLGWTMKALTKRIYCKGHDSSSMLTCVKASSLVLVCPEFIPSGGFLVSLTSKMKPPALVMCPEFLHSGGFVVLLASGVKPQTFAVSVTALKGGASGVVCSSWWVCGPADFRNEASDPRGIPVIHKFGLFT

SEQ ID NO: 924214 - protein, 157 aa, Homo sapiens
MEFFIHSFELLIFHYDDLMHEQMMWQEWLAALPSMTHPSFSVVAGGSCPHGPQFPAPQPAAIRVFYARFHGHKEVEAFRYCKEFRQTWGQESNTKSGPLYENGCEGEGKLLGGPALEVLMPVHKMSVAPPFILTKQFHKFAKYPLRNENEIVSPPTD

SEQ ID NO: 924215 - protein, 181 aa, Homo sapiens
MVMTEQLIGMSQGGAAKAACGKDPMSVRYGQHQCHHHGHCLVVTQRGRDISGNAAWTQVSMVEAAFGLLDLLQWLSGLLSQTEACTVGFPTFEVLGLGLGRYWLPCSSACRRPVVGLHLVTVTHHGSGGESASGSQPFLAVLAQPPIHIFVLILTTLYWHMLLLLMDGAFPGKAFQVFKVN

SEQ ID NO: 924216 - protein, 128 aa, Homo sapiens
MVWVSPEASMSEFHPSLQGSSFPSGPGVEKSYAACVEDGKGNSESSWPTLTENRKKPMLKFRGWVPPIPWLTLDFTQVLCLPLDSGCDFDSVPVQAAQFPSLTTVILLQSVKFFGKKVYTQQQKIRME

SEQ ID NO: 924217 - protein, 151 aa, Homo sapiens
MPISLQFGVALSMLGYPARRCLFCAMEPAQGKRGSPGSQVSRFPGKKMAVGPPSFHTPDPGGERVSPGILMATSLTGSEQTTESGNGSHAFYPLPPWWERPSRQSWEGPAGKGACDQMPLGPMTMSVRPVLAPNVHYVCKNITDHFATCQY

SEQ ID NO: 924218 - protein, 158 aa, Homo sapiens
MCTALNPATFLPEDGEPIKHDCQQIIVQTYAAQDDLLEVPLANPDINLYTDGNSYVENGIRRAGYAIVSDGSADGKCGVGASTQSPLWGTASGAVRSSSPNSGRSSRPHNSRSTESLHHVFGKATGTQCQPMKAAVPCGGMGTERPKALGVHSSHQCG

SEQ ID NO: 924219 - protein, 140 aa, Homo sapiens
MMSLGWALIQYDWCPYRKGKCHVRTQTYRRRPCDQRGRDWREAPANQGALRVTGNTTGRRAAPNISFSRSLGESMACRRFSFGLLASITGRLTGSAGRTLAALPGLAVPPVFDVYKNGILIKAENTKSCHLKDTYPFMKG

SEQ ID NO: 924220 - protein, 149 aa, Homo sapiens
MLRKVVAKRMARSEETPILDAPPSAREETLFLKTLWLQDAIPYSEPILTGITVERQRIVYKAWLCSQYFEVTQFNCRKTIPCKQYCLEVQTRCPFILPDNDEVIYGGLSSFICTDKREGQVMSLTSHSRCTRESEMQNDFTGLCVILLT

SEQ ID NO: 924221 - protein, 138 aa, Homo sapiens
MLMFELISGAHDTTSKRPKTGKIKSPPPANWRLMSWGLSVCPNFLSVSNNDICPIELGPTLKASWHPNNDICPIELGPTLKASWHPNNDICPIELGPTLKASWHPFEGLTHTYCEIHLHVSVLGVRASTEMSLFPMLS

SEQ ID NO: 924222 - protein, 163 aa, Homo sapiens
MALTLPGVDHPQRAEEQAHGKATDPLNTRRDTVSKDASASPSQGLHKAFLSRPIYAAEADWQDHHSVASAHSITVHAGDHPERGADALSNADTGRVSIPGGENSKCQGPGGQDGEARVGRGGYWNVQQGTMEAEASVASTEMVRSHRFLDTLKATWTRFADEE

SEQ ID NO: 924223 - protein, 150 aa, Homo sapiens
MHGCSPVSLGAVADVKSGPSHALSHAHAAPSATNQLEIKVGFETGGKDFLNSRALYVLAKKPYTNAKAPGSRLQEPSLFCKQTASFGFNTNTHKPPLVHKSGRESLGGDLDSVHCHFSDLVCNKIYIICSKSVMHKCHYHKIRKIGLFKK

SEQ ID NO: 924224 - protein, 191 aa, Homo sapiens
MVNPTVFFDITVDGEPLGSVSFELFAEKFPKTEENFHLLSTGEKGFGYKSSCFHRIIPGFMCRGDDFTCHNSTGGKSVYGEKFVDENFVLKHTDPGILSRANAGPSTNGSQFFTCTAKTEWFGKVKERMIIVEAMGRFAGNGKTSKKIAVADCVDGHLWHEDLMTCFRGEGREKSQNDFPRFYSLLQKCRR

SEQ ID NO: 924225 - protein, 199 aa, Homo sapiens
MLDPKANSPMVHLALFQPLLFSSSHWKEIKKRHHWPEETIRLYYKSGRLTLQAVHTFDDSECGQMCEFGPVIVSEGAWVQLSENPMGHTVRNTIPGLCNMSFSQLGISRTHFSADPSTQNKTECDTRVHAAGQSGGGEGLRAPGEESTPRLETEGVCSALDGDHSMGLQKLLPGPQDFVKGVWGASVEHLGLSKNFWGR

SEQ ID NO: 924226 - protein, 144 aa, Homo sapiens
MRTKCITVNRVSPPKCAAIVGLVSGVPDWWGIPCKCQFAIFIEWIGSFWHLWLNKKMKVEGQDMDFVYCYWATKKGCPRTEPRRTLTHSSCADLCGRCRCAQGMLPHGYHEKTPQTGWLEQQKFIFLEFWLLEIQGKDVAIINC

SEQ ID NO: 924227 - protein, 158 aa, Homo sapiens
MPSDTALAQDPVSQLPGAGASPLVSPPPELPLSMAVAFKAIPGPAVAARNALGMQILKPHPRLSELETLGSYKEGRKCEETQGENDCLQAKERGLEQTFPSQPTEGTSFADTLILDFQLPDWQLLHQAVDTPTQGLHMRVEKRIELVHFQKTPAVQEI

SEQ ID NO: 924228 - protein, 155 aa, Homo sapiens
MEPTCFFSQQEPSTDELFFPLWFYFEMILGVRKSYPSAPPGHPPGWEYHGSKSTLPLHNPALATRMFILPNSEPALQEFSFTPLLKSWESRFVLAIFQAGVNLPAGFSQGEGPTGGEWLRAYASCSLLSSVCISQWQALALSGAFTSRSSSADLH

SEQ ID NO: 924229 - protein, 176 aa, Homo sapiens
MLDRFHLQYTAGGPEQGVNENSIYEACHDCWVEQRGQPPGIGQNLLLCGRVEKMEHKGTHPCAQGLWSGKGPGGSRGSAGSGPDFGVEGPGWPPMEPLSPDLLLPHRGSGSSYRPDGSERAPAAGMERRRNGCGVSQSPGEQGGVCASLCFASNVGQETSRLSQLLRQLSPLKWLL

SEQ ID NO: 924230 - protein, 141 aa, Homo sapiens
MRVRGSHGAKHRCKEEELSGYPSRASRVRTETLSPEVTHHFYLRCIGWNQSRGPCQYQEVLRKREGTRNSLQMADWKVSPGLDVTLLVVHKHLIKDLCIMDLLCHALHHGGMREVAEDLLVYYTIKRETGVRGVRGEEFPA

SEQ ID NO: 924231 - protein, 212 aa, Homo sapiens
MKVVKGKQFSASMEGDPPAAHLVDIRNLKYDRVGMQLILAACSLSSDASLNGCCTEKPASCASSASPDLYETSRLRWEPAQLQQYQRHVFCHVDQGSEVRQRDKREKAKTRQRVIAELKPWNGAPWMGHCHGQGRLMTIAIFPWIVPQGASGLNENQVKTLSQILELLFVPLLMWSKNPNAGSRLYFILWSISLFIHSLNKHTYHVPGKRMQ

SEQ ID NO: 924232 - protein, 149 aa, Homo sapiens
MYKSKLATCCPNPCFIKCYFNKSLFSEVMIHVTQNMCSHSGRSKRRGRKWQQVWHREAQLLERGCKIKAIPAVTVDLGIDSSSTSVFSLSSKPADFKRGKSGKRQDPSVFISDDIQPQGSIACSGETHQERTVPQTGSFSNGSPGCANS

SEQ ID NO: 924233 - protein, 170 aa, Homo sapiens
MPGAGRVYYLYLSPERGILFALIGCLGYLCAQPNADSQAGNWKGPRFSVVEKSGVPSNFTWLSGRSQMVTCNLTDKCTIRNHHKWQERRRCQKKRKVGPACCSLKPAEWSQHCQHGQHVHLCLPNGLLLCPCWESLGRGSSCSSSLSLPALAFLGCSGLFQRGGPSQRGT

SEQ ID NO: 924234 - protein, 177 aa, Homo sapiens
MGVFTQCLYPLTIYCDYLASTFDISDSGIKCREYETPPFCLCQKTSYRCLSSISTVVFKSQNDSAQVGYNNDGQDTVRGKAGFKRGLEGAQTVNIQVRRKGFEPAVEGKQCKKLCLPLHEGKSWETVHSLHSLKGCGDTIPGELKIFMEMSCKYEVFCGPPVADTLSFVSGFTRRRD

SEQ ID NO: 924235 - protein, 336 aa, Homo sapiens
MYTYVEPSFSLVNLAPGLAGENLTYSIGELQISSELLLLVDLNLDFPSVPAAAVTSQVASDFRVSKEDAFTKQDKTGEALITNKQQALHQASQKDADFLVFICCLSLLELEAKLIPHAGDEPGPSCDDRLFPAKAEGDVAIGTCCEDTLGHGRWWDWNVKNPQQKASSLGRDSIAAQGWDYESGRGEKRQGYGAMPELKPRKLGDLNVGLYKKGSTSIWVPWEGFRQLPLMEKGEVEQMYRDHMMTEKQGKEKRERKSGGSRIFSTINSHGHCKFTESFKSAETVYHAIISKAIEMKAKGNASTTFIKKFIELLISTAGYKQRKQPLEINIKSSSP

SEQ ID NO: 924236 - protein, 119 aa, Homo sapiens
MACVHSQVAFRVISKEVGTSDASMAELFTSFTPRNGWYSKVQGKKMAPLTSRTPHTPLFDPEVLEPVRKDEVARLILNSWPQAILLPCPHKGMELQKHPYVLQRIPFFVDFLKPRHNSL

SEQ ID NO: 924237 - protein, 164 aa, Homo sapiens
MNLRRLEETGVFLPLHGFPCDSRSLSCGYQHLLWWREQETEVDSVRVFGYKPPAEKASRLTFPWLSQSLEQQSTSFKGSVDSLGFPGMFLQYFLEQKFTVWVSTCCSVHPSGSCKNAEVLMQVRKSISQLVCGSLDSAAGRAGPDSEVKAMVSLTASSILLGKA

SEQ ID NO: 924238 - protein, 162 aa, Homo sapiens
MSTVRRRERCFVAVKVTYQEDMTVINVRMLKKSFHIHEANIKKIKGRNRRTHIYSWRFSRLFHSNWAQNYWLMWLPVGKRMWEVSPHSPPLSCTFISGRQIPESVECATRQPWVQGEPQEVRPQPEYLLDAAVLTAFGPNQKCQSLMDDPSLGSLLCMDTVA

SEQ ID NO: 924239 - protein, 136 aa, Homo sapiens
MSISAVPNATSLVSFWLPGLESICPEGTVPNDILVQRWHECQVRKTGSTGRLRTLLAASLSASRMRSLCAGHQGRQLLQPHCCNSMAQSEPSTEELFWGLSLQQREECGGGKESTSLGHTLPGGLLDATTSAPPSC

SEQ ID NO: 924240 - protein, 142 aa, Homo sapiens
MKLLSPLFTLQLSSYLILPECNEKVRRAVALLGAQPSGFPDLDAGACNGSCLWYVWSSFSLSQSWHLCRHLGLPVLPQQPVCLAVYSGWTLRLLAHISLATLRLAHPWQEQPTSVAPKGLCSPTSFSSWCLAASAPAFDIHK

SEQ ID NO: 924241 - protein, 142 aa, Homo sapiens
MSLPQRSLILRLPKPSPTDRVAPTTARFSRSNFSSNSASSSKQSIRCATVQLLEDQVHRHVCWGDWMGHVWHPGWVEAAIMSWEDLVSQSQGIMNLTAVEVNKDARFMNLHGGYSCFLKEIVNSLMSETVACASFMGDAEKL

SEQ ID NO: 924242 - protein, 182 aa, Homo sapiens
MGMMRCEKEVTRGTVQVLGRQILGEQPKYGRHVRIYFPQTLCVASTHRIGSDIKVACVDSLLERALQHPSACCLPDTGDGRQQQLEQLRATEREHQTRRGGWRSGHDVPSAESRCQATALYDSLISVDVDPAHSQQPTCGELPLAEGGSSLGRHSGLHHIGSMGHGKGKKEHGHLVTKLSSS

SEQ ID NO: 924243 - protein, 142 aa, Homo sapiens
MGAQGWGRAPYTPSVALPAGIDWIKCKYLSPYHCILDSFPGQKAPGAPWFHTEAEAGLCPTQDSTFIPCPTPGNQSDQPDKLSHLTLFPPCQGTLCTQKTAQKGRPELQNHFCLFLTGMEAHFFFGGQSTESCYVTQAEVQC

SEQ ID NO: 924244 - protein, 164 aa, Homo sapiens
MQVSQLSWQQWHLLLKKLATMASPQTALLDDCPLCYPGSPLVSPGIYLPNRVVVRLSKPRCRELRAVQLRWMPPSLEYHSHPSIHSAIVFSGVSCLLSFLTEFAVLGCPPLTWLTSLSFKTFEMHLKCQSSAEADLRAPVCIPPCMLRVPLFDKGYLHPHVDYR

SEQ ID NO: 924245 - protein, 153 aa, Homo sapiens [sequence omitted]

SEQ ID NO: 924246 - protein, 151 aa, Homo sapiens
MTLPNPPLVIWAVMGGSQGLEGARLQIHIRITCGKCLPSYEGKTRAVYVPPVYSRDHLKRNGWTLTATLSSALEGGRTREEKRHEETLCPTHHSTDPTLGVEFGIVPEKRIAKISSMPFSTFSAASPTSSWGLILSFRNNSCFRATCHRVS

SEQ ID NO: 924247 - protein, 191 aa, Homo sapiens
MRWASRWDLVLSSRRRSPDTGQQLLWTGARSHRLSLSIALGWEEPAERLAVSGFEILPLSLSLVSSKLNQFLISVRILIPDWCRQSLGFGLMHLNPVSTFSGCMTLDNLLTVSWTSVSPELRQVLYYLSHKVAGRIKWDSRHKALDPFKYKAMPGLPSGEDPGDLSPSSLIPQEGSGQGRGIPAPGLCVPE

SEQ ID NO: 924248 - protein, 147 aa, Homo sapiens
MGEGSPALHRPPPGACTGHWLYTRSMHGVLALHQERARGTGSTPGRGVGTEEWLFWRAAAGRELGSLIFQPWPPRRSGVSPRAPEEDRALLSSEPAVPGGWILHKCQRPLRCKKQGALLRVCGETPPSGGQMMNSISLSFTYFYTCH

SEQ ID NO: 924249 - protein, 237 aa, Homo sapiens
MKDKSTKESQVRPWSALRREGVGASTENLITLFQTAEDSVSVSDAPYNCVIDCEEKAGTESGKGTESSHCKYVAESVMAWSTQNVDYNQLQERYQNLKEVWKKNVHSFVLATASLTLEGEAIKEEMKCEQWHEHLVREFLGYSWLKTGVTDDLQIIQLSDYSDILAQWPPHGPLQHKPFDHLAFHRLSKILSRPLHCASVKTPVALFDMPPFVLLPRAACDSSPLPVNTVEEQLSSW

SEQ ID NO: 924250 - protein, 141 aa, Homo sapiens
MRVSRMQSKRILGECLKLHVPVPALLAWSQASSMMMPLNTSLLASACVCELFWLLVVNFWPLTLPSPTLNTSPQHHLLMGACVEGKPVAASDPVGHLGTGAMVPGGFVEQVTAIIIITEDFCDMKLKSTAQWGPVMSSGDP

SEQ ID NO: 924251 - protein, 149 aa, Homo sapiens
MLLVPGPLRSRLRSVLPTSHHRDPASGQGQTSCLLSPEAQSSWLIPAWTINTRSSCAPPSTGVYQAPGTKCEQGLSKFTNSVMLLAESWLPFCHLLLPFHGYWPGGSCGAQHWTMFSRPIPVITLRDENGALWHGLASGCPSLYLLLLF

SEQ ID NO: 924252 - protein, 142 aa, Homo sapiens
MQLVLRLASQIHCEDHICAFHYDESKGRETVQNITEFKRLSFKAPHSSTPSQDRTPFTERAQSSCSNSCNNLQVGTQRGQTEEEASKSLDVPGALRGNECTFRGLKYHSSCLEPLMSMKSIHDKSRALGGFLHEFGGQTRIF

SEQ ID NO: 924253 - protein, 162 aa, Homo sapiens
MTHDITKTTQSINQEKSSIIQNEDRTRGHIRNATEKQIPPQKEQNWPQLQGICPSTMVNRSAAALERPDTLIPPGIPTLFHPQRSGWTLWPQMDFAGHVTDLMGQGGHLSYGDSIKISVCLKTSGASILFTGCTCPLNESSKPLIRETSSLWIQEEPQALYP

SEQ ID NO: 924254 - protein, 170 aa, Homo sapiens
MTKQKLHLKVTNRRPKNASSPPKDHNSSPAREQNWMENEFDKLTEVGFRRWVIRNSSELKEHVLTQGKEAKNLDKRLEELITRITNLQKNINDPMELKNTARELREAYTSIRSRINQAEERISETKDQLNEIKREDKIREKRVKRKEQCLQEIWDYVKRPNRCLIGVPDE

SEQ ID NO: 924255 - protein, 139 aa, Homo sapiens
MLENVFIQSHFPIYMMKNPPVMHSRELRDAPQKHLSLRGLNWWAEAGEQGALQLEHGKPDLLAIWNLTIRGSFSFGASAMLLRAALLSSWGTHHYLRTFPQSSNEEVMLAMGASLPYNTLTLGPVAVHTGSYLFVPAGL

SEQ ID NO: 924256 - protein, 142 aa, Homo sapiens
MPCENQCGIGNEQGSSYAYPKVREVVQRSTGGHHLICNSSYASMKVSQESVKQELKQDSAGLRLRLLLKSVCHPTDQESWSLHQQIQGGLERKEAHRQRLGHFTLQGVLKCTAPLTLDVKSSNIKNFKTSYSVYLKIPLYGV

SEQ ID NO: 924257 - protein, 148 aa, Homo sapiens
MALLHTVSQGPKSFQFVASPSEGSGSQPGVTLPPGAHLAMSGGWPLRQSIFLVQNVIGAKVEKRCPRDVSSSGARTSGEHLVSHPVMVALVKFEPYICLLAHDIAEASMGLIKLRRNKHSPNLLLRLQILLSSVLLNTPLSVKNNTAK

SEQ ID NO: 924258 - protein, 149 aa, Homo sapiens
MAQSVVGPHQGIHSAFLSLSWNLLRPHHLLLTDLSDLLPTQNLFFQPSPFTMITHLVSFLSPQLLDRLSLFGAHLSCEANTMERTGSCCACPDLLWPHSPWTSPERAGTCGHSFPVRALLWMMTGAAQVFAGASRAFDTIKKTESILNV

SEQ ID NO: 924259 - protein, 257 aa, Homo sapiens
MEDLRGGFKELNTHEYAHPISHIRADRSPPLGPRGPVTLAAMCILGRMISGERPPQTCGGSRKFCKGDESLEDGEPCGWPSEVDDDQLRTIIKADPLTTTREVAEELKVDCSMVIRHLKQIGKVNELDKWVLHELRKNLKNSSFEVSSSLILHNNNEPFLDPIARCDENVGQQKGPNSSPPQHPTTCRTTNASKVEQRDVKFCLVCHIHLTSCQSTITSSNISTTFCRENVSTTSRMQKMLSKSLLNPEAWVFMLQE

SEQ ID NO: 924260 - protein, 146 aa, Homo sapiens
MEGGFSRLGVQGIFRPPERIREGGRRWLCDMWLDVVVEKNWALSVDQRWLQVLQFSVHLMDLLRILLRCNGFPGIQKAVVDQTSSRPLNSDHDLFLVQVWLWEVPWSFFSVQPLSCSLPVFSRCIKSTFHHTSQSDPEMVHCCCVE

SEQ ID NO: 924261 - protein, 153 aa, Homo sapiens
MWRKYWYLCTMSPDVGSSGITFHWLCNFKKATDEEGTHPTNGNNETYATIMSTIMRMFQEAKSHKYFDLETEWSAGPTHHLMDEDNEVSKKRLRRHPYHELAPVATKHRCIPLVCIWSTKMKLRLQDNAEFTQHVAVIQRQNCFRKLGKEFQL

SEQ ID NO: 924262 - protein, 165 aa, Homo sapiens
MGPAPSLPTGPANLCSPTNPLVTLCPVSPASYGLGCGLPQKAPLKEEDMRPSVLPHRPRHVYRFWPSLLQGSFFIVPFKWSISRTMPGELESLELLRHTVQTFPPLPVLVQAEAVESALREEGCEEENGRETSAEVADVMTRTQLTAAGFEDGGWGHQPRNAGGL

SEQ ID NO: 924263 - protein, 156 aa, Homo sapiens
MELKSTISCYFTQRALSSHLPPLQTQFSCPGLQLCRPQDFRGTRLSLMFRTFCSHAFYRGGFQWGMGQQFLLAGDVCQCLETFLVSQQQLKVGVVLASSGQTEIRDATKHPTTHTATPTTKNQPAPNVHSAEVETPCSTTANCVFILSDKCLGLYC

SEQ ID NO: 924264 - protein, 137 aa, Homo sapiens
MEVWGQIVEVSNSSTSRGHFEAHLKAKITPHTPNCRRDLEGPPSPSQAKVHLADSFSQWYSVGFSKASLGLLDRASQKGVAVFAPCGPQITGIRIVSGFFHLQIPSPTHPGLTNENLNFHKDFPLQMILMPVEFEQQ

SEQ ID NO: 924265 - protein, 144 aa, Homo sapiens
MCVPPEAVCSVKGDDHPQQRRTGLRLNVTSSKRPSLTLSQSKWHSLLSPYVSVTVLITVFHGVSEDCPCIAWPPSPCVSVEETGTLAPAVSAQQSAYGKAGAQDFLDEGVNCPYLCFVNFDFPCLRPLDLDTDLKSSCDEVRPI

SEQ ID NO: 924266 - protein, 138 aa, Homo sapiens
MDEGDVYIHRGEHKGPRANKYLPFIPNWSYCLVCLIKTTFFTHYEISLVPGFSYPLMALWPFPEILELSYKLFVHGQENPTTKQPFLLIFWLKMFYECNGFQTCLIIRNNCGGVESYSKLLSQTFGESSKQKWLLLLR

SEQ ID NO: 924267 - protein, 135 aa, Homo sapiens
MGDVEKGKKIFKTGQAVGFSYTDANKNKGITWGEDTLMEYLENPKKYIPGTKMIFAGIKKKAERKMIAYLKKSYYSTSNSTSLAVYTTCTDTSSTEVLNLSKSSMRAGISFFLTPVNVGILTSSHELQMSFICDS

SEQ ID NO: 924268 - protein, 209 aa, Homo sapiens
MAHKPNVLHYLDLYGKNLLTSDSTQQPVIFSKCNGDGDSGDGGGDGNGGGSGGVDGGSSTTIMVVVMMVLVVVVVMLVVIVMVKLVLVVVVMMVLVVVGVLMVVMVMIMVVLVVVVMVVVVVVVVMTVLVVVGMVMVVVIVMVMVVVVETPPDSPCHPPGSAQGHSRVLLGHPVHGSVVALAALNYAFLFMYASSPPDCELVMVKKSCP

SEQ ID NO: 924269 - protein, 150 aa, Homo sapiens
MAGCRSRALPGREAAKALREIYRSAAAGPGAKPLIPRGRQGWPAAPSAGPGKPTLTRNSSWPGKRRAQPGSRSRLSLHTSLQAEGAGSGLGQPRKGLPQCSGGLKGSSSAAKVGIQAEEAPRANEGCKDCQHAVTSQYRLFIYFETVYIT

SEQ ID NO: 924270 - protein, 132 aa, Homo sapiens
MTEGVPTQTNGIAYCTPKLCGVAYRSEATNLYSINSGEPPPRCGHNRQRSIRFPQHRHVHTGTWAAGFLISDTELLYNIKEGFVSSGKWGTAGGMWPSTQMKTGDHPLGHTWQGYGQSELGWPQAPKLPSPR

SEQ ID NO: 924271 - protein, 151 aa, Homo sapiens
MPALPLLLPWRLCFWSAALTVWISSCETLQGFSLSSKQTLSSLFLLRGLPCSTPSKNVGLWSRRIKSELGPVVLSYSKLSQVENRLTLGPSEGRTNAGEQMLEFRLKTMNPYSGLRGLRHLSQPRPPWPHLPLSRPDSLASWPFRLTGMLP

SEQ ID NO: 924272 - protein, 153 aa, Homo sapiens
MSNKFIPGMWQNASLIPERDLLRKKQKQKQKQKPKKHLGSSRIRKLDLLMWKRVSVIPKAERANISDVKSSACGSEGMGHGPGGSPCLRPARLGKMIHSSPPLGTRRAPRLLEDSQTTKTCLLRSISTNPSLMLYKSSVSLIRNPAAQVPVWT

SEQ ID NO: 924273 - protein, 135 aa, Homo sapiens
MEFYFGEDSRGLWREMLNSPGPQPMGPLLTAGQGGPDPGDSARVALTRRDGPWTVSLGGAWRGNGADLSLSLGWLGRCAGRWHTWEQVRSANRGGRPRRDAGEPQRLLLAPQNPGWPSVERDAFCGLYRLHGPIH

SEQ ID NO: 924274 - protein, 186 aa, Homo sapiens
MTTEMKCALLSASHQGVHDTIVTLLSTPWLFGYGASSQFLYYKANNLGKYSEIMQSLSPHNFPLGFSIHQLLLPTAFFLGALPTAAFLLLSFLLCLLTGPLLLSCLCLHVGSLWACRQRNPRTFTDKISNICKCTVYKLLSLTLSHLISSHEQLPRKASAFWDPCNGHFSSSLSGTSNTVLAESSC

SEQ ID NO: 924275 - protein, 170 aa, Homo sapiens
MCIPLSPLTSRSGLPRTVFSPGWAQGLCSHYHNQIKNISVTPKVSLCSLSILLHCQAQAITDLLLGTITFLEPHERDGWVKDMNSVKGFDAYCQTTFQKARDDSSPIGSSQALTSELFLTQFLLNVYNCGGVFQFYRCMESALCGEERQLMDPPCLEEQHRGEAQRAGRQ

SEQ ID NO: 924276 - protein, 154 aa, Homo sapiens
MISAFPTEVPDSSHWGLSDSGCRTVAKERGDRRHLENRVTPTLILRFSDGLSKWHTRRLYSPPGSEGPTPTEPRSLLAQQSEIKLQGSCESRGGAPMNAEARVDKTFRGTIRQQHLLCTNIRCSAASAADTQANRVWSGPPANSNRPAAEGPEC

SEQ ID NO: 924277 - protein, 166 aa, Homo sapiens
MRRFFANKRSQLHPALLLRVGSRSCSETGIVTSVKDIVAHVPDSQLTLGHMEEHSFTEPILIPKKDGLGLAVPAPTFHVSNVEKYVEVSSSSGFHLGSSQCHRHQQCPFYVPLQLQIYWAQCSVAGTDVTKQKDCKMKLQEFVDYDYITNHKRVLTITNLEFFDTQ

SEQ ID NO: 924278 - protein, 173 aa, Homo sapiens
MSSFVEPPDTMKKLFRVENWPDDALLAKPKVTKSCLICVKDSYTDFHIDCGGASAWYHVLKVSAGSFGDRVLGLAGPRQGYSPVPRAVSPPRDLSASLTCLLPCPELNATPAQSLQRGPQWSCLVSMGTPHHRGHLGAAQPALTELSWAPSPAASQGGCPLVHFSYAGPSGEA

SEQ ID NO: 924279 - protein, 138 aa, Homo sapiens
MGQTASSGSLTPKRPDWERPPNRGRQTPHTGELWLASGQCPSEMKHPEEGAGSNLCCSSASTVDTQQTAADLQKRGLLEEKLRNRKQQYQHQQQQQQQQQKTHRETSSKDHQHQRSKKVGNNKLLCAKGACTNQMQGS

SEQ ID NO: 924280 - protein, 141 aa, Homo sapiens
MRTSSLTLVSSVASLSYSAVATKTLFLVFKHSKHVVAADLGICSLHQESSSSQPEHPLHLEFSFQQSGPSAAGLLEFARGPLQTLFAWVSAAEDAEQQILLPDPSSESFVSEGNLAVRGVSRSLLGIISQLGYSGLSDKDV

SEQ ID NO: 924281 - protein, 157 aa, Homo sapiens
MSPSWIKCTTFHQKRQTRPGTPCFCPHGCYISDTEVRQQIHTSIIKRQESLYWGLVSSWLNSQFLNCCYHAKATTDNQYKVLGGPVEKKEDDDHSQGHAMSPFLHLQLLQNQEERAILFSSGCYPFLVVCIKEQKDEAPLLFAWESRIQQALGKYIL

SEQ ID NO: 924282 - protein, 139 aa, Homo sapiens [sequence omitted]

SEQ ID NO: 924283 - protein, 176 aa, Homo sapiens
MRQNFIAQFIQLLKCWLCNVLSVVVVEKNWALSVDQCRLQAWQFLVHLIDLLSVLLRCIGFTGIQKAIVDQTGSRPPDSDPDLFFVQVWFCEVLWSAFLVYCKRISFDDCSQLVITNNFWPATTLLVFKAVVSFAALLQPPPHSSWAKCVVDLSVVLKLRNLLFSSKGEGSSSAGP

SEQ ID NO: 924284 - protein, 218 aa, Homo sapiens
MAITTTTATSPNMATFSTKVTILATAASITTTNISIRVTIPTTATFTITATNTTTATILTMAAFITTATTAIFTTIATILTTASNTTEVTTPLTDAFITTVDITISHHPLTTVTVTTTVTTATFTTIANKATTASTPTTAIFTTIVTFTSTVTFSTTATFITTPTIVTKTTTATILTTITLTSRANITTAVTFTTMATITSTVPSSPEPPSPPPLTLL

SEQ ID NO: 924285 - protein, 135 aa, Homo sapiens
MHAHSQFCMSGDHTLEGTEHAIKEIVKEEADEYFVIVLSDANLSRYGIHPAKFAQILTRDPQGNGPTSTGKRYVAELAGLPGMPNIRYYTGWLNFIKCHSKARLHWHSERRRSFEENCVLQFCCLQNGLLFQIIN

SEQ ID NO: 924286 - protein, 148 aa, Homo sapiens
MGALPSGVVRRGPLSSRPQSGRSTNSLHHAPGKDADTQFQPVKAARMGAVPCKATGVELPKTMGIHLLHQHDLDVRHGVKGDHFGALFDCPAGFQTCMGPVAFSFWPISPIWNGCIYPMPVLLLYPWRKLTYIRFDMLIGRRDLPCLR

SEQ ID NO: 924287 - protein, 152 aa, Homo sapiens
MPLQEVASAQFHGPPTPAILHIPAQTTKIFIITFEYPGVDNSKLTQTPSFHLQGHLVSKNWKTGFQVYQTPKICTLNPRVSQQVEHLTFMSDTSIKLECKSLLWCIPGPPAVWLVWFRAFVEGSGLLRRWLEKEDEEEGEEEEEKRNLTTCS

SEQ ID NO: 924288 - protein, 195 aa, Homo sapiens [sequence omitted]

SEQ ID NO: 924289 - protein, 156 aa, Homo sapiens
MFVITDLLKPTAVNLSKSFSVQLCSVAGKELRSFGREEALCQEPQLQVFWSLLEVHSRPVCLGITSGGCRTANIAEQQILLPDPSSRSFISEGHLAVRLEKHSIKAGLFQYSGYPVWLPLARKGKSRDHLSFLGIAIDDEDSNSEQYSMNLDFDGV

SEQ ID NO: 924290 - protein, 136 aa, Homo sapiens
MKTLFSELGNVLRIIVAAECHAKFQHKSCFLGIVFFHVLIALKALCCLHVYFICWVGCLIFTLTEFARYSLRESCACDMVQNNSTFEKGELKCSFRHGPPVQRLWCGPQDTQGCLKADVSRVGHQKRQQTNECSDV

SEQ ID NO: 924291 - protein, 156 aa, Homo sapiens
MFPLSHPAAAPHPQIHKQPTQTVHFQKSSLLTAVQHAEGPLVSVLSEGGYVKGKWPLTSPKQLQWPSPGFPRLRGRMANNTMEPARPQAAPAAALAGHPAGTLDLLGAVGIRVSRPLFSSSAISSSQRDCPAAALGPGGSCRSQSLPLPSSLFFSS

SEQ ID NO: 924292 - protein, 139 aa, Homo sapiens
MSIPSSSSLLRSGDAIPAQPLGSLVFRVELSQKASVWRGPFNFFEFQQKVLSGRLTSVQFKTTFNKLILHSYTKSTTARYFTIIKQNKFQDNLGLLDLLESDILYLPQKPAFKNTCQSPVVDYKPPSKKEKNKTTLVCG

SEQ ID NO: 924293 - protein, 173 aa, Homo sapiens
MKIKSNQSRSRGLLSSNPNLETRNHIPITSVYKALLCLWDYILCAGLREHEEGAICHTLEAEACTSAARLTVVGGGDGNCRSARVVEKLLQGFSGFACPAAPCLARGEGGATCGTLEAGACRWHGSAAHLAAVGGGDRDCSLTVVVVTRSSATACPLVTGSLHHPSWVAAALT

SEQ ID NO: 924294 - protein, 143 aa, Homo sapiens
MNSKDKFDGWVCSLGDWREGGIEEAEAARMSSRAGPIAGNATEDTVQRKSGCTRKEGRLPSSLENLFIVDTEWEGPASRSGCRAEFQEGEGWELLTWPWVVAAAEASNEADASLQGQSGAARSEEQPRREPGEGCCLANRPGL

SEQ ID NO: 924295 - protein, 135 aa, Homo sapiens
MRFVKWTNQHPVKWANKHPVKWTKQQDEGGEKKGNKSWPPQPAEATCSAVTLMVKVRGIILQVSKNTNPLQKLQTRLKEQTPDTPPLRAVNTHHEGNVQLEILTVLTKINQWNYILNHSKSCILRALIRFSTEKC

SEQ ID NO: 924296 - protein, 143 aa, Homo sapiens
MVVHLIFGTYEASFVDSWPSSAGFLDPSVAEGEVWGTDKRKDMPRSNSTHKLYWVMAGWVCMWVKSLTVAVCPNEWHRCPNTEAVEGKEASGGEAVWTRGLGDNNAGTRRNAKELKRCPGSIPGTLNSRSGLHYKVGLIWKFS

SEQ ID NO: 924297 - protein, 278 aa, Homo sapiens
MPHLATLGKRWHQEAEGVRGKCGQKSLLWFPQEVTGKEGQTGLVLMSSSNFSTLWDLGAVPSCLVSGSGDAWEAARNPENLTLKYWGPYVSGIGSFRWVLGLTDFKNEATDTRGVKLQTFAVSVIAHKGGASGVVRSSDGFMVLLTSGVKPQTFAVSVTALKGGASRVICSSQWVGGLADFRSEAADPAVLQLIKQCCFQFLLSPEPKDDSNKEGDSFGNKRSSYAVLKPTPAPSGSFLPWSELFQEASQLSCNGTYLPSTGFLSLSTIDVLDQIILC

SEQ ID NO: 924298 - protein, 248 aa, Homo sapiens
MPALSSETLNSCFGWYHSFQCDLPYLLRHQLARSNTDLQGSPCGCEFPEGAGKQTSLAGSNGKAEGTRTYAIFTADSHSPLTDDSYPVITVAHKCPAGDERRKVQCSKAPLPHSPKYIGLLASSVPCRTFDSLALSSDQSAPIPKLWLQPDPNLQVPPASLTVFPPHIDRTPLKPVPPRKPTWVENSDGSPWKTDISGFSLVLSIVSRLQHRSLRGSRTTPSLPQSNGPGVPEPVYPHSSQTFKMRTN

SEQ ID NO: 924299 - protein, 159 aa, Homo sapiens
MMVLSNPRDDSLHLIDIMMQSRYTGPGNTGTEEVNFAVPHSLPDSGPEVHSICSHSHCQSQTVRAMGETVSVLRMDALEFNGSSCSNHFLLHRKSPLRVKRMLKYSHPVSFPLANPFLLWGFPGQFLSPVMLVILRMMEKGLLEPPIKYVSFRIWTFCL

SEQ ID NO: 924300 - protein, 142 aa, Homo sapiens
MVTLTCQSSHNPTHTVTNKIRKCRSSDVNSKEFPEHCSREPWRRCHLNLRHSQQKGNFITSEKKALVQQDVTISELQMCTSNGKTQLKQIIMDKVIQSEIYAEVCFLPKYSPLFTMWYYGEQTSSTQTSLKIHWVAFIPFFF

SEQ ID NO: 924301 - protein, 224 aa, Homo sapiens
MYIRSVCRKEGFAWACCGEALCEQGPLEDDRWPAAIGAGADPGPVRGDLGHTLRTGHFSQVKKICISCPGHNALELVYTGWNKACTAHLRMCCKGCQPCWEIAASLSFLSWLWLWLPTLAILPQHVALQTVWHMNCDDVFPSWISAESRLSILSLGSREGGVCIPDFLEEMAVVDVVFSSSFDSTILTPALAEVKVASVPWLVDQRAPWDPKEGGCRPDWEEIW

SEQ ID NO: 924302 - protein, 188 aa, Homo sapiens
MGVVSPCCSHDTESGNILEGSKENRKMWESLELPRDLNSFDSDPENEDQAEVISDEDEELVGNWSKGHSCYVLAKRLVTFCPCLRDLWNFELDRDDLGYPAEEISKWQRVQQEAELQSLENLQLDNALKKKNPFSREKFKPATEVCISNEELNVNHQYNEENVSRVCQTLPRQPLPSQAWRPRRKKWF

SEQ ID NO: 924303 - protein, 149 aa, Homo sapiens
MPLEQAKDGDCAGSTLELLLGTLTGALHCPCCACLLLPGKLKGLWSRPAIGSQEPRLLVTPPPLECGLPPRELPRGEAHEAWNPEPKTCQRPLCKPGRHPPESGLERAPAPAPDPADALNDTPRKALSERTQESSQGLGAGSVNGAVSG

SEQ ID NO: 924304 - protein, 178 aa, Homo sapiens
MSGHSDPGGFDDYKEKIKFRKKEEKGKRVLWGYEKSRGREQKQFCNEEVTWPMAVEEERTLSTREPDEEGVRGSRAPLALAQPHRSPAASRSLKVAASADFLILLFLDGPGPKARGAPSSLQAYARAVALWFLISSGSPLEPVACRGSGLPGSRSLRQEAGQVSACSSSYWQAPRMEG

SEQ ID NO: 924305 - protein, 157 aa, Homo sapiens
MSSPTQQRRSPSRADPLTGERTNERTGPGQAPCPSLYAPFWALSLVLSLPQKSDLSHLDSHIRLSPAPECPNRHCSLACSHLKAALVTDNQPSHLQKAGPGSPVTVSFHTLPLSPYSCIQRPPFLTVMPLFCSALQPQGPTCQVLCPAHGKCSIHIS

SEQ ID NO: 924306 - protein, 134 aa, Homo sapiens
MLFINLHITTVLQGKHGYLQFVNKKGLQRGSVTCPASHSQSVKSCLQRFLGARRVCFSALGQAPQLLHNCPCLSSPLSCSASHSYLLFWSPKAFEQVIPIPNPSARATADLSDVDSSVSLVLASQPVHFIPLPM

SEQ ID NO: 924307 - protein, 137 aa, Homo sapiens
MACKDVTNKCQIAWAQAGNAVDIQRTGTSEGTSVIRLHKIPEKVLQTGFLGKMKTVLYLAPWKLDLGGCTRCKSILVTRQSCGLAQQVPTHLSGSTVSVDCSLVFPLLLLEGLLLSVSSAEVSKRGDPIESTSVFIV

SEQ ID NO: 924308 - protein, 146 aa, Homo sapiens
MFLTLCPSVLIVQFPPMSENMWCLVFCPCDSLIRMMVSSFIHIPTKDMNSSIQDIGMGKDFMTKTPKAVATKAKIDKWDLIKLKSFCTAKETTIRVNGSIVEMFRLYSTSVSHEVSPEEWRVSLFAKMPCFEYCSDSIHSYFLSQI

SEQ ID NO: 924309 - protein, 136 aa, Homo sapiens
MPPRAGAVECGEVVNDAKSKMRKTCFPTLLLRFTGKEHCLLEITYGNAIFTAFLGLMPSFVSWVEGRAKGSEGGEREDYVENGNFYHHPAIMRPHTSHGDIRDHMGSSNEAPLPRPAEVLSVEANWGVPKYHCYQQ

SEQ ID NO: 924310 - protein, 213 aa, Homo sapiens
MTSTPSACDLTLPDVTSTPSACDLTLPDVTSTPSACDLTLPDVTSTPSACDLTLPDVTSTPSACDLTLPDVTSTPSACDLTLPDVTSTPSACDLTLPDMTSTPSACDLTARRDLHPYACDLTLPDVTSTPSACDLTPSWVLGSGCSPARRLQVLCKDLTAEDKPTSEETDAPLADTKDKMPLEKQTPVIQEQDDKCDKLHVCDKAVFQMRTIT

SEQ ID NO: 924311 - protein, 149 aa, Homo sapiens
MNWASVVTHACQLAGDGLLKTLLSLLLEELPRGHQEPGDRSQPLPPNSSNLCTLPSSKATSTSSGSAAMTGLGKQMLAGHRASLQVVLEHLNPSWCPPGTMTSSPECGFAWVQTEPAWDALGQGRLFCVQAVLTPCPHRKRQIEAAESA

SEQ ID NO: 924312 - protein, 143 aa, Homo sapiens
MTSSPECGFAWVQTEPAWDALGQGYWGLSGLLQLIQRHPEPTYLNLTLIEDSSVCRLSSHPVLTGKGRLRLLSQPSSTPEAKECCYCKLQTTHLVEGSNILNPGLAKTYPSNSSDPPTSGPSSQPLCGWLLKLRKASRNVEIQ

SEQ ID NO: 924313 - protein, 178 aa, Homo sapiens
MRVPTTRAALCLAEFSEDARSDQRPVIPSSRPRVAFSMSVVDLDLKPYESIPYQYKLDGKIINYYSKTVRAKDNTMMSTRFKESIAAGGVMDINTALQEVLKTTLIHDGLARGIHEAAKPLDKGQAHLYVLASNCDETVYVKLVEAICAKHQINFIKVDDNKKVGEWTIPFEDSSPSL

SEQ ID NO: 924314 - protein, 160 aa, Homo sapiens
MRLIHCHENSTGKTASMIRLSPTGYLSQHMGIMGATIQDEIWVGTQPDHIIRVVQETPWGVDKSTFLNKALRMWGAVPCPLLQLPLSTLSACAPATLPTSSSLNKLLPTQSLHSAISSPWNNALPPCCLANFRSLLKCYFLGEETLSLKLFVFFSFTVLK

SEQ ID NO: 924315 - protein, 196 aa, Homo sapiens
MAMTNTNSKLSINTVKKTASQVSFQCVKGPPFPPLQTVMLVSPGVQDRLTRPRLDLRPCPDPRPCPDLRDPVQTCATPSRPVQPRPDPRPRPDPRPGPKLCDPIQTCDPVQTCDPVQTRDPIQTLDPVQSYPRPRPDPRPGPKLCDPVQTCDPVQTCDPVQTRDPIQTCDPIQTHDPVQTRDPVQTCVCSGGASQH

SEQ ID NO: 924316 - protein, 141 aa, Homo sapiens
MNSTLDALADSSLDVSVVLPANAAIILRPVLEEWPTGNKASVEHVGGFQGTAAGSLGSRSLQGLLLVLSAFKAVASLLPQLSADYLPNARAQRFPATAVRYSLCRQWGLPANQAGAGKAVRWLQLEGKLLCSAAQMQVRDR

SEQ ID NO: 924317 - protein, 161 aa, Homo sapiens
MGHINGSAVWGQDPKTPGEVNIHLRLSQVVQAISGLTALPFRNALLSALAVARSGLGPRRAQALVTGDGAELPLRESWICAPRHGKGIRTPADLALTERRWGPWKGTPPVGAKSKKKMTLISQPRAGRKGGVGVVAPCPSSPTPTVRAHSPGVTRDVNPQA

SEQ ID NO: 924318 - protein, 195 aa, Homo sapiens
MAKHFSFPSPSLELSFFTSISIKILPTKLRGYVSRACFFLTFCHDYNETEAKVKMTISPSLRRSWEISPRDHAVLSLITASESLLTQCSVLAAIQITNQDEELIVGSILGSLGQSHALFSPMFLMVMENNGLARTGSAVRDFQGDSHRNSPFDREGSECNGGEAFSPQLQYSPGLAASCGAAAATFSTMKEAAWS

SEQ ID NO: 924319 - protein, 160 aa, Homo sapiens
MTLPGFGFPPIPVPSSISWNNFPDKLLTPKSQDLLHGHLKLRGLSSFPSTCVCPIQSSVCVPAAEEKRLLRATSSTDRPQKPKHEVRLKTGQAQALPSQTQRKRVRAQQRNQIPLEIAAPRRVWKASPNKAAPEDLKDPHGPHLDGDANKNLRTSSLQAL

SEQ ID NO: 924320 - protein, 118 aa, Homo sapiens
MQDVRPKDTLVLPLESPASFALCSSVCLGPGDESRWRPSPDVPRLLCVGKGGEAAGNWTLLERGRASGLWVLGLGTVLPSLVAPSAVDGVGILGALKKRNSTNHLEDPGSSGAPWSLR

SEQ ID NO: 924321 - protein, 141 aa, Homo sapiens
MPVNLTRQARPCISPILCDVGTQMQAHPHEGLTSASPVPGSSRMGSPGSSTKHGAGLWDRLLRQPCRGLADLLGNTVGEPHLLIDKMRKISSSSQVFLRIEGREGPVQKRLVDLKVSMNMENLKPVVSWRSKEGRVLASCP

SEQ ID NO: 924322 - protein, 186 aa, Homo sapiens
MLSQLKPFSALSNRALTTPKALEARAAFQDCCKYPLFPYTAPLRGASWYVPLTIRILPGKDSCTQDSEELLRVRNRQWEAGVNPEGLFEALTSCQGRIEEVRTQESEWLKFEEGYRPCPGDSEKMAINEELALIRHQICQHLDLGLPSLQNSERVWSSERLQLKLLQALPHCRELPLLMSALPGSE

SEQ ID NO: 924323 - protein, 287 aa, Homo sapiens
MEQEPGAVLTAVHMEQEPGAALTAVHMESEPGTALTAVHVELEPGAALTAVHMEQEPGAVLTAVHMEQEPGAALTAVHMESEPGTALTAVHVELEPGAALTAVHVELEPGAALTAVHVELEPGAALTAVHVELEPGAALTAVHVELEPGAALTAVHVELEPGAALTAVHVELEPGAALTAVHVELEPGAALTAVHVELEPGAALTAVHVELEPGAALTAVHVELEPGAALTAVHLELEPGAALTAVHVELEPGAALTAVHVELEPGVALTAVFGSPELCPEHHDWAQ

SEQ ID NO: 924324 - protein, 130 aa, Homo sapiens
MCPCGTIHNSKDMESTLMHLSGGLDKENVVPIYHGIRCSHKTEHQTSGPLQQHGWSWRDGAGGRHPTRINAGTENQILHVLTYKCDLNTEHTWIQRRKQGTLGHTLGYYSDDLGDKIICTPNPMTCNLPM

SEQ ID NO: 924325 - protein, 183 aa, Homo sapiens
MRLLSAFRNCLGNGSQDLLTQRIPQTFQPFLLGGLRGLPTTASVLWCPASPVRLDCLPQLTPICGSPRPVSTVSCLHPLLSLLHWRLPSSDTQACLLPHRLCAGCSLGVPGPCPLHAPGLSLLSRSPPHPSSPALHPTPPFPPSTTPLLSGSWAPPRHLRLLSSAKCTICSSSAHSLPTGRPC

SEQ ID NO: 924326 - protein, 154 aa, Homo sapiens
MQRVRSAEEVMENEVNKSYPWTLDAWEGLEPSGRRRRWSGSSRRPAPTGAAKALGLSACLCGSCWIQNRLDHLKSYLIPADFLRGQPGGDIIGRHTGFRIRGQKCGLSQPLTQFCSLAKPFAARAALSVSGGGQLPSQSPGGGEVEGPRGGTLQ

SEQ ID NO: 924327 - protein, 151 aa, Homo sapiens [sequence omitted]

SEQ ID NO: 924328 - protein, 132 aa, Homo sapiens
MAGRSRDPQSRCGAGARSSQQQVEVLADTANPGPQSGVSREAGHISEQSSELSVRNSHERTTCPGYLLQQGERQTYPGKRCKNGQRLHQNFLLETAGGMVKMRRRPQPTAGKRTAKLTPQLGRLMAIIIMPT

SEQ ID NO: 924329 - protein, 405 aa, Homo sapiens
MKLGCGGSENPVLCLSLSLEWEDAEDEGMKTTGGVLQVASYLNLASYLNDASYLNNASYLNLASYLNLASYLNLASYQNLAFYLNLAFCLNDASCLNLASYLNLASYLNHASYLNLAFYLNDASCLNLASYLNHASYLNLASYLNLASYLNLASYLNHASYLNLASYLNNASYLNLASYLNLASYLNLASYLNHASYLNNASYLNLPSCLNLASYLNLASYLNLAFYLNLAFCLNDASCLNLASYLNLAFYLNHASYLNHASYQNLASYLNLAFYLNHASYLNLASYLNLASYLNLAFCLNDASCLNLASYLNHASYLNHASYLNHASYQNLASYLNLASYLNHASYLNLASYLNLASYLNLASYLNLASYLNLASYLNLTFYLNLKSYLNFTSYANLTSYLKIH

SEQ ID NO: 924330 - protein, 181 aa, Homo sapiens
MPSPPASPIHAHGHTVPSLTKQLSAVSGTDLMMGWKRIGGPAAWLALKTEDGAISQGIQMGLEIGKVKETDAAPRTLEGTQPCGCLHFIPWDSDQTSDLENSKKIRAKMLSLSLLATIPKYSFICSLFSKYFLSTYSVPGTVLGTGDAAVNVMLSPRFLQISPVLQAVLVSGGFCNKYYRS

SEQ ID NO: 924331 - protein, 285 aa, Homo sapiens
MHRCPRPSGTHEGTNLQMAQNLSRDVEKCKAPEFPPVFTGLRVKRSRCWQSGSLTWYSKTLTVPPWAESPQGWLDQDVPPALKHTWGHMLANGSTLSRESESCGAPSATGAREVAGAKCLWVPGVLRAEWLQARVQGPAREGTAAFPKVQGPLQGFFLWAMSCPCRVLSMWPLGWTPASSPFDMKQRCWASTHVVPLVSCRACERVRVPLSPTGLQGSVSRVCRLIQPSSRAPASAPGLAFLTRTRDYRPLTKYGLDCDTPGSQFPARSGLPHSRTEPGDGPVCT

SEQ ID NO: 924332 - protein, 192 aa, Homo sapiens
MAQFSGAQSPTHVPAPSPPRARKVILRTQGPGGSGHVGRGRARALAAVTLGTALHCATWAGPGPPVSVAPSDSLLFKLQQSHSRLRHDHVSHTPSDGHLADGLENRSHQSRCLRAPLPVPSSVSVPNMLPPPKKNCPCRQPRVPLTCGRPHSSRPPPGYQLACIGPLVPSACSSTVGFSGCGLSVSLQCILN

SEQ ID NO: 924333 - protein, 741 aa, Homo sapiens
MEFRVASVDMPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 924334 - protein, 156 aa, Homo sapiens
MECCSICLYSLYFLEQWFVVLLEEVLHILCLDGIIGEFYQTFKEFTQTLLKLFHKIEEEGTLRSSFYEASMILNSDKDIIKKENYRPISLMNISATSLNKILANRIQRHIKRIIPHDQMGFILGMQEWFNIQKSITVTHYINRMKENNPMIISIGA

SEQ ID NO: 924335 - protein, 242 aa, Homo sapiens
MWEEEEVEEEERWRRGGEVEEEERWRKRRGGGEEEEVEEEEERWRRRGEGGGGGEEEEERWRRRRRRGGGGGEAEERRRGGGGGKVEEEERWRRRRGGGEEEEVEEEERWRRRRGEGGGGGGEKEEEERWRRRKGGGRGEVEEEERWRRGGSGGGGGGEVKKEEEVEKRRRRRGGGGGGGEKEEEGGEVEEEEERWRRKEERWRRKERKVRRKGAESTLLSRIHSCDDGVNPLMRAEPSGPN

SEQ ID NO: 924336 - protein, 141 aa, Homo sapiens
MTQAVCLLEELLYENIKTHFLSASLHHSDPLPMSTWGPAPPGPQLTSLPGGILQEGSSLDTGKPRTAGGLREAYTVRGRHNACAHPGGRPPCDRVLPWNTPFRSCNLTMLALPVNLWCSVEPLAGSVNMVRPAASEWGVLW

SEQ ID NO: 924337 - protein, 194 aa, Homo sapiens
MCLLTGMLLLAFAASRGLQGLAWTIFERIQDDYWYKHRHVDQWTRIENPEIKLHTYNCLIFDKPGEKQWGEDSPFNKWFWDEWINDLNVKPQTIKILVDSLGNTIQDTGMGKDFMMKTPKAIATKAKIDTWDLIKELLHSKGNSQHSEQTTTEWEKIYANHASNRGLISSIYKELKQIYKKNSQPNPLKSGQRT

SEQ ID NO: 924338 - protein, 245 aa, Homo sapiens
MIEMTKPLGMRKKGAVEIKVKVRDLRGAKKLWYMRNWINGRPVDNEERRLSKPTLLQLLLLLLLLLAVNTRIAQITFEPVRGAKMQVLCVPKGPLKCHMGSLGKEDQENYPIPEPGPNDTHPPPLTPRQSGPLSALEELGVSFPTLSYLTPEPQLLGEHQIKGSFPGRSTALLLKGQLCYRLVSEVLLRMHSVGICGSDVHYWEYGRIGNFIVKKPMVLGHEASGTVEKVGSSAKHLKPGYKIWI

SEQ ID NO: 924339 - protein, 216 aa, Homo sapiens
MNTEFQSVGLISDLSFLTTKNKEKDKEKKEKREKRKEKKEKKKKEREKKEKEKRKRKRKKEKEKEKEKEKEKEKKRKKKRKRERKREKRERKREKRERKEKEKEKEKEKRKKKEQRKKRKKKKKKRKKKAARRGKAARRGKAARRGKAARRGEAARREAKEGFQKKNLSFVKETNMSTIAKLVHSAYLKNHCKLCYQSVWLPTSAKEFTISIPTLE

SEQ ID NO: 924340 - protein, 288 aa, Homo sapiens
MVAEGNASPRIKSGRGSVTVKVTGDNLVFSVAQCALEGPSDACFTIFLKPSYLAGYSRQQVRSTTDTLVVGTRKAMPVISPFSSGMSLPTAMEVPVDAGIIITAFDFGGILLLEDGDRISTDDKLVILSLDSAVELATGGIILEHVDHVAGVSEGVTDDDNIHFARVKSSPVDQMPSTAKCVYYNLQFHQLSQGHGCCCMAAAAWLLLVANSPSRFRDDVWEPGPRIGNVRNLPGILSTAVSLAPKQSLSLSLCPPLPQAHGEYCGLPWGGQGIDSVHLRPKGSSVIL

SEQ ID NO: 924341 - protein, 167 aa, Homo sapiens
MSELDSFGSYLGWIEQLAELRQEFLRQEDQLQDYRKNNTYLVKRLEYESFQCGQQMKELRAQHEENIKKLADQFLEEQKQETQKIQSNDGKELDINNQVVPKNIPKVAENVADKNEEPSSNHIPHGKEQIKRGGDAGMPGIEENDLAKVDDLPPVSVITSVIIASCT

SEQ ID NO: 924342 - protein, 140 aa, Homo sapiens
MSQVPGLLLSRTERISECGELQFLNALLLLPQLGFQTESPEAALDESHRVIVDIKEARKYSATAEQQCPQLKIQIFSKGKEKKESIRWMTDASEIWIPKKKETRLLGFSQLALQQDTNNSLSLVVECILWIQAFGQLYMS

SEQ ID NO: 924343 - protein, 421 aa, Homo sapiens
MTEEELGASGDLSSEKQEQSPPQPPNDHSQDSEWSKREQIPLQVGAQNLSLSVELTEAKLHHGFGEADALLQVLQSGTGEALAADEPVTSTWKELYARQKKAIETLRRERAERLGNFCRTRSLSPQKQLSLLPNKDLFIWDLDLPSRRREYLQQLRKDVVETTRSPESVSRSAHTPSDIELMLQDYQQAHEEAKVEIARARDQLRERTEQEKLRIHQKIISQLLKEEDKLHTLANSSSLCTSSNGSLSSGMTSGYNSSPALSGQLQFPENMDLAKHVVDTSMADVMAACSDNLHNLFSCQATAGWNYQGEEQAVQLYYKVFSPTRHGFLGAGVVSQPLSRVWAAVSDPTVWPLYYKPIQTARLHQRVTNSISLGEPREGRLPWGLVSGVPSGVLLGDRGGGLEAALFGGQCTWCATPPCAH

SEQ ID NO: 924344 - protein, 129 aa, Homo sapiens
MRVAMLEEWGRARSKYQLKSPDGWGHPGGPDGSAFLSSRYWGKPPCSGSHGSAAGVRGEVQVEVKAHSWLTGTEYHITSHLDPRVPYGAGCPPTSHSTKMTKTQDLSLPLEGLWRQEFQGSEATVREIN

SEQ ID NO: 924345 - protein, 166 aa, Homo sapiens
MGGEKGLRTGVHFSLQQRSCEPQDPIQPHAATTTLQARRAHSGTAKTKRSDLLWRSGKWIQKYKADDWKQGSGNGSEICLPTPGYMGFLSPAAQPPLEKRGSQRPCPWLDTLKFSWGTELQMPAGTGYLGMEEANSQGPQAQVILPPSTAMETDLIVILNIMNNNK

SEQ ID NO: 924346 - protein, 134 aa, Homo sapiens
MAIVVEHTLEATLPDKTPGAAKTPHRQGGCQRQPWDSKEGHGVPHQHPVQYSSAHGPRKQASSGFVFMYSHVPYNILVNNRPHKTITELKNSYHRVTPVNSLVTLSWCDTVTITAGVKNSIENQQPEGFKILYL

SEQ ID NO: 924347 - protein, 236 aa, Homo sapiens
MFPFLQTQFLRRKVYRFLHWFPLIPTPRLCLAGMVLILATSIPRLQSILKPGLVNWLNSINGKDILTELLKLKCAFEPHGTLLNMQILAPSGNHCEQQGPRGSVGSVSAAGSLQQRWRFLERGQISPEASVYLFLQLRERDGISPTYKDQLTLRHCLQSDREPDLAALQKLLLSAGGMGLESFHCPSQHSMTRVLGKLLIVDWEIYSRGSDCASFTLSGLRKPSSQKFMGTLSEYR

SEQ ID NO: 924348 - protein, 154 aa, Homo sapiens
MSLSAAQNQTETINWYQENGALLQRYLKTWKRLRNGVIGRGGNSLEGSGEDTKSVELPRDLLKGFAQNGDSDMDNKVQAEEDSDGDEKLVGNWRYLVEEISKQQSIQEVTCILLKAFSFIREEEYVSLENLQPDYAIEKKNPFSGEKFKPATEI

SEQ ID NO: 924349 - protein, 155 aa, Homo sapiens
MNLFCMELAWGKHWQRHPTHPSWLEASGGSWGHCLPNQHQEESPWWHFLPGSFPGNYSKAVNLHSSGLRHKEGIALPCEMCKEICRDSQRPSSDTHVFKNGVPGNSFSRWGFSKEQNKVFTLIRGSKILKFRDNQILLIRVDACYGEAWVNCKCM

SEQ ID NO: 924350 - protein, 156 aa, Homo sapiens
MHVEGRAQGLSEESHVEYEREESRTTTRLLAKVPDHYLPSAIPFSISVAASCLREPGWNDSDVMLSSQPLVKNNKKRLCLDGFVYLYKTGVPIPSLKRSELRGQTPALPIGETCRQVKRITTCWSRNLLGKQYWGRKGLTVIDELFLGDSMWTSLS

SEQ ID NO: 924351 - protein, 149 aa, Homo sapiens
MEADFSLSYTAGISLNNLLSLPHFWCFSQPLKVIFSGALKYVMPELQKNYLMEPLDLFRYFPQNKRRLSLSPELPGAGGGVIQAPQWPPPPGLCWNSEFLLCITLYFIELPQNSYFEFCLKVRMSLSLEDWSQVSYLDCLVKSCFSGWS

SEQ ID NO: 924352 - protein, 136 aa, Homo sapiens
MVLFPMPLNWLRPSNRDCQALYIGAILLTSDKLVEMRKNQQKESTENPTGQSASSPPNDRNTSPARAQNWTEDEMDELTEVGFSRWIITNTTELKEYVLTQYKEAKNLDKRLEEQLTRITSLERTINDLMQLKNTA

SEQ ID NO: 924353 - protein, 131 aa, Homo sapiens
MSCQRQQQLMDQAHIYIRTLCGSLCSFSLLMLIAMSPLNWVQFLVIKNGLELYAGLWTLCNHELCWSHTPKPPLCKCLKGDTPVKLYIFSVQASKRGNPISKHKNKIVPGWVRFPCLVQVLENKMKQGGRY

SEQ ID NO: 924354 - protein, 409 aa, Homo sapiens
MEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEEEEEEIDDEEIERRRGMMRQRAQERKNEEMEVMEVEDEGRSGEESESESEYEEYTDSEDEMEPRLKPVFIRKKDRVTVQEREAEALKQKELEQEAKRMAEERRKYTLKIVEEETKKELEENKRSLAALDALNTDDENDEEEYEAWKVRELKRIKRDREDREALEKEKAEIERMRNLTEEERRAELRANGKVITNKAVKGKYKFLQKYYHRGAFFMDEDEEVYKRDFSAPTLEDHFNKTILPKVMQVKNFGRSGRTKYTHLVDQDTTSFDSAWGQESAQNTKFFKQKAAGVRDVFERPSAKKRKTT

SEQ ID NO: 924355 - protein, 154 aa, Homo sapiens
MSTDADSNGMVGCAYTCSSGAVVRSAYVCMCVGKVVEACQLELPEGQVWYACEGVMAVASRQYPGWVSKAALEADMARQGPWERLAHRVMLRSHEKNYLNMVIIFKFGQTNIPEDICYPPNPKRQTRHCAPFFVTGHARCSNLCFGLEIIQEHH

SEQ ID NO: 924356 - protein, 248 aa, Homo sapiens
MHATSSICSCLHPGFGRESPSPLSVQRFWEGHLAESAGRVVAAALQQAVLATGLAAVRPLFCRAAVVCWGSTPDPIHLGPSCPWRSSCQGYQSSSHKPLAGDAEIPTERLYLSHWHQQQGKMANWSHSDVGHPSPLGTQSSQRLGGLSLATLLAHEGISPGLHLGSKLPAIMFRAPLWPLDTPAALVPVTATISAALMLVFLLFRGSPADKGADGDLEGLLQKFLGRPKIRSGYKFTVLWASFLLWFK

SEQ ID NO: 924357 - protein, 150 aa, Homo sapiens
MSTGLNTWVINIYLEAIILSKLTQEQKTKCCLFSLISGGKMIRTNEHKEGNNRHWGLLDGGGWEEGEEQKRAACLGYITRFLLCPSGFFVGLGNGAHQQETGERFQAPTYGKLSLHQDTCKTDQSSNGKVTIFHLFWVSYHDELKFQEGN

SEQ ID NO: 924358 - protein, 136 aa, Homo sapiens
MRVNGYAQRMQETSRKGRTKKPSPNEKHQLLKPPCNEPITNTGKFIPRKPKVKTMIMTVYTQQPHSILKTEKLGKDYLMIILKAKDTFQWIHKLSKEIFDNCAKSSSDLQKKLKTKAVKVEKSCLFIVQPSIPPTI

SEQ ID NO: 924359 - protein, 174 aa, Homo sapiens
MGKKQSRKTGNSKKRAPLLLQRNAAPHQQRNKAGRRMTLTKKRIKRNEQSLQEIWDYVKRPNLCLIGVPESDRENGTKLENTLQDIVQENFPNLARQANIQIQGIQRTPQRYSSRRATPRHIIVRFTKVEMKEKMLRAAREKARKLYKPEESGDQYSTFLKKRIFNPEFHIQPN

SEQ ID NO: 924360 - protein, 146 aa, Homo sapiens
MAKESLKGYMGMKLDFKRRKNQIQIQSSSERITLKKAMLDAHPGTWMVIMKSMKISRKHLHWYNSKPCQLGRMHEKYPGETNVSFRYSNETGGYKSVLHHALSSLVEAAKSSRAATDQQMGNEQEYKFPANQIINICCLHPGNTGQ

SEQ ID NO: 924361 - protein, 181 aa, Homo sapiens
MGWLAEYEGELTQGSQLSPAREQNWTENEYDELTEVDFRRWVITNSSKLKEHVLTQCKETKTLEKGRIDQAEERISDTEDQLNEIKREDKVRDKRMKRNEQSLQKIWDYVKRPNLRLIGVPESDGENENHVGKHPSGYYPGELPQPSKTGQHSNSGNTETTTRILLEKINPKTHNHQIHQG

SEQ ID NO: 924362 - protein, 183 aa, Homo sapiens
MSILSPAACTTVSHSKRSKLEPDDVQHHVQVSKDQTKVKKTTSRTYSFILCMQEVFKLRAYCTRSQDISKLLYIKIYVLTHKSNKEAATFLEPWVEINKAIEPGAYATPICRRGGRKSITGGIDIVRIGKLKTGTAKNCNQDTFSLIWEMQMGVPYKLSRVGERNGKLLEDPSKYPKEKDLAV

SEQ ID NO: 924363 - protein, 148 aa, Homo sapiens
MNKLASSLGCKNRLLLQGEPLPKERREDIHKWKNIPSSWIGAINIIKMTILPKIIYRLNTIPIKLPLTFFTELEKNYFKFHRESKKTLYSQDTPKEKEQSWRHHVYGTIVSPGGSVLPSGAKTSRQAEHNVTGIGSKSFASGPLGVMD

SEQ ID NO: 924364 - protein, 167 aa, Homo sapiens
MGKYLGFMGHTVSVATSQFYHYSAKATIVFFFPSDQTYLRHSCDEPDLRVIITDTFKTRTFKISFMYRRNYKVTTCAKGRKTPKTVPEKNLMTDILNKVIKSTGLKMLKELKEVMEKTSSMMYDQNGNRSKEIENLKRNQKEIPELKSTTTKMKNSEDSEGRYEHIV

SEQ ID NO: 924365 - protein, 134 aa, Homo sapiens
MCEQVSECHLRGAPDEEADAHGKLNNSFKMRLDPKNVLPADINTPAAESAADLPLHRETLILDSHTAPLRGSLGAAQAFPSPFPSPCPVILLRDLVPGQPFPGRLLEYPAEAFLCLLQRCYSAGQAAGFHVTVS

SEQ ID NO: 924366 - protein, 196 aa, Homo sapiens
MPPSCAYNLCDLEVLRLIVKSPKIVKRNVKDEAQDKTIAGRHTSRWTSRGTRCLKKTQAAGLREDVEGSMLVEEHMTDGTWAGYGLAERGGVWLGQSEESRGCRVAQIQGKTISLLALPFAESYFYSIKPCTNSPSPHMIQFFRYTKARTLGYRKPSVLAIRQGWRVNGLPVTSQCEEAGQVSQKQRDQDSNSCLP

SEQ ID NO: 924367 - protein, 153 aa, Homo sapiens
MKERDAAPAERGKPATYTGDKKAKMAAKTNKKWVRLATVFAYVLSVSLAAIVLAVYYSLIWQPVGAGTSGGAAGPPPGGSNATGPSGTSGAAAAGPNTTGSSRREAPRDVPPLQAARPAPPEPPADSPPAGPLERPRGPDEDEEETAAAPGSR

SEQ ID NO: 924368 - protein, 359 aa, Homo sapiens
MFGTQVIHWGVCWWFWCDIKMENHRAQYPTSVRQPESARFYWQLCHLTQMELAVSENPQFYSHMLLLSCHFPTLSLYTLEKLLPHIWGNVGFAFTKEDLTEIKDMLLASKVPAATCAGPIAPCEVTVPAQNTGLGPEKTSFFQALGITTKISRGTIEILSDVQLIKTGDKVGANKATLLNTPSISPSSFALVIQQASDNGSIYNPEVLDITEETSFLLPEGCPRCCQCLSADWLPTCCISTPFYHQWVQMSPGSVETDYTFPLAGKVKAFLADPSAFVAIASVAVATTAAPAAAAPAKVEAKEEVEELGRLGTACFKSTDRSNPNSVCPAKVGTAPDPHELLEEKSKEKVSEDVCRKNC

SEQ ID NO: 924369 - protein, 205 aa, Homo sapiens
MTLSRQDKVVSCVQVEGTAIKRSTGSPFSDMRDGGALGTGAGRWVVELVEELRAYIVQLPREAIWLLLLLPASRRKLRFAIDVPALIELLPRLHQAWSSQLHAVCPKGHEFSCTSGLYKPRSGQLIIPHLISNSHLISNRQEILGRSQEGLAVPMGDLRGHGSGIRSDIQVYTCESSTGHVRSAQPGSRQVLSPAAGKCTGLDDG

SEQ ID NO: 924370 - protein, 158 aa, Homo sapiens
MKPGSSEKGSHFPQLHPGSTSLKTEATQAALSGFSLQSQWAVSHGLRCKQAALREPWRAGRGCSDHSCCWSGTSLQEVRSLQVVPKQFSPIAFSWDDSRLSPHFCHYQAEQNSSSPGIHPAADLRGYMSSCCYSGEKRVWALESDSQGSNSSSAITCW

SEQ ID NO: 924371 - protein, 149 aa, Homo sapiens
MVTLISKQHLELCALQSGVETNGPFTRSAHEPWGDPFDHQLCARVSFVRCSRMQGPLWERLANHRSWLCIPELLYCGPGAPEHPMALSESMVGFWLHWGFYVLQITRKQQQQQQQQQEEEDSNDEAAYRAFMRTSYEKNPKLLASLAAE

SEQ ID NO: 924372 - protein, 153 aa, Homo sapiens
MFAEKLPNLTHLNLSGKKLKDISTLEPLKKLECLKSLDLFNCEVINLNDYQESVFKLLPQLTCLDTYDPEDQEAPDSDAQVDGENEDGEEEELDEEEDEDEDVEGDDDKDEVTEKVKTGREKQMMKKMVKTPDHLQKQNCSVLFGLFMDLVAV

SEQ ID NO: 924373 - protein, 137 aa, Homo sapiens
MQGLLSGFVVFLQVKYSWLRRNLSFFRLKGLELKNTCYRCSESFYETAGDMNRAGGHGALDDLEFLAVFCGLPCRFQFPAYPWLSVTSVEDDRNEIKLAQWEFSQTFDLTIWANFTDSILADQAWDLTESMTATFAE

SEQ ID NO: 924374 - protein, 146 aa, Homo sapiens
MVATVRKYRGATRTYQLTTTPKCHLQDNIRKLQHQKYLTDIHPCETKDEKSATNKGPARSHGLILHKKIIPKTRSHQIFQGRNERMLKAAREEGKVTYKGNPITLTANLSAETLHTRRDWGPIFDILKEKKSLTKNFISSQTKFAK

SEQ ID NO: 924375 - protein, 154 aa, Homo sapiens
MEQSWTENDFDKLRKEGFRRSNYSKLKEEVQTHGKEVKNLKNKLDKWLTRITSAEKSLKDLMELKTMARELRDECTSLSSQFSQLEERVSGMEDQTNETKMEPSGKHSAGYYPGELPQSSKAGQYSDSGNTENATKILLEKSNSKTHNCQIHQS

SEQ ID NO: 924376 - protein, 227 aa, Homo sapiens
MVVGEANMSFFTWQQQEEGPNKRGKAPYKTIISHENSLTIMRTAFRDLLNGFDQNADNDMDNKIQAEVVPDGDEEFVGNWSKGDYCYVLAKRLDAFCPCPEDLGNIELERDDLGYLVEEISKQQSIQEVTWLLLKAFNFIRVAEHKSLEKLQPDNVIEKKIPFSEKKFKLAAEICMSNEETNVHHQDNGENGSKFPQALGSARGNIQDPGTEIKNLRNQPHVLLYCS

SEQ ID NO: 924377 - protein, 133 aa, Homo sapiens
MLILMDWQRKCFLEMKSTSGEDAVNIVEMTAKDLKYYINLVDKAAPGFERTDSDFEISSTFKMGCKAAETTRNIKNTSGPGPVNKGETITSEKYVQQMDEMHQKLSCSRHWSTERAQFFPTTMLNYMAFQEDD

SEQ ID NO: 924378 - protein, 136 aa, Homo sapiens
MWPKFTVSPWIQGRIHVLANIVPGRRSPLDGQAATVLLPHVGPATLTGSADLPKKGILSERRNDADLGLKTEEGGNDPWSCRAQGLDPGPQWFLRKDQTFKDIKEHKSRKPNPRTAIRKIKGTSVHTYEREQVQEL

SEQ ID NO: 924379 - protein, 146 aa, Homo sapiens
MNPQGIMDIIFLAHSDWHVGDTNRFHSIPAFNISREWEANKCVLRYEEALKHQLKELSENVLQTCKILETLQQLSTSSCCTSGHKPLCDRQVSGMLNKPRSTDGVEYIEKTHSQSWQKGTSCRICPQGFPPHRMGLEKIKTISKEV

SEQ ID NO: 924380 - protein, 306 aa, Homo sapiens
MPSCCGSGIWKFLCAGDAAGVCLTVEARNCNFFSVIVHLEGVPINSTTILSFAHYIGQPADYSILNSVPFLVDCFRAKEHLTEDSASASLELMLLNPVPLCPTYKYILQTLHSNAADDTTGSTSSAIPPGNRSQQEELTSIPYDFIFNPTNQHSPLSEPISAKLSLKTLIPEARILPLSFVTENTKENIVPSQQQSNGHAGCYLLWYWNLNLPAGSPYSTPVVIPHCQRGVIIMDIAFDRTFTLVLQPLGTVVWNMFLDEISRAMIFHPIRDMDSKNGVNSFDSKYYVIPTEAYIHLILKTWLCKK

SEQ ID NO: 924381 - protein, 167 aa, Homo sapiens
MLLALDHITGLFGVPGHKAPLGKCCGWQTGYILPGPVLLREEYPAPELAHEPMPHPSQCSESGGSPLPELQAQISAPYSRAEGLVPVLTPWGMGTGPTILSSGSSGSNTSCAGELKCSQATGKTESFGKLCWKSSFPSWESRGCAVRMPLGEQPDRGIWRDRLTKGT

SEQ ID NO: 924382 - protein, 154 aa, Homo sapiens
MGRESLMVLSTGYSKLSCGKYSAEWNKKPQLSGQKTIKGNPREAESIRDIMRAQRYHESSYLGKKPHKAPGFTLKLPSNTRLIEVMKADILVLFQILRKNMQSFTTKYDVSWQWAPLWPRVGLEILSRNQGLEQGTLEAYLVFYPTVAELVPKL

SEQ ID NO: 924383 - protein, 139 aa, Homo sapiens
MGDFERLKTSVEGVTASVVKINLSPSNYRSTIEQQMRLTLHDCCECQKKNCKHALKTVTHFVHCHEEVMLLGNRKAFPTNRIVVRKAVSGDGEGFRDLFPILSTGVSSCSNVLVTTEARPQGNCHRGICPRGIATAGQW

SEQ ID NO: 924384 - protein, 134 aa, Homo sapiens
MPKVPCPTQLAIFGPLHHHMNFRISLSISTEKLWTSGEPLNPCTINYTLVNIFINNYVSYEFRPKELHIYEGQEETGCAGQTVTQPVAGRSVDCLAQIEPKNGREGETTYGRRGEITGRHCPLISGQFYPFLKI

SEQ ID NO: 924385 - protein, 156 aa, Homo sapiens
MRAIYGPMAPTPFCALQVLKIRMQTSWGCHYFVCQCPGPNQTSSPPPAATELASGCLDPGDFKGCLDLGWQARTHRQHRTRSRQDIHFLVASSSRHQLFPGKTKAKGRRWRGFAAVLHLCDSRAFLWDLMRLLFTLAFTMIPEPASLEMMFSFMNG

SEQ ID NO: 924386 - protein, 140 aa, Homo sapiens
MKEERKTPESMRVLQWSLGSVCGADHSSQSRFLQPIKLVLVPPHCAAEVSNQFNYRVDIQGQRNIKSWPKPGQSCAWTSRAAGWEEKAAWSGADELAGGDGAGCIPQFTARVTTDTQRISKEAQMCLKDTGLPEAPRMQV

SEQ ID NO: 924387 - protein, 267 aa, Homo sapiens
MGRGWKSVEGSEEDKKMREKLELPRNLLNGCDQYADSHMDSEVQAEEVSDGDEELIGNWSKGHLCYALVKRLPALCLCPMDLWNFELENDDLWIWLNNFSKQQIVQQVVWLLLTTYAHVHEQRNNLKLEFIFKREAEHKSLENFQPGHVVEKKSPFPKEQFKPDAKIRITKRKARANSQGNGERASKAFHRPSWQPLPSQARRPRRTERFGVPGPGPCHHERPEDTVPCILAALAPALAQSSPGGPGHGGRSACLGPHVPVQYTYRW

SEQ ID NO: 924388 - protein, 170 aa, Homo sapiens
MLAVALFFITIRLTSLMLLAAFLALFPLHDSRGLKHTGAGHVNSVALLPIPLKAVSLSPVSSLQVPCVPEATGFKVVPCPKQYNEVIPEALLMEGRTGANFLVPLTPFFVPSLQWRVGAGMKMIVSLVRLNTLGCSGEGYQAPRDTCRWRDILRAMASVEWPDNVAPIPT

SEQ ID NO: 924389 - protein, 172 aa, Homo sapiens
MTIYELGNRPSPETESAGIFDLGLLSLQTGTANRVEMKTSSRPLATLARGNSLLLEDCCQTEVCGHLGIAIDLKMRVEWVIIAAPTLELSPLLSPCCGACEAGPAANGSREGIRGDQGFCSPPSLRLSPCAIVVLELGACTQFSASRGWLCPAPAGDSHDGDFGAVNAQEAC

SEQ ID NO: 924390 - protein, 135 aa, Homo sapiens [sequence omitted]

SEQ ID NO: 924391 - protein, 202 aa, Homo sapiens
MAPPAPPRPPGLSLKLKLLRGSFLPSVFTRGPLAAPCISTCVCPTSSQSLPLTMCPLSRGAHPPPALQQPPKITLNLAPGASALRVKETRCLGCPRNLKPQAAAKRVAAAPKMAASLLFSDLGFLASRIPRNETLGHAEQWRTFSPNRSGNGRLAGSEMQQTPCRIRRGGSQWRVWDAGEQQWWTALSRWDDTCLYYLIVFS

SEQ ID NO: 924392 - protein, 131 aa, Homo sapiens
MRWAGAEEAPATHCHGHSLAEISNKRRGEVGLPGCRSYTTAAPVQQPMAFSYISCKRGAEGDSCECVAVMGIHLVDISRLQLCCVWATECDGRQGGCVSLDSYRCYTDEKNVMASLVWEAPLDMGSAAVAG

SEQ ID NO: 924393 - protein, 184 aa, Homo sapiens
MFLTALKRGFCLGCCVFLLNFGCFYENQCKKAENFKNQNTSSPPKDHNSSPAREQNWMENEFDKLTEVGFIRWVIMNSSELKEHVLTQCEEAKNLEKRLEELLTGITSSKKKINDLMELKTTARELHEAYRSINSRIDQVEERISEIEDQLNEIKCEDEIREKRMKRKEQSLQEIRDYVYSNQL

SEQ ID NO: 924394 - protein, 207 aa, Homo sapiens
MDQAWGLLPGAPGPQLQPKDSFGKVQEAGRALPAQRGHCGRVFRRVSLDFEGCQPPDSHSALYFCVFVLIPLALLEVWEKIGGTLKKAYKDGAEDIPVTVWSVWALVCSTLESFHTDDDEEESEEEEECNEVTEEVTEQVCLPAKAAKEGEVCPYPSAPPIILKKSGLTLQIFLFWRTGAKSSCPGDRSSSASSDLSQFYSGRNPAS

SEQ ID NO: 924395 - protein, 142 aa, Homo sapiens
MNMFLFFPFSSQDNIFIHIVPLYCQLEANNQRHSNRQVISEGRIPQIAPERGQGAADLAPANHTEGSELSYSGCGQPLVGVVCSRRTAFEIPTQHSVRLSFQPADSSSASFVLMILKEGVNGRFLGQVHVHSYKDNHKKSAF

SEQ ID NO: 924396 - protein, 127 aa, Homo sapiens
MQTGARLTRGGFVDLILGVNLTGLRNTSKAGKALFGVCLMDHAEMEESMLHLRRWEYGRKTWAQDKGTTLNPNPLAKEALLQPPGRGGNALERGRAARGSGHCHIKWEFLFIHQILMDSFNHYAQDC

SEQ ID NO: 924397 - protein, 369 aa, Homo sapiens
MWCLERLRLGPECLRRSGDWLLPGRARGAKSRTTAACANVLTPDRIPEFCIPPRLMPRLALAALRNSWVEEAGMDEGAGRTDWDPRSQAALSLPHLPRVRTAYGFCALLESPHTRRKESLLLGGPPAPRPRAHTYGGGGGPDALLGTLRVPRAPGPATPAAPGCPRPPQDALARRPRGCRLLRVPDGLLSRALRAGRSRRLTRVRSVSSGNEDKERRAGSQSPARAPSTSPPSSRVPFPERLEAEGTVALGRAGDALRLAAEYCPGTGRLRLRLLRAESPAGGAPGPRAVSCRLSLVLRPPGTALRQCSTVVGRSRKASFDQDFCFDGLSEDEVRRLAVRVKARDEGRGRERGRLLGQGELSLGALLLL

SEQ ID NO: 924398 - protein, 239 aa, Homo sapiens
MIGRLHDIDRLTLVSSLCDYLHGLVEELMQVMRHQSFQAPLAATCCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTLSEIHPAGWVLRGPAAAERLDQDVVGRTSTQHPFACKGLSGDTAEARVAEQGEEIPGHQALSMPTRYSASPT

SEQ ID NO: 924399 - protein, 137 aa, Homo sapiens
MSGEWVKGRNPSDLSWSSCSRDDLENFLKSKVSTCLLVTDPRSQHTVRLPHKLPGMHYSANEQCQILFGMNATFCRNMEQTGKALATGEGQEPVVHLALAVTGLGEQNLHHPVEKEGRSRGTSQGTEQVTRGTDVNY

SEQ ID NO: 924400 - protein, 173 aa, Homo sapiens
MVPSLVLQHLMCAGLWCLVEGDTSCKTKLDPPLDGTECGADKKEPRFPHVELAVPSPSSKHNSQVHNLNRGMPPPSEKRTHWCRAGECVSKTPIPEHVDGDWSPWGAWSMCSRTCGTGARFRQRKCDNPPAHRARGRQGRDQNCQVCTERPVSLDGEAGPNCCCDFIFWSVFI

SEQ ID NO: 924401 - protein, 144 aa, Homo sapiens
MYLCPAWPTHTFPCQRPPTFPSSDKPCELYCSPLGKESPLLVADRVLDGTPCGPYETDLCVHGKCQVTYFSFGPWWGFGEETHSPQTGKRAPPEVAQQLGWGVGVEALYFLCLAYATGTILPGDSGQAGHVVREPQHLSQLGHL

SEQ ID NO: 924402 - protein, 270 aa, Homo sapiens
MVFHTALPLTKALTLQLKRCGSGLMLMEFTGLTMFSIILKRLQRTVEWPFEVTITMPTSSRGRNAATRRHNDSIKLEDWYPPGHFGLLPPLSQQAKKGVTVLTGVTDLDYQDEISLLLHKGGKEEYAWNTGDPLGRLLVSPCPVTKVNGKLQQPNPGRTTNDPDHSGMKVWVTPPRKNPRLAEVLAEGKGNTERVVEKDASCPGTSDPKFFSFGTGTGSPCSSACGQPIVGCCDYSCCVMVLATNISKSFSGNMEVTHFTGHLNVCDHVT

SEQ ID NO: 924403 - protein, 135 aa, Homo sapiens
MGMQAQPFHVGAATVSQLPVVWFPGERRTIVSCTRIVNKTTTLVNDSDCPQASRPEPQVRRCNLHPCQSRMKFHPNAEGLEEELTAGNLLEHLVLLLISVSFTVFQVQSKITSHIGKQIHTQKRRPLMETDWKMT

SEQ ID NO: 924404 - protein, 160 aa, Homo sapiens
MTLRPLKLLILSLCLVENQLAGWGGPDLRNRKRPAHPLHCHAPQHRWKGKGLQSLQILCFLKAQAAYFKSIMPWPQSKADTAAQRFQEPASEGACSPATQAQCATSSQRAHSQNGGSADPSQDRQRACHRSRCCGGKVFHCSWPALQDGLVPHMASTGKH

SEQ ID NO: 924405 - protein, 175 aa, Homo sapiens
MSQPSENSIMNVILKDLKDAAVVVPIIFPCNSSVWHLRNSQWILSDHSGLLQLYPRMSPTQTAVPVHGILEPVLKGPCLGNHAGGATSAPDSGDAVPSLMLKGDETLGLGWGRAHSWDVCHQNPTIPWRGPLQVSRLMVLAEVLTDSCHHRPQVQDYSPSDPSSLYLTFEPPQQR

SEQ ID NO: 924406 - protein, 148 aa, Homo sapiens
MEETKAASTGHIKSKRSLENIRVPSVSLNTTTAENSFINVLPLPSCGTRFGCTGPGGFPLFRSPTHLAQRLGWCPLAPIINHYAPPHTLALGTIESDTNKAVDRLKTHPHKPVFRSEQIWAPEEPRKLPPASQVRYHPFRFDFFQVCR

SEQ ID NO: 924407 - protein, 370 aa, Homo sapiens
MGNLKFGSWLGHFLVSCMTVDTLFNVLKPPSRPDSRQNSNKDSLPTVVHQRPSLLRFKDQLLSIQTLCKSSKNKCSQCRHLALDALQMKEEDVLAAGTNLGGTNLDFQMEWYICKRKSDGIHIINLKRTWEKLLLSARAIVAIENPADVSVISSRNTGQRAMLKFVAATGDTPIAGCFTPGTFTNQIQATFWEPRVLVVTDPRADHQPLMEASYVNLPTIALCNTDSPLRYVDIAIPCNNKGAHSVGLMWWMLACKVLHMCGTISCEHLWEVMPDLYFYRDPEETEKEKQAAVEKAVTKEEFQGEWTALAPEFTATQPKVAGWSEGVQAPSVPIQRFPTEDWSAQPATEDWSAAPTAQATEWVGATTEWS

SEQ ID NO: 924408 - protein, 305 aa, Homo sapiens
MSPCSCCCHPNILEALKITNYDQLTLYSSHNFQNLFSSSHLTHILSAPRLLQLFSLFVESPTITIVPGPDFNPASHSIPDTTPDSHDCISLIHLTFTPFPHISFFPVSQPDHIWFIDGSSTRLNRHSPAKAGYAIVSSTSIIEATALPPSTTSQQAELVALTQALTLAKGLSVNIYTDSKYAFHILHHHAVIWAERGFLTTQASSIINASLIKTLPKAALLPKEAGVIHCKGHQKASDPVALGNAYADKVARQAASSQTSVPHGQFFSFIIQACPQNATRYSPFELLHRCSFLLGPSLIPDTRPT

SEQ ID NO: 924409 - protein, 238 aa, Homo sapiens
MSLHALSCSGAQDCQGRPGTGVNGCQSSAGAGLQDGSACASLKSGVVKAQPGTGADWVPSLQGLAGGWVHECWPEAEEDLETRSTKAGLESGVTGPAWSLRLLVPASQVLRQSGASGHWGHPGSGTGLEPENGLKPEAASAKLGCRDRTNTGGSMKPRAIEASPALGTIWSMEPLGTAQPWGSACCWMSLRTESLGPSWSLTMVSGLALEPVQSLGLLQVTETTESKATDKGGLLLNS

SEQ ID NO: 924410 - protein, 226 aa, Homo sapiens
MKTSSGLPVILHYGIPGAAGNPGERGEKGDHGELGLQGNEGPPGQKGEKGDKGDVSNDVLLAGAKGDQGPPGPPGPPGPPGPPGPPGSRRAKGPRQPSMFNGQCPGETCAIPNDDTLVGKADEKASEHHSPQAESMITSIGNPVQVLKVTETFGTWIRESANKSDDRIWVTEHFSGIMVKEFKDQPSLLNGSYTFIHLPYYFHGCGHVVYNNSLYYHKGGSNTLVR

SEQ ID NO: 924411 - protein, 155 aa, Homo sapiens
MQHGCPGSSQGVLSPTLRQTLNCVTLRSHGVDGEDSQRAWGKLPEGPAAIRRTFQGSSPLSMTRMQEPEEKLCEPWSRPGTCRFIDHKVMRKRFYISRGYPRRKEVKTTAKPSLFHTECPHQAGPSRLSWEEVQELGSEVCTQLDVPTSGPKLRG

SEQ ID NO: 924412 - protein, 165 aa, Homo sapiens
MELISAPPSKASKASPQGHRTSLVLNSERQEFSHCMLLEAYTESGPQCLNPKRDDQWQEVKNPRKQEGSTVWMSAEVDLKVVKCKPETQMLIMKLTFVMILVNSRSFKQGFPSCLYTPEDLQIPGSCPTLAESEPSGGGVQEPAFVPPLVILMTSKCGNHCPSKP

SEQ ID NO: 924413 - protein, 147 aa, Homo sapiens
MSKTQDRKISKSSYSRVTVHPGKGGGQNQNGSWDERSITGTRPCQLQEELEKRRYEREVCRAEESPTSWSEKSSSSHCQRWSMKAEETSTASYFFSQAPEDGRSYCWPGGCPTVKKTKWTWSTRTRRRLWHLQVCLSLHLTALTFRG

SEQ ID NO: 924414 - protein, 145 aa, Homo sapiens
MFPPWAGCRRWETRKPRVEDGSVGTVGHCQREISKSDVTLSGMQLRPAILVCPQSNFLCHLLEWLFQVSGFLKSLSLSFHFKENIAVIGWELAPSEEQLCPPSHPLPHLGSSWLALPFGHWLPARDLCRGSAPSHALSFLHLPLC

SEQ ID NO: 924415 - protein, 164 aa, Homo sapiens
METSLMPCTLGSVFPKLFLIFDFVLFYSPKPRLPGWWGECQACFPLLSALSSHIPPSCEFLLLMGNASVLFLEEQPSNWYPLKSTSRTLKCRNSYSLVHSLQFQIATHLQCYLLGKPSRSLSYAPLFCFSLLPVPLALALFFLILCPSLDCNEFGTPCHLGRTD

SEQ ID NO: 924416 - protein, 138 aa, Homo sapiens
MDRDKKSFEVHARKSLDCCEWTLKGNSGESLEGGKESCRESLHLLTECLSGCDQNIVRNMDCKGNSDEILSPCVPLPGNSAVVGTLAWAQGGCMTLVADTYSFSDPREIASPLKGYPPKRIMYYQWDRGSHDAGPILP

SEQ ID NO: 924417 - protein, 134 aa, Homo sapiens
MRGRFGVSELEQHEDSCPAQGGKVSMQQGEGEKHIHKGEPIRGVGIPSRVKRIPRVRGKSCHGCQSLSQVRTGIHMGAGEALGEVSEPQQGKGGPPCRRPAQHWVLEPEQSEEGVHTGGWFIYFAKFENFAAIV

SEQ ID NO: 924418 - protein, 131 aa, Homo sapiens
MRMLEVLMLKIPGLKYCPSHGPHPSGEGVCLEGKKIQCGIRHARFLSADLLNLPGHIALRIKPVSFAVKCDHVTNFGYQDVSGYNVCSFRVIAIQGKSAGYIVALPCACQYKKYQKGCAAGWNPLQGAGEI

SEQ ID NO: 924419 - protein, 162 aa, Homo sapiens
MVMALEHIITAQQDSPHPHYNQDYRVPQKPKTFVKTLKLNEDFEPCECYLKEEMMVNIIFSNLQVNPLTQYIASPAGADDSGPRHKASAEQETAEDISECCMLSGKCGGDVAVNIGRGKFQQWIQKLVENLVMNVISWEGPDITYVTFQPEMHNLNLLLRKQ

SEQ ID NO: 924420 - protein, 187 aa, Homo sapiens
MLTYQPPLQPMAPDALKGQDWVTGFTWEPGLASEPENLVTWVNGCHTGKQNTSSETNKEVAQFSAEIWKGFKEEATFDLDFDRTMEVDEVETLETQAKRGVGCLVAEQGVYDEALQPGPGLPPTPSLGTQGPWASEKTFSFPNLSSKPCMGLPWGPRISTVRLTTRGRGSVSPEGSSSKTNSLPGKR

SEQ ID NO: 924421 - protein, 129 aa, Homo sapiens
MTKVSRRKGHHKTRRGQVEGRIRSITRPHSSFIYSFTHSFIHLVTIEHLVRGRQTAREEEMTPRRSLEILESLAVAKPGFNLQTLIPHTSQIDAWYCKVEAGLFEGMDESYSKFILHYQLCKNGDGPIK

SEQ ID NO: 924422 - protein, 127 aa, Homo sapiens
MTAATSQGNWHRGTQAWGRGLLDFSVQNAKMAFVSCLSTEVEERWGCGNSLAPINTPRLPSALTLVCFPAGCGPGTTWQRKQPGPRGEGETGEPSAKAEVLQQSPSSGPPRATDTWSEGHPVHYTMN

SEQ ID NO: 924423 - protein, 155 aa, Homo sapiens
MGYTNIKEEKLLFNTPKNTEFLYLPEFRSLAQYFHFDGFFCYSLLKHVFISFTKGKLTWWSSSAFSSVWSSNWKGISWKEQGSYRSDLGEVARFAEINRRFAAKRLSGLGWARWLTPVIPALWEAEAESPRFNPDVSKSNSVSFNYGSINQRLQL

SEQ ID NO: 924424 - protein, 156 aa, Homo sapiens
MACDGGSLWSLTFVSTGKWGSSANPGQGTAWTICHQCAESAEKHNPAQAFCGCGQEVGTGLPRLSQSAGCLSNAAGGDLQKEKEAKADLPVPMRGTGCLEVVGPLQGGDRKKKVRCVAATAEGLPEPASELVGSLTYGKDPGKSCKILGKGLYGIL

SEQ ID NO: 924425 - protein, 150 aa, Homo sapiens
MQPGKGCSNLLNQTPWGWAQQTVFEQDLQGTLRHQSLRTLRYRVETTEGKLLTPRAVAWRQYVGLWVWTKIKAKGQVLRQSVRRLPSLGEDRDIHVDLPKALADPQRPARSCSKNRCGGRRKLAASIGPALGSAAQRVDGGANGTKLQVS

SEQ ID NO: 924426 - protein, 150 aa, Homo sapiens
MPSISKTNQVCMEKKNPAKMRVLKENILLQCERGKGEQARKTRGIGPRSQHCRGVAVSLSDANKMTSPQQMRSPSSGDGMSSSHNLMVQRQRSYNHRHIINEETDIQGHPRGKSWNPDFSPDLLTPKLCSLNHSSSLDLRTFPEIQDLNT

SEQ ID NO: 924427 - protein, 134 aa, Homo sapiens
MEEMESKGRRSRSPRKRDRCFPPGNMLAQICSKQKREYPQPCEEESLGRDVWWRICEGDWASVILLKSLLMASQDEAISIVGSWIRTDSEMETSQNGATDLTMNIMTGLDIEKYYADSPDPDALTKANPFRAIT

SEQ ID NO: 924428 - protein, 206 aa, Homo sapiens
MPLWAHEKHCQPSAVTRGSSCQSDVNPLNSFTAKHNVGQSGEQCDVVCKLIYHPEQYESGVQTWSTSSQYCTIPKVLKYFLNPRYCVFRCKDETSEVTGEHVCNTEGEEHRSSLSYRNSMGPQGQGQEKSQQTESGTGHSPEPVLRVEGLGIVRVLHVHHHIGSASSSFCKAKDVKDLGYGQTGSKVNYPAVLLFKECIAAENFVP

SEQ ID NO: 924429 - protein, 149 aa, Homo sapiens
MSRWKTVILMILTLHRPRLIRKSEFTFSPPPAPFLPPALISPLTVSTFEIHPNIFWSLLRNLACGPCVTILGGDRVSSPVRSYSRSHQTVKQRVEGSVMLFLNCVVEIRRRSSKEGHSGQGRPAGGVLAWERGLEHSPGKWTLLGTLLS

SEQ ID NO: 924430 - protein, 176 aa, Homo sapiens
MCKDSRGYTLASNDSLGFKCLSTSHTHLYSSTSCSASSGKGIATSVIRRKGNSLRSRLQGRLAETYCVFRCNGREAAGILGPVVWGRCWDGIDAESFGRSPVSGEAGGSGGSGRGQERGRGGRGGDGGRGGSDGDRDGGEGGGGGGSEGGSGGDVVNVVKVVEVKVEEEEKTLILV

SEQ ID NO: 924431 - protein, 146 aa, Homo sapiens
MREEEHRSDSEANVLSIIPYRLSRGQSPLHYIMRLSKSSRKVIMVCPDLVSSCGFVVSLTSGMKPWTFTVSTTALRGGVDPKSEQQQDLLWRVKEQSFHSMEIATFYVIYCLCRPGMKGALYGMGWANVGEFLFIRSEPSGHVKRS

SEQ ID NO: 924432 - protein, 138 aa, Homo sapiens
MGGALMCSTSQFLCLNTPNIACFNVHHDTLSTGKRGRQLPMPGKPAPAYGMDGECEGLEMTQGHVSGDQAVCNRQKQVSGLSTGKLIQMQMQGSNCAEPPVTEGAGKPLRDFKQESDRIWIVSYRQKCDHGMKEHRWT

SEQ ID NO: 924433 - protein, 193 aa, Homo sapiens
MTFLGLKLRTGRVLMLLLLLYFAWLPKSISALVHACCRGGALAWRGPCTHVNQWHQNGEFHVCTCVAVGESHRQVHTGKAVGGGVWHLCVYRGLSAEAVQWLDGICYDVCCRRNPGFGIQACTASGCGQEGPSKKPANEGCSDQTGLVPVGKTARLCPEEMNKSTYMCNLPILNENLQICLKKYKNLNRIKNE

SEQ ID NO: 924434 - protein, 174 aa, Homo sapiens
MKGSRCHLWISGIIPGREQMLDKSQLLYYPYHCTGPPRKLEFLYFPKFFPVTERVSQVGAIGYNGGLACARGKHGTMFGDEVLKTASSETMLRTRLCSESALLEGLSFSVPSNQARCLNMVTFSRSLTADKMFLSTSTMQHTIYEKRETMDVPQLPAMFLSISLTGLPCDQWLP

SEQ ID NO: 924435 - protein, 169 aa, Homo sapiens [sequence omitted]

SEQ ID NO: 924436 - protein, 136 aa, Homo sapiens
MPGIPETHSPVGRENSAHAEHSYCYVTMLRTVHSSSVSFLSIYIDITYTIRLLTGLVTQSLQPLCYARATCLLAVDPIHAELRHVRGHPGDTCCGVDVLLCFCSTTRAGFLGTVYSALAQPHTQKGLRFSALQWQS

SEQ ID NO: 924437 - protein, 182 aa, Homo sapiens
MAYAHIEWDMIVCAAYAHELPKYGVKVGLTNDAAACCTGLLLACRLLSRFGMDKIYKGQVEVTRDEYNVGSTDGQPGAFTCCLDAGLARTTTDNKVFGALRVLWMEVSLSLTVPNDSLVMVLKSRSLMLKCIRSTSWVRMLQILQRALPNGRCLQGKNLYCSFHGKEWMRQGKGILASSVRA

SEQ ID NO: 924438 - protein, 196 aa, Homo sapiens
MLLLTFLHLLLLPSRGSKVALAGCLRLVHSIARCLPCFLPETFLCFQNLRFGRLFCLLSSLHSLSLPLTISICPRASESKSRGGHRSLLEREREKIFFSSTNGHQGAGKWRKDGAQNHFAPVNPPRNLPLLLLWESQLFGCWGETKKLCIETDIKLQTQPLSLKLKELVAVKCKQNSELVGPTMDTCQASTIRKVL

SEQ ID NO: 924439 - protein, 163 aa, Homo sapiens
MPAVVGFGEPQGNLFCCPHWKCGIDDNPAPASDYSNSHSKAIGAPTPIRSSYYKEYEFSVTNSDIKAVLLYFSIIELNFILSCRPHPLTSEDTVLLFSGIPMPAGLSPGEVQSMILSQNASGTQIFIKFLPVVFLPPEAQTWHLSWKSCPCSPTCSSAFWFTV

SEQ ID NO: 924440 - protein, 324 aa, Homo sapiens
MSKRMCSAFTLQDPVHLVPPPGSLLQSPPSFVICSVPPEITGRVTDPFKLCGLLSGCGPARDTKGELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQQTCSQFFLVTPGRIL

SEQ ID NO: 924441 - protein, 137 aa, Homo sapiens
MEDEHCVVLQRFSRLCLFNRNLPVFSYFYHMTKGVQVQISYVQILHSDEVWAFSVPITQIVNSAPNRMLAMGKACVVFLEWSVQEEDLDGKGKVHPKNGQSPYTFCKISDVFGRKFESCQRDAELDRMAVPIILSCT

SEQ ID NO: 924442 - protein, 162 aa, Homo sapiens
MGLCGPGKSRKGLAATWYQPSGPLEWNPGPVCDRLFAQRRLREGLIAVCPSAAKILLVQHRNGKLIKGRSMPSNGSHSTGKNKCLNIHLLSNKKHLFALGLGKSVQDARGEGYRGALAKLEKLEAMKGRNAVSSSDFAKRLSSERNCLPSSSIDIDQIYFWC

SEQ ID NO: 924443 - protein, 171 aa, Homo sapiens
MKHLFLLGRMWELDFRLSLLCVAFWNETFWRVGEESTPQGNSLRLCLREMIMQVRRTRPQEAKLTKDVKTKRSWGGGKVQGVHMQACYMGKLRITGVWCTNDFVTQVVSIAPDEEFFRPHPPPSSTLKEVPVSVVPLLVLAVWLVPVNGCNVSSKAEAGSSLPSPSIQHGR

SEQ ID NO: 924444 - protein, 294 aa, Homo sapiens
MLRERHPTKASSAAPVETSSTDILHCPSPPRLPPPGPTLDQLDDACPYWGGWIFFVQLLIQMLISSRNALTDTSRNKVLPATWASLSPVKLTHNTDYHNVQVQGSWEKKELGIKQRVFNRGQNRQCHQHQRPKVDKTTKMGRNQSRKAENSKKQSTSSPPEDHSSLPARERNWMENEFDELTEVGFRRSVVTNFSELKEHVLTHRKEAKNLEKGLDEWLTRIKGVEKTLNDLMEPKTMAQELHDTCTSFKSRFDQEGERVSVIEDQIKEMKQEEKFREKRVKRNEQRVQEIWGY

SEQ ID NO: 924445 - protein, 155 aa, Homo sapiens
MGNSPSGHSWSACFQARQTAVCLHPGLEQLHPHAPGQSNSTMASPTKPYSKFSDPLYTCIHLYPEKQKKKWDLTTDMTEIKRIIRDYYEQLYNKFENLEEVDKILDPYNLPRLNQEEIENLNRPKRSNEIESGTKRPSTKFEDYENAEYVASYEP

SEQ ID NO: 924446 - protein, 166 aa, Homo sapiens
MAAKYSMARLLRAALCCAGLASNFKWLVSSINFWRLDKGPTKDTIPCGCRCQISKDALSRQSGTQLGSAAGPEGDQNSPPDKIGKPMTEMMSIAKEEGFNRVLQPRRWESSKPPPFPASAPEAGTTVLHNAGHGDAELPLRRSQFRETIHMSFHKGLHHTKGKLIL

SEQ ID NO: 924447 - protein, 171 aa, Homo sapiens
MERGKMSNFTVEKPDRHYLSQVIKVNIIMVSDIDSRLLPHNPSECQCQKPGSAWGGQQYQMLKTHSNRVVANESPHTQCQKSQSIQGAAKDQVGATEQHDSGIPGFPRLGQAWLLRGNWHVILQPPSQSFESLHYGYSPIHSAQPSARKDDGPEKNLWTTNPPKNLFKRSY

SEQ ID NO: 924448 - protein, 274 aa, Homo sapiens
MSAENNQLSGASPPHPPTTPQYSTQNLPSEKEDTEVELDEESLQDESPFSPEGESLEDKEYLEEEEDLEEEEYLGKEEYLKEEEYLGKEEHLEEEEYLEKAGYLEEEEYIEEEEYLGKEGYLEEEEYLGKEEHLEEEEYLGKEGYLEKEDYIEEVDYLGKKAYLEEEEYLGKKSYLEEEKALEKEENLEEEEALEKEENLDGKENLYKKYLKEEYLERDEYLEEGIPKDGNSSLPGCPGKKHKPDIEPERKLSTLSMVLTGRKTHLLTKFCSQL

SEQ ID NO: 924449 - protein, 148 aa, Homo sapiens
MKDIGPAEVTETICTLCHQTMFPNFRWDKTRAENDSVLLGAHWRQKKPALGLSYLLHLSSEISRIARFPVGNGSWDTNSQLEMATELQHLGQTAFGAAEEDLAGLEEYFIPYNCVVQGSFKAVSGMLLHLLITTHCEKGVFAHGETET

SEQ ID NO: 924450 - protein, 153 aa, Homo sapiens
MGAPESQRPPLKNLFSGNRSHQLCHYLPCLGICLCPSISGSFAFTLSGLLKGCGLGCWRTGLTLDSEPIQNRQKKPDVDVIQYQLCLSSSSVLGLLAFRLELHDQPSWFSGLQTQTGTTPSALLGLQLAECTSCQPPQSCELISYDKSISVYL

SEQ ID NO: 924451 - protein, 163 aa, Homo sapiens
MHREGAPFSWGDVVTADSRKLDSGDEQRPVDLGGRGAHEGARDGNSPMAEALVFRDKFVHSRPCSLSVPDKATSSHLSYKNTDTKGKSPSPEKEPWPCTPLQSDPPSRDLDKGPCTSTVYGLKIKDPLLKCSSGREETINKTKTKFLASFVRPGSLIPRNHIT

SEQ ID NO: 924452 - protein, 137 aa, Homo sapiens
MVASAEQPSGSVEEELSKKSQKWEEMNILATYHPADKDYGLMKIVEPSTPSCRKMGDGEDACSGIETTEAVAPDILAKKLAVAEGLNPKYRVQEQESSGEEASDLSPEEREKRRQFQMKRKLHYNEGLNIKLARELI

SEQ ID NO: 924453 - protein, 175 aa, Homo sapiens
MEELPQKGQEAIVPIQKLDSAPKEEREKENAVVNRSSAPHSKQTPGPQQLSFLLSLQEARPLGGAITSLHWCCTSLAALVEDWSFPIPNPTLSLADSDTRDLVLKSATVGTDLTGNAFNCFSTLKNWMRFCQCDDTYSVRVLWYTVVLTRSSFDICFVPASEVLIHEQRHHRLCG

SEQ ID NO: 924454 - protein, 152 aa, Homo sapiens
MSTVTNNDLHTLLFRSCLFLFSVPQILCLKNLQILKLRNNPIKEIPSEIQQLEFLRIFTIAFNLITVLPIGRLQASSDIIKMFICKVCSMKTHQEGTYTVKNEGAEFFISKGCCQKSTLLSKEDLTECGETWRSDVGKKPIGNRLKMWKDDR

SEQ ID NO: 924455 - protein, 182 aa, Homo sapiens
MPIVKQAKIYHNKLKVEGNCEYLTGWLQKFEKRYSIKFLRTHGAKASTDHKAAEKLIDKAAKVIADENLTPEQLSNADEISLFGHYSPQKTLTTADETLKILIKNNVDAMYFPLNVTSLIQPCDQCNLRSMKSKHKNPFLNSMLAAVNRESISKLEEVNIEEVFNLYHRGPVVHSFTIGEIA

SEQ ID NO: 924456 - protein, 184 aa, Homo sapiens
MVITAEKELFQGYEVLSPDSYYCYHHHYSRDIDILIHSTNCYPQRPSIDGSGGLSGMATTMMPAAVGEVLLGLSLHGACGGQKQAGAPTSRAQLQPPKLVLQTQASLCSWGLEAGRSPALPGTAVGSEMSAPTAWPLPAPCTHSDLGARLRPSPGAVGAHLGVYTLGAALTPQPSAALTPSQSR

SEQ ID NO: 924457 - protein, 578 aa, Homo sapiens
MVGKAKWKPLELTLPRKIVNKKQYYIPGGISEISVTIKDLKDSGVVIPTTSPFDSPIWPVQKTDGSWRMTVDYRKVNQVVIPIAAAVPDVVSLLEQINTSPGTCKILGVQWCGACQDIPSKANDKLLHSAPPATKKEAQCLVGLTGFWRQHIPHLGVLLCPIYQVNLKAVSFEWVPEQEKALQQVLAAVQAALPLRPYDPADPMVFEVSDRDAVWSLWQALIGESQQRPLGFWSKALSSSADNYSPLERQLLAYYWALVETERLTMGHQVTMRPELPIMNWVLSDPSSHKAGCAQQHSVITWKWMTHSVDTTQPLSPATPVIAQWAHEQSGRGGRDGGYAWAQQHGLPLVKARATTECPICQQQRPTLSPRYGTIPWSDQLATWWQVDYIGPLPSWKWQKFVLTGIDAYSRYGFAYAAHNASAKTTIRGLMECFVHCHGIPHSIASDQGTHFTAKEVQQWARAYGIHCQQAKKGVTVLTGVIDPDYQDEISLQLHNRGKEQYTCKTGDPLGHLLVLPCPVIKVNGKLQQPDPGRTTDNPEPSGMKIWVTSPGKKPQPAEVLAEGKGNTEWVVEEGSHK

SEQ ID NO: 924458 - protein, 138 aa, Homo sapiens
MGRFSLGPHSFGTVSRIPKPLCSSGSHSPGNLGSEKFTKGFYAVPGLAECLDSVVLKAENVTMISKGLNDYSRGEKESRISKACVPNKPYCLSFLVGESRILQESSSAEGKPFSGKVYLRLDNLAALHMGYINWHSFA

SEQ ID NO: 924459 - protein, 139 aa, Homo sapiens
MKLFRIKQIYLKSTNVYTFSHTSLELLVSGNTAASEINICGISELRLSLGTACCGCCGRCRCGSQANGVMFPGGLWLPLLYHTGHQGSEEKPAPKGLTQFPMQPTVRKAGLTPTMPLTTVPSLFLAAGKGYFVDYSDYV

SEQ ID NO: 924460 - protein, 183 aa, Homo sapiens
MPSHKQAEAFVNTAAVFLSCFEIHIDRASERLFVFTINCVTGIIFLVKSLAFIFISLYRLMHSLCLLLGDFHLLCVKIKLFLESLYIASWLYPTATIFGITSTRSRDPRTLSWGLDQDPFSVTPSQRKPLLPLFANLQIQKKREESNSKDGIIMCESDIIQLKITQEAAFQQSLAEFLLSDIW

SEQ ID NO: 924461 - protein, 153 aa, Homo sapiens
MPMKKPHPKITSIKDQRDENWMETEFDELTEVGFRRWAITNCSELKEHVLTQCKEAENLGKRLQELLTRITSLERNINDLMVLKNTVQELREAYTSINSQIDQAEERVSEIEDQLNEIKWDYVKRPNLPLIGIPESDRENGTKLENTLQDIIQ

SEQ ID NO: 924462 - protein, 139 aa, Homo sapiens
MPHYSWHSPSQLPLARRGSSLTPCASWLRGHTTLLLLALCGLHSLPNLWITSLLIFGDSSLRDGHLSFPQLPWLLAMGTKKAPRSYCKLRLFGMAQVPQRKSNWKVHYRQMVKGTGIGNTTNGPQSGFKEKMKVVKKEI

SEQ ID NO: 924463 - protein, 139 aa, Homo sapiens
MEVWFSGQWSYILRAIMAASSESYRSPEKASSHRPHLLPTQPKSLKASLTPTVPPQQHRVYFLAAETQGEYCASQPLEKRQTTLPPTFVSDAGEHVAASNLPISIVVTKHQTKRQIPGTENPDLRKRESERALFNSVTY

SEQ ID NO: 924464 - protein, 138 aa, Homo sapiens
MLSPLNRTFPHWRSPTRRERAVCGDPYSELFLQELPQEHTRKAERIYRPLKEVDCHCRLHGTAEELASMYPPYTITADVLSKAPPLGWRPVNTKPSHLTKIQPRTITESISFPCYLHQIPDCPSDIIHPNENKPEKQF

SEQ ID NO: 924465 - protein, 137 aa, Homo sapiens
MLLMGSFSDFCPCDESARNTPNPGSIQPPTCPFTYLITNQPPGTENGGHKHHCGHQHWNCTGSDLKPAQHWVSPKACLREKAILPGKSELVWLPEKSHLDVVTKGMVLNMEIGESIVSTSRVNQAQGNNSHQPNSQV

SEQ ID NO: 924466 - protein, 157 aa, Homo sapiens
MPTEAQAPSVGTGLLGLPDCFLGWKRRQWELVTRLCRTKDTADPGPRLHTAGIVEFSHSCEPGIMKMEPQCWRRTVATGPWSRVHSRNGSGLKMGPCCGSLAHRGLVGDGECTPCTPNVEKYSCSNSWKLSKLGSELSSCLLLYNVQSLQLYLAGGR

SEQ ID NO: 924467 - protein, 149 aa, Homo sapiens
MPGRLVKWQFLDYIWEPISVAAPAASISSPEEAFCKELSAPSGVDTELVHYASMLLSSDVPSCSAEFRKAEESLPMSINITRHWEYCHDSADVHLRPKGFVVSLWSMLPCLEFTFQGSGLPSGPGPEMPSKSQLWNQGPEEPTWFTSPL

SEQ ID NO: 924468 - protein, 137 aa, Homo sapiens
MHRKGGEDNELFLAAGWGEKLEKWKARWLFMINRKGDIQKEKSSRGVGGYRGNGQQGHRRGKKRLLEATGSSLLCVPTDSSQYDYCSSSSKWNYQASRSSRDTPRNIFDSSIVHFLLFNLSGETIASWCHRGVTIVD

SEQ ID NO: 924469 - protein, 150 aa, Homo sapiens
MWSSEGKMHRNRAAQEHLALCVWDVSKHPGPSTANGSYNRGDVLNAPVWTLKTVIKHVTLPPINACNEVLTSKCCTKEILYTIATRNKEKSFAPSLVIDFLPSAATYSNVANIYKAPLCAELPGQTIQRISNKTNTILMAERTGFPFALA

SEQ ID NO: 924470 - protein, 145 aa, Homo sapiens
MQLYEYAKDLFQQRYHHTKQLEHQRDRQKRREERRLQREHRDHQWPKEDGAAEGTVTEDYNSQVEDQSEWEVSQRIDLINPFKELKAKCGSPAAPPDRDLEMLLSLCLASSGVQGKALSGGSLAPGTERGPFHTLNIFCTTNGYC

SEQ ID NO: 924471 - protein, 150 aa, Homo sapiens
MFQDSAGVCKWLGHSAGLAKQNICVSVYFIHPSLGQGLGVRPLQLVPLCEERYHTSWPGLGSPSNGFQRELDDTVWGQGMGRWVLIAMLQSIYFIIRSTVTIKKVGHGSDMTRSLKRYMQALPRTVGLDFESDSVFSDQEPQNGKDVMKS

SEQ ID NO: 924472 - protein, 178 aa, Homo sapiens
MPECFLTLARMTHQDSCSRVDGTGVEVKIGITSWCQGHNLIAESDLQRLPLPVSALDFQLCQNLSPRLNVAECLKVVPGVYVVVGFPVDSDSQQELNIAVLADEQTQIIVKEDNALRQGSPTPGLWTSPDPWPVRNWTTQQEAGGLVYQDEKAFLVTCQTNEDNYLLLSSEDSTNESH

SEQ ID NO: 924473 - protein, 146 aa, Homo sapiens
MAGKPTGNSSPELKEVPEEQSKTAIECHNPSSPPPIVDPSHLACQIPNGIVNDYLKYGCPDPKDAPITCKEGKLLRYEKNLLVSLTRHNLGSSNQTPNGAANRTTYGHNILPRTLRSTPGGALAAVPTGRPFAAGSSQKELWPKAP

SEQ ID NO: 924474 - protein, 141 aa, Homo sapiens
MFLTLRAVVNWDISMFGTVFRLSMDGPYQRLQNHTCRSLLLPFACVASCVGPSGMQKTNLPHISIVAGLLHLYILTGFTQNLSKTEPHKFKLYSMLHISMSSCYSRLPRPQVKVEEKETEVLFLWQQQSGLGTFADGLREI

SEQ ID NO: 924475 - protein, 137 aa, Homo sapiens
MGFTRLMKFSAAPNKAFLFGNTHCVSDWLSVWRAAGPRLTPWCLEKQLGPTAMGPARDRTPPMAKEKVRQLLRRTSETLPTYSSQAMSKAFLVRDPNLTKALGRMEAALSMSVVRVTLLPVSRGDLLLLLRFMLPPG

SEQ ID NO: 924476 - protein, 192 aa, Homo sapiens
MLTPSVMVNFSRQLDWVQEYTDSWQNIIPGPRTTELQVLRPLDSDRITLQTSLVLLPADGVSHDFSVSIIRNASVTSVCLPYQEARVTTAVSIFPAENRTKNTTKNDGIQLLAKGQNVPTKGDTVKKWTTMNTNNSGPWNITMNITNTHNYHKISTALSALFSASSVLNMLVKALFDYVPRVDVMEVQLKHR

SEQ ID NO: 924477 - protein, 139 aa, Homo sapiens
MVELVYNPTNSVKVSEKFDRLKPSSLNLSKSFSIQLCYIAGKELHSFGGEEVSGPSAAGLLEFAGGPLQTLFAWVSAAEVAEQRILLKSKCCCLIFPLQASSQRGTQPSVVGSTQFELPGCSVYLLKPQQWQAPLPQPC

SEQ ID NO: 924478 - protein, 209 aa, Homo sapiens
MERVTKLSPTECGKLDSLNVSFQTHASKEWITILLNLKVWYIGARRWCAFCNQWVENVGKIREREMSQGAAAFWKLKRCDERTQPIVAGFENRLKRPQTKKCGWPLEYGKEVNHGTQSDPWSTSTRRVVIKIEMRLGAQGETFEPCEFRKHFLVPVAQKEWFRRRQERIEAHEKAANVLATCRKLHLLSPLPLLRKNCFCAFSGESLSM

SEQ ID NO: 924479 - protein, 141 aa, Homo sapiens
MVWRENGRCFSGLLQAGLGAAWEPRVGEIKLKEDFVEIQHSPASKDYVFTSRVKSGSLGIAPGDISCDGLEKQCKPAVPGGNAINKSSVIRVRNRKEGNMGKWGEYQVDQRDTVMGVRCGIRNNVGGWIEVQARNNGNCGT

SEQ ID NO: 924480 - protein, 146 aa, Homo sapiens
MIGPGQSDYFIPQQTEIDPKSGNMSSSLVALTSGAVTCGSPSPRHRKGRSADSMHHVPRKNCRHSTQPMKTALGAIPCRATGMELPMAVGTHPLHQCALNVRYGAKGDFGALRFNDCLAKFWTSMGTEDLCGIKEASKNTVYLRIT

SEQ ID NO: 924481 - protein, 169 aa, Homo sapiens
MEPAVEMTNVLLEGNVNYMELGDIQQEIREIEPDYVTELLLSLDKTWMHEELLLMDEQKKWFLEMESIPGEDAVSIVGITTKDLEYYTNLVEKVTARFEWINSSFKKSSVGKILPNCFTCYRVLFHESKGKMDAVNLTVVLFQEIAIAIPTFGNHHPGQSTASTLRQDL

SEQ ID NO: 924482 - protein, 228 aa, Homo sapiens
MGVPLHKLPCLLPCPLRVIQNTFQKYLTVGSSGEVPLCQILSFTDLGLVLRAATFQRFWAAFVCRSPHQKAKIWDLAIWQCPEGVCLFHYIDNIMLTAGSLANLEAAVPLLQQHLAACGWAINESKVQESVLSAKFLGVIWSGKIKAIPEAINDKIKAYPQPTTVKQLQTFVGLLGYWQTFVPHLAQMIKSLYWLTKKGATWDWDDVAETTFLAATRFNSAGTSPMGS

SEQ ID NO: 924483 - protein, 162 aa, Homo sapiens
MWKLSVICEWQCVSSSVGPLPHHVGQTLFAGEDKGPVGQPFWVPALGKQELGRGKEKDLVNRKQVIGMAIMMGEKSEVSLYRYDDLGTSWGSLPVGSAARPGVGKRVQDLAGHFGCWQEQALAGPTAALSSAVHVQSFAVSSVGPLPHQVKWLPLYEDKGPL

SEQ ID NO: 924484 - protein, 140 aa, Homo sapiens
MRLRPSRGLGPTLILEASPTSCIYVKHKLCPCPYHVTKQQLQRLLPDSELSTWPYPTTVLFSQGRQLCNSALSETISELSQKLNLMTEFNQWSHWTMEHSQQYHMTAVHRKLSIPAIEPGTKNCLFVAPTSQPTQNPGLD

SEQ ID NO: 924485 - protein, 215 aa, Homo sapiens
MIVRLPSPYGTESIKPLCFINYPVLVSHHWGYLTIMVEGEGGAKTCLTWQQAREHLQLTSFSCAGCFLPSNTGLQVLQLWDSDWLPCSSACRQPIVGFVIVWEGPEDIPLTKALQNRFVSVAPASLKSPVIALFCAIKNIHDTLEKVKISTLTGVWKKMIKTLIDDFEKFKISVEEVTADGVEIARELELEMDPEDDFSNGSRVAYIRQCIKPYI

SEQ ID NO: 924486 - protein, 156 aa, Homo sapiens
MSCNILTTLQSCFLGKIFPYNGRSHKSWKCENNSTDHFWFEDRGLMRGNAGFPNLKSVRELILKQGQAKVKNKTIPLTDNTVIEEHLGKFGVICLENLIHEIAFPEKHFQEISWFLHPFHLSVACHATKNTVDFLKEMDSLGHQGKRTNQLIHQLN

SEQ ID NO: 924487 - protein, 154 aa, Homo sapiens
MTLYHIVRHLLQAWLFLQVIPPSVKLSAERRPVTGSPSLQAGHPSKCVALGGEKIRRESSFLQGGCPDKCVSLGFFNVLRMEEVYVDWSMGGHKFQAFPGLKVGFHWGLAASCLGTCLPLTCHQWCPGCPCYEDPAVQDQAAFSNPWTPYQAVS

SEQ ID NO: 924488 - protein, 158 aa, Homo sapiens
MLEKEQFQKRKYSGEPVVTRGPCSQSSQDGGGPLPKWRVASKMVARLTFSDLGFLASQIPSIRIWGHAPYQKWQWVRHWIRSTADTLPDPEGWKLAVGLQRRQTAVVDGERKLSSSRNKHRPEDSSVARFNRVKTELPYKGRGPKKGAPTQREGTQKG

SEQ ID NO: 924489 - protein, 260 aa, Homo sapiens
MWQYIKAFLNSLWLDAAADATQTAELKHTWPLGELCTSRAKYCNLVGVVIVTSKDHSTVPSIQLLQDDGESGKGCNIINLPPGSWLITQRNGNILRAQRWSLLLANWALSSGYSQVSLVADHPAKPLATAHESLYNRTSGHFSFHAKCITRCTAQSSANWEDFLSLLFFRDVLERGCSAAAVHFRVVPAYCAESSVNQMCPEFLPLGVFMVLLTSGMKPQTFTVSVTALKGGMSEVVCSPPGWVRGLTSGVKLHTFTCLQ

SEQ ID NO: 924490 - protein, 144 aa, Homo sapiens
MTWLQRGATHSRAFFLLTAEHSRGQPAYRDELPTAGHLSAVLTLHQAPRHLAHPPLVCILYSSWMQDKNSAKGTTGHRGFQPEKQHPKDPGEEDKGGFCSHRTVRFYFSTPNSLLHHHSRVHTTAGAFQVPSTEGTSVPMLTLR

SEQ ID NO: 924491 - protein, 139 aa, Homo sapiens
METPILKPSDLVRLIHYHENRMGKTHSHDSIIYHWVLSTTHGNYGSYKMRFGWGHRAKPYQAIKQPPTLSDIKIAHNITPYQREGIALQTWQEIPQAISDSYSQILSGAQDNFLDEFYKPVTAQNSDQLIVFKRCSSKS

SEQ ID NO: 924492 - protein, 137 aa, Homo sapiens
MAGQASGNLESWRKEKQGTFFTRQQEGEVRPKPNPEQGLSIFNSMKAKRDDKAAEEKFEDSGEGQNINIKRSLEEVDPNVKDNFEESKTSVEEVIANVVELAKFLGLKVETEDHPSIHIKASSDGVESDYTARPRAT

SEQ ID NO: 924493 - protein, 191 aa, Homo sapiens [sequence omitted]

SEQ ID NO: 924494 - protein, 152 aa, Homo sapiens
MGVIYQETSISLSPWVLCCFCMVVPFLLLELPSPGDIYHRWAVSGRMGLQDGETTSAILSRKKFTTERLDYPGDNQLRVRHPFSSDDKHFTTCSLSEVCYLRDSSGQYEKRDITIETIEIQRIIRDHYEQLYTNKLGNLDEMDKLPDTYNLL

SEQ ID NO: 924495 - protein, 127 aa, Homo sapiens
MYKKINDVFMPTNRTFILQPMAQGVILIFKPQRDALLFPPKEDAAKRQYYEPECRPLLVTEIFSCLDLGLLNLQNYKSGGRCHQTRNAAIEAAKGKETDYLLEPEERVKPCRGQEPRTRQTVGAKEL

SEQ ID NO: 924496 - protein, 141 aa, Homo sapiens
MVDPLTSWHPAPGKATGTQRQPMKAAPGASCEERLSYQCEENDTVLQTAVKEVAIRVIKRAQALVHNVFVVMKMRSLEWKPVNKDLQPENLVEFWKLKPSKCEASTKTADRGDFYSHFSPYLASNNSSKLQLSDPTSLWVQ

SEQ ID NO: 924497 - protein, 161 aa, Homo sapiens
MTDPAEQCSYPIDGEKGHTSDPEEVKNSHVVNCLWEVQQVGDYTRPVGSVGSLHLIVCNNVDFQPYSQKKYMYVCLTVFVNMKIKQGSSMDPFMVLVKRLTHLRSPQLSTPHGNGNTQPPKIARAHQPFNIRLVLLTSDDLQSYQSFKLPGGKKKTHFYKF

SEQ ID NO: 924498 - protein, 230 aa, Homo sapiens
MFKELKDKKLPMKNTVSSKEICISNEEPNVNHQDNGKNISRECQRPSWKLLPSLIQRLRSKTWFLGPSSGPPCSVQPRDMVPCFPAASAPFLAKRDQDTARAITTEGESPKSWQLPCDIEPVGPQKSQIEVWEPLPRFQRVYENAWMSREKFAAGAEPSGRASARAVQKENMGLEPPHSVPTGALPGGALRRGPQSSKPQNETSTDSLHCVPGKVAGTRKCPSGDSVWGL

SEQ ID NO: 924499 - protein, 161 aa, Homo sapiens
MVGSLPLFHANPSNKWLLLLLLAKKMNSDKAMWATLKFVCSFSSEKQYPDEVGLHMIQRPQVPSQYFEMQDTVIRIISCLSNIISPHLPLTLNHSAIRNALCSGTHEDGERINSEKGNELGFLVNTFKRSWDSWRGLLTFPFAVAFRVWNSEVTIRGPVVI

SEQ ID NO: 924500 - protein, 151 aa, Homo sapiens
MLRLCCSYNARPDNTLTNFRKSGKFGLYTDTSWKQRIQVPPEILRSHIKNHWIRGKMGANYKTMITLGLLATNNSMSDLRLKDMFLLQDQENILMFQVSHPEKQIPYGYRRETEVLAASHLFTSERKQVGDSTRKSRDTSQLGRMIKESES

SEQ ID NO: 924501 - protein, 193 aa, Homo sapiens
MGTQCKLSVDVPFWGLVNGGPLLTTPLGSAPVGILCQSTTPTFPFCIALAEVLYESPTPVLSGHSGISIHPLKSRWNFPNLFLTSVEYGPSKCMGVFAQEKNDSDSSDGSGQSELKAVWKELTIPDVIKNIRDSWEEVKVKLTEICKKCTSALLDDFEEFSPSVEEMTADVVAIMEIKVTKNVDGQRGGEMVQ

SEQ ID NO: 924502 - protein, 187 aa, Homo sapiens
MLKRQVLEQQICSCFPTIAFTFITIHCLGQFPTPYPKTLEALHVQLTLVHNDVHWELKCNSRAGGHGQEAQPSAHLERFIDSFKMGTRDGSFLASSGFLHNWFKSCGDHPKIKCACMWVFSIYCILFQMLTDSHKTKGKLASKVPAHHPKQNLKGYVQRSALALGQSSKIKLLTFNKIPVKTLNKQR

SEQ ID NO: 924503 - protein, 554 aa, Homo sapiens
MLPIYKGRYCVGKRKRFRLCNLQACPAGRPSFRHVQCSHFDAMLYEGQLHTWVPMVNDVNPCELHCRPANEYFAEKLRDAVVDGTPCYQVRASRDLCINGICKVCLVRKRLSQHCLPPAPLAGPRTWGCDFEIDSGTMEDRCGVCHGNGSTCHTVSGTFEEAEGLGYVDVGLIPASTREVRIQEVAEAANFLALQSEDPEKYFLNGGWTIQGNWENLTSPGPTKEPVWIQLLFQESNPGVHYEYTIHREAGGHGEVPPPEFSWHCGPWTKCTVTCGRGVQRQSVYCSERQAGPVDEEHCDPLGRPDDCQRKCSQQPCPARLSPSPWLPLQCSVTYEEGTQHRNVLCISDTGVPCDEAQQPASEVACSLPPCRWPLDTLGPEGSGSGSSSHELFNEADFIPCHLAPRPSPASSPKPGTMGNAIEEEAPELDLPGPVFVDDFYYDYNFISFHEALSYGPSEEPDLDLAGTGDRTPPPHSRPAAPSTGSPVPATEPPAAKEEGATGPCAQAPVVVASSGHTLVKCVNTQTGLPEEDSDQCGHEAWPCELPAVWHRGL

SEQ ID NO: 924504 - protein, 164 aa, Homo sapiens
MADRLASSTKNKSLCCPFGVLWSSKRKLSPDIAPPKCATSSETPCHAQPVDSQPPPSLPPSTKHGGAVQAAMWPDSLYQSCCPSAENQTHFRMTENVCYGSPHEIHQVSPGSIQVTGLEGPQQPSWTCSDTLGLLIQWDKLQDPVKETGTHQAEQGLATLMVKG

SEQ ID NO: 924505 - protein, 460 aa, Homo sapiens
MWSPPLGGVECNDVTSATGIYGEGRASSTTLEDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLREQEERQREQEDRLHEQEERLREQEERLCEQEERLCEQEERLREHEERLCEQEERLCEQEERLREQEERLHEQEERLREQEERLCEQEERLREHEERLCEQEERLREQEERLCEQEERLREQEERLCEQEERLREQEERLCEQEKLPGQERLLEEVEKLLEQERRQEEQERLLERERLLEEVEKLLEQERQQEEQERLLERERLLEEVEKLLEQERRQEEQERLLERERLLDEVEELLDEELERLRELERLRELERMLELGWEALYEQRAEPRSGFEELNNENKSTLQLEQQVKELKKSVKNEFE

SEQ ID NO: 924506 - protein, 1589 aa, Homo sapiens
MQPLVLFERSLYPGSLLCSGKAHCTLDAAGRGARPGRETPLGPRGGESELAEASGSRNLQGGDLSCWEFLGLTSCQVKVWAGHKNHPEVTVAMALTDIDLQLQFSMSQPEALLLLAAGPADHLLLQLYSGHLQVRLVLGQEELRLQTPAEILLSDSVPHTTVLTVSEDWPTLSVNGFLNASSVVLGAPLEVPYGLFVGNTGRLGLPYLRGTSHPLRGCLHAAALNGRRLLQPLTPNKHEGCAEEFSANDDVALGFSRSHSLAALPAWGTQDEGTLEFTLTTQSWQAPLAFQAAGWHGDFIHVDIFEGHLWSMVEKGQGTVLLLNSVPVTDAQPHKEHRSGLTPGAANASLLGWLHGRPQCQWLEAGAVGSLADAQHGGWLQTGGGGGARFIHDGPEDTSDQLVLEVSVMAWVPMPSCLRRGQTDLLPIQVNPVNDPPHIIFPHGSLMVILEHTHKPLGPEVLQAYDLDSTCEGLTFQLLGTPSGLPVEHRDQPGEPVTEFSCWELEAGSLVYVHCGGPTQDLTFRVSNGLQASPPAMLKVVAVQLAIQIHRSTGLHLAQGSAMPILPTNLLVETSAVGQDVTVLFHVTGGLPFRELQKQGAGGVEDAEWWVTQAFHQQDVEQGHVRYLSTDPQHYTEDTVENLDLQVQVSWEILSNLSFLVTIQRATVWMLQLEPLHTQNTQQEALTTAHLEATLEEAGPSPPTFHCEVVQAPRKGNLQLQGTMMSDGQGFTQDDVQAAEVTYGAMARASVAVEDTFCFHVTAPPYFSPLCTFSIHIGGDPDMPVLMVPEGGECVLSADQLFIKSLNSARYLYEVMEQPRHGRLTWRGTQDKITMVTSFTNGDLMHGQLPVNDHAPMQTISCVFHVAWGRWRLLTTDNMAFSNADSGFAEAQLVLTHQDLLSGRGASGRGESCSHTQADHGWIPLQVSDGQHQAITVLEVQALEPYLCVANGSGLMVPQGGQGTINMAELHLGTNLNICSRDEAHYHVTDSPHWGQLLQATQPATAFSQQDLLVGAVPYGHNGSLSSCNTLAFSMDVGPVHTDATLQVTIALEGPVAPLKLAQHKKIYIFQGEAAEIRRDQLETPVYPALFSEPRPGPGGSVKGFCLPRNLTEQPRAFQRSDMPCDLRPVLARSQPYSSTLLISETLLVCIWSLGPMVAQEAVPPADIVFSVKSPPSAGYLVMVLRGILADEPPSLDPVQSFSQEAVDTGRILYLHSRPEARSHAFSLDVASAWVLPLRTSRGAGGAACCHPHWGHKTSAVEGAQSQLHPGPSTAPRCQVLLPHSPGPWPAGAGATPAWGPAEGGWASSQDPQHLLLERGGRASDPVPARWEQDTDGFVLMANASEMDRQSHPVAFTVTILPVNGQPPTSYKLRPAGGGLMVRRPQKSGTQHPGTTGWDGSVAVRPPGGAIYPCLFREPSDGALPPTVWPLLPRLGLRAPCGQGRKPRNARGLFSGHTWEGATVPIPTEALRSMDGYSGPKDLVYTIKQPSNGWVVRWAVPGTEVRSFMQTQLDGGLSPSSHSAARASEPAGTDPQLLLYHVVRGLQLGRLFHAQHDSTGEDLVNFTQAEEPRPAALPQVPPEGTPVSP

SEQ ID NO: 924507 - protein, 119 aa, Homo sapiens
MIALRETNNENGLVDGGKVGMQPLVLFERSLYPGSLLCSGKAHCTLDAAGETNNENGLVDGGKVGMQPLVLFERSLYPGSLLCSGKAHCTLDAAVLECLEDAKNNNSEVASEHLKIPVL

SEQ ID NO: 924508 - protein, 210 aa, Homo sapiens
MSGLVGKSEKPGTSSWQSKAIKEELMERSKGGRAASLPICGPRPKAVEGLAPLLVSKATGRENDPEAEQKNAKTSWNLPDISDSTHYHNDRTAFYEKVSVSSSHPHFNTLGPQDRQREVWVSLAQDGGTGAISAHCNLHLPRSSDSSASASQETGITDVCHHTPLIFIFLVETGFHHVSPTGLGLLASSDLPTSASQSAWITGVSHHTQP

SEQ ID NO: 924509 - protein, 149 aa, Homo sapiens
MLSDSPKSTAVFMAVSRLRRAGAELGTKKGVSWLQLQCWEQPWASAARGGPILLRPLSLPLRLQGTDSVPVSACSSWLYDPVSRLDMFEEEEEQEEQLCAQAQPAEGQQLSFPSSLRTLVLMRPLGAWVWFFSVSQDKQMYLGSVHDFS

SEQ ID NO: 924510 - protein, 124 aa, Homo sapiens
MSQMLLAPPGPHTSLSSLTTVPQNPAEYSNFWCLLDTYFSCLVSEMDLQANIMTSPSYRTDVDQEGQTHMGVAAHAGPSSCSSGVGTDPLSPSPSPSLAFRELIFCRHAWSLVRAGQLSTQGWK

SEQ ID NO: 924511 - protein, 147 aa, Homo sapiens
MSVLLPAALLSAISRSHATDNPFTKTFNSQKQIVQPDSINRWIGGIYLTKEVKDFYEENYKTLMKEIIDDTNKWKHIPCSWMGRINIVKMTVLIRKNNSKIHMEPKGACIAKARLSKRNKSGGITLPDFKLYSKAIVIKTAWFWYKK

SEQ ID NO: 924512 - protein, 139 aa, Homo sapiens
MTEPLSHPYPRRGSWAPGDLKVFPLPQPTDGLLMDKEAVEIDKWEVKKEKNRKAVTQILVVSIGGHASWKECSKLLQQGKMGEEMHQLFTAVAQKGHSKVSHVTRAPISFTRQVMNRPPLGNHRGIHDYSVSMTSVRLI

SEQ ID NO: 924513 - protein, 160 aa, Homo sapiens
MAVLWNRKGGKSPWCRALSGNRPRLLGLYGSEGERSILELRKTLPRAAFAHCDGAPSTSLAQRRGSVNYLQTTRGTVRVLGYDFKAEELPIFLATFYHYSNLIRMKLQIRSSRLNYFNNFCNVFHYLSIIAYSSNFKNPFSKTNAFSKWSFPLGTQVFYS

SEQ ID NO: 924514 - protein, 152 aa, Homo sapiens
MNIPRLQFHPVLPLPSLWFSAAGDAERVAAARLPSFVKALGAPRPAGTWHAPSLPPGCPRGRSSPPKGPPRKSPRGHRRVCQLNLLQKWKRSQKRQQRRINLQTKKRKQKGKGEQRENRQKWLTKKLKKIYLQKMIQDSLHIVLDDSYVLNA

SEQ ID NO: 924515 - protein, 147 aa, Homo sapiens
MIVLLGVFLGKVFQGPFRELLLRENNDDFCEEDHMDPEAVQLLETKTLLLQMDATDRPITHGTHISHCSPRKCQVVYRPGFDPRLFSLLTFHIHRQWSGVAVNTDSIEPDFLGSNGSFASDHLGNHPGAVMVDFMYQLDWAKECSDS

SEQ ID NO: 924516 - protein, 139 aa, Homo sapiens
MGTNSPQYRGSYVMELLSPDLKRSCSFHCCSLGAPGSNEEQPWASCQMTATSVPDLEGGNATLENAEPCWSECRGSGVARTPPWQAPPPWGAPPPCNSHALCAYAWYHLQMSQFLTSPWLQSQPQAELCNQGRGRKGRC

SEQ ID NO: 924517 - protein, 123 aa, Homo sapiens
MVTPSLGSGNYCLYCRTELPDPQKDKGGCSGHRASNDWHLALPGCGFSSQPNTFPAHSRCSICVYPVSISKACVPPLYTEARSSVVDSEEEPLDRVLGHLYENPGLAEQQLEDQFSEVGPDLL

SEQ ID NO: 924518 - protein, 153 aa, Homo sapiens
MSSGEVVEVGGAWNKLGDCWRGHSDEDQNISTSDTCYSDRDARVPGRMDSAHLLSQLGLAFSSLTQSQQADCRPTLRGWAQGTSQQASRSPGGNSERQNSFTQTHHSAVLFGAGLQKAVGQAGLKLPTSGDQPASASQSAGITGVSHCVPGSR

SEQ ID NO: 924519 - protein, 148 aa, Homo sapiens
MAPMSWGESDHLSPGSRSATSRQTPSLAALSPVAKKGGGLLYSKAPEPIPAAHQAKNQEMQVQLMNLFPDAGFQVSCVLVQATPGTDTGTNVEGELEVTHLTGFCILSGFLHPCTKDSDSSLLGFCFCRNMSGTGFQTPSHPDGSGGH

SEQ ID NO: 924520 - protein, 224 aa, Homo sapiens
MGDAPEEARLESGPPYEEVVVDGDRSQHSLAAGRHDLKIQKCECPRTTLTSGACKLVDHWPSLPAPRAQSTQFLRGSSETCLIPKPKLLKAYTTSLPVEYQQKAGHIVVLAANVTIILNLTINITNITITIKIAITITTVTVTVTIIVTIINITISFTINGPVITGSRACQIISLSFSFFICEMRITISTPEVRRVVADSPPRKRCILKGEAMDDDFTQCFSLF

SEQ ID NO: 924521 - protein, 164 aa, Homo sapiens
MVNRPAEAVGLLRALWSALHSRYRSNSTWGFTMLPPSMPKIKMENSFLLPSKALDAAACHFFFTTNAWKEDAVSLAVLFLSQLCQFLCKPSALYFVAEFYNLPIDVVRWRHVVSSSSGLCPSLVQNIPAFTFLAATKETVCSSASSYKMAEPPSARMAELLLGG

SEQ ID NO: 924522 - protein, 218 aa, Homo sapiens
MLLKHLMTGSICSPKTYCFLGLLSAQRAPEFCQVPRERLHSPGGLLSMATQAQLASPRGSCTGAAGAAARQSRPCAAEQEVVLLREARALRGWEKDRKEGSGMAGCRSQALLRREAAEAQREFQRSAGRPALLGDPAHPPQLLARVLSPLLPRASSTGRPLPMHGLPSPRPPAEPTPTRNTRWPAIAACSSPGDCLSLELAVTDDSLRETVNNRPTIT

SEQ ID NO: 924523 - protein, 155 aa, Homo sapiens
MVRAEKMKGKNKLVPRLLGITKDSVMRVDEKTKEVLQEWPLTTVKRWAASPKSFTLESTSVALSDIVGTGERPDSCPLGFSGLGEPAWSEEDGASPWAGKGMGPEVKERSASLGFFRHYCFSALYISQPLVHYLEKATHPDDSQFCVPDDIPSIY

SEQ ID NO: 924524 - protein, 194 aa, Homo sapiens
MDPRENQDWKGQDGEESGAVVWPGSGPEAALPQEVGDQERLLQDRPSAEMGQLLMGLGSQQRCSCLAYEAQLGLSFSGSHPRHPCFPSYTSQPLISPTLEGGPSLSGGEAWIARVALPGGPRHSRWQRKGAASPQNPQRHQDTQGSPTGPKFLQSCHQNAAELENLPLKEGASLASRPRPYSQQSGGEIMGCLS

SEQ ID NO: 924525 - protein, 174 aa, Homo sapiens
MCSLPGALACPRPGSKQLLFLTADPTTHQQPPGYHQSYKKLLMDMVSPDMGQGRAHSPGCDIDVDAAPSSANVCYRTSGPCSMEPATDMLQSAGYAQSHQRPLSSPLTPTTSPTKPCQHWEAGTGPHLWNSQPPHLLSQQSIQSHHLLPGQFPAAGPERDSGTLEAEDTGIFMI

SEQ ID NO: 924526 - protein, 154 aa, Homo sapiens
MRVVCMESGGRKNKDLLHARPLEQGGVVLGCLCADNVSRALNAGHVCLSLLGLDRGPTQLICHTYFEYHWICQVARPTGQQLLLQLELAAKPSPALHPTHTIQPYECDASIARLSAEHKTTYEGLQHLNKEQQAAKLILETKIKDAEGQEHGTF

SEQ ID NO: 924527 - protein, 150 aa, Homo sapiens
MLREPVAPLTCINRRVMSTMENYVLANLPAKHKIDQGIRRPPAAEEMIARWESWAKDQPIFWYRKCNHGNSSEGSSSSISNDTLKREIQSMKRIQYIIADFEDGGCQVPGLRVAFGIETSPWLTASKAMETSVLQLQGAEFCSQPDWVWK

SEQ ID NO: 924528 - protein, 327 aa, Homo sapiens
MVAKAKWKPLELPLPRKIVNQKQYCIPGGTVEISATIKDLKDAGVMIPPTSPFNSPICPVQKTDGSWRMTVDYRKLNQVVSPVAAAVPDVVVLLEQINTSPGTRYAVIDLANAFFSIPGHKAHRKQFAFSWQSQQYTFTVLPHGYINSLPWCHNLFLRDLDRFSLPQDITLVHDIDDIMLIGSSEQEVTSTLDLLMRYFCARGWEINPTKIQGTSMSVKFLRVWWTLLSTGLEVFVPEGGTLPRGNTTMIPLNWKLRLPPGLFGLLLALRQQAKNGVTVLAGVVDPDYQDEISLLLHNRGMKVWVIPPGKNHDLLRCLLKAKGIQNG

SEQ ID NO: 924529 - protein, 146 aa, Homo sapiens
MSNSASTWCFLFPEIKYHHLILAKTLQPQQENIVCKCRSQPGHWVSNKKAPDALVAQRAQLLERLPVRNLAFQYQGKWLLGRVIKSQVPQPAELCNWATTFSRLFKNESMMSSYMGVPITYSVKPVLSNQELKTLNNFLPSSVPEF

SEQ ID NO: 924530 - protein, 143 aa, Homo sapiens
MKPQTEPDLSENGRSHRVLRGSGLTTLGTTPTLADNHFLGISVRITECLENFSSVTCQVHFDSASGASGPGPALCSFLCPHRPGFRHSLCPGSPSKVLKMASTILTSPPPQDSLLTATPGSVSLFPGSGIFPQEMPLISFCFL

SEQ ID NO: 924531 - protein, 144 aa, Homo sapiens
MDDTVIRNGSANPLFHMSTCKSILQDTCDHQNSDPNPLTSISSSINRRTTLKAAVRIQYEKGHETSGTFHKCYFPFLSLSDTTHKQQLPLRGPSLQSRTSWCFLLFSPHTHWLVGKRNILGQATLCWSPAQQPICARFQMREIL

SEQ ID NO: 924532 - protein, 161 aa, Homo sapiens
MHESLRTNHPDKPITTFRMELASSSEKMEHLKMIYVYQHMCEFEYEKFFQSHAFQGPIKISFFPFPMILLSFQGKNCMSTKNGAFSYFHKSGPCELFSTPDRGKEKFVYCKKNHSVHGTQCDGNTFSLQCWGGRVQGTVTDYTLQALPPELSGEGSAFVQF

SEQ ID NO: 924533 - protein, 147 aa, Homo sapiens
MPPLASSITKCAIFVTCPTSSLGNPVICCLSLNTVPNLLAEPSFTLSCDQVIVLLLLLLHLFADDGQVDLFSHDPFLCPTPHFQPLTGHLHSQPWLVLPFLPVPTAAMLVQSPVTHNKMNSNVLFSVSLMEQMPSSLFGLESVPANV

SEQ ID NO: 924534 - protein, 141 aa, Homo sapiens
MSQKPQHSQRKTWTFPSDENMPEVMTWALSFGVPVVVLQEILQAGLGGHWQGKPDLREKGGGWESTEQEEKRTSDRALGGTMAGKQFGLHMQQQTTLDSNPVLADLLELPQAHSILIHSRQDHRKKKAPMASVTSMGPMTG

SEQ ID NO: 924535 - protein, 186 aa, Homo sapiens
MDMKRRIHLELRNWTPSAVRELVLDNCKSNDGKIEGLTAEFVNLEFLSLINVGLISVSNLPKLPKLKKLELSENRIFGGLDMLAEKLPNLTRLNLSGNKLKDISTLEPLKKLECLKSLDLFNCEEGEEEDEEDEEDEDGEEEEFDEEDENVEGDDEDEVSEEEEEFGLEEDEDEDEDEGGGRRQER

SEQ ID NO: 924536 - protein, 135 aa, Homo sapiens
MELTNSYHLGCCGRGRNEDPLLLGQDQSKHHLPLWEAQDALSCVKPTGDRRHDRRDRSTSKTPPSETLVHRLCGGWARRMEQHPTVRKPFNTRPQTASTTSPTKSSSNGIYHQGAGKSTQRHLPPGGGQDHASPR

SEQ ID NO: 924537 - protein, 145 aa, Homo sapiens
MALNTELDGRREGGFHPKEKRDRERREKTAVTRRDQGSPHRFLADLSGPYQCSFTALPSSNLDTTFTSVVLSAPSQEAKSKMKQVSKACKYAERLQLGLLLLTGNIVNHNILLDACRALGNRILGPRDMIQLVVPLCQGVMPYKS

SEQ ID NO: 924538 - protein, 147 aa, Homo sapiens
MVKLKQKQGIYEEYEDIRRENSVGTFHCSICGLGMATLGFVTPEAPFESSKPPIFEGLSPTVYSNPEGFKEKFLRKTRENPVVPIGFLCTAAVLTNGLYCFHQGNSQCSRLMMHTQIAAQGFTIAAILLARSLDLRMQSEKSLTEKY

SEQ ID NO: 924539 - protein, 138 aa, Homo sapiens
MLRASSIRLLPSPEICWSSKSEWAGTCGYLDDPSELGPTSGAVMPGNFCGNLASSQYTEWGNSQKTIEKRVRVLKYRVWNPVFPTPCFLIYQLKTANVYHLSSSVGQECGAQLTWVTLPQGLSQGCNHGIRQGCDFIL

SEQ ID NO: 924540 - protein, 142 aa, Homo sapiens
MSKGTINICMLCGDISFQLTQRQVLLVSVEPCYHLQGHHFPDILKSFTSSFSSSSDSAASSTATKCCPLICTGPEPSFNHKTTGGVISKSPRETSDNAEAMPSRPGDEDMGQSQRRAKRTSSMWLRPKGKGNHMDLKQLGKV

SEQ ID NO: 924541 - protein, 138 aa, Homo sapiens
MCHITMFQSRIDHVSDMSFSGDTEEKTGLTFTEVILDHLHQYWLDLCLKIHVPGRHCRPPELRIWSRIFSALGEGAQCPVATGPNSWGLEQPQNSLAVGQFWCKILYIFVMLNKRCTFFSGCLFTLLVALFLVIKNLM

SEQ ID NO: 924542 - protein, 151 aa, Homo sapiens
MTCRFLTWELLNPTFAPGSTARCSAENIKSIHKRDITDFVGCKPERRIFLLYFMSMGFKAFIIPGYASPVPMHLRCKEAGFFVTSCHPSLVEGCSQHLPACKAEAGSSCSVELLVCMNGKCWGHGVPTAAVTGIGASAVCLVLHVHLLACL

SEQ ID NO: 924543 - protein, 257 aa, Homo sapiens [sequence omitted]

SEQ ID NO: 924544 - protein, 137 aa, Homo sapiens
MPAEGLGPLRLGLGAVWEPRVGEIKLKEDFVASEEIRQCQSSAAKPRRFGKESVKEPWARVPGALGVVARMSLEKEFQKIMSSIKPGTGHFHFFCGGTSSVKAGTDHFHFFCGGMSSVKAGTGHLDVYVQVTGDMMA

SEQ ID NO: 924545 - protein, 371 aa, Homo sapiens
MFFSWPLHHWERLQAALPLQGCHLQLLQVGCDLRWGTPFSGIEAAQLLHGRQHWAYALPTAKEEEEDQLHRRCCQGRAQEEVGTVRLRAKRVNPGWGTGSSEEKPHWSCELRAAPGSWHSPPAQPAGLDPGAENARLAADDFRVKYETQLAMRQSVESDIHEICEVVDVTWLQPETEIKALKEELLFMEKNHEEEVKDLQAQIASCGLIVEVDAPRSRYISKIRADIQSQYDELAQKNREELDKYWSQQTEEGTTVVTTHLENSLRVVEVHYTMQREQLNGVLLHLESESAQTQTEGQHQTQEYEALMNIKVKLEAEFTTYHCLLEDREDFILGDALYSSNSIQTIQKSTIGRLVDGKVGSETNDTKVLRR

SEQ ID NO: 924546 - protein, 185 aa, Homo sapiens
MGCPRISSLQGGFVQSGVVSFNVGENPNEIFCFADKVTKARRIYVVGNKGTKSYLITTATTITTIIIRMEVMRWGFLALLFTACEELCAAARPGPTFMDENLPEREFGIAQHLQPQGYSADALSSLIMLPTPTGGFNNGSLFSHSSGGWSSKIKVLAANSNVISSMKPWLPLTEKQAESCTRMPG

SEQ ID NO: 924547 - protein, 145 aa, Homo sapiens
MKERKWHSKQHKHLKQIHIVKKKSGMIITQRDYWPDWTTYSYYVIVAAKFEELEQKSYMTNISGPSAAGLLKFAGGPLQTLFAWVSPAEAAEQQRFLPVPSSGSFIPEGPPPTHQMPARALLYEVSVIPYWEMSLSQETRGTIQN

SEQ ID NO: 924548 - protein, 161 aa, Homo sapiens
MLFWILSMGACNHHCSYKLVKLASVLASGIYNLQLGYLCQPLLVLLAECQQPIVEKVQCKHVAGALQLSMLCGKTSVVADHLRLDLHLAEGFAVVDAHHAAHHLRQDDHVLQVRLHHFRLLHGRYLLLGLAQALQRRVLFPPQTRFKRCCRRALYSCISCS

SEQ ID NO: 924549 - protein, 144 aa, Homo sapiens
METCAWTTLSCRSVGVCRRSTPDPVCLGISSRGCRTADIGEQQMLLPDHSSGSFVLGVPGRGREVNLKTNHMSLEGDPSPTEPQHGSSSTSGLKTQRNSAPTAPATAAILPAKAPSSLPKTASLHSGAIAFRLNNDFYAMNAQA

SEQ ID NO: 924550 - protein, 140 aa, Homo sapiens
MWVSKTETGKTQGHYRCNLTEVPSNLMSRDVTVSLNGGNEEKNTRWNKIKLYPQVCSCYIIWMVTMGAPDSALPQERRSDRRLPRGVLWEGHVGGEAFGYGGRARSFRSALTSDSSSQIKKFSKIFATGKFLESLNWGHY

SEQ ID NO: 924551 - protein, 175 aa, Homo sapiens
MSVHPHPKSWTKELYLVSNCGSNPITSGSHGFPSGSLAWGEESSCSQEQLWSQRACSEREECGPEEMEMKISGNEADVDHFQLLIHGSIITSPPELHLALFFLRSLASFLCKLRMPMRSKKVMNVKNQTYIHLPFHNIPCPLPCCKGNIQELGVTKPLPTVHAWALEEAHSTSIL

SEQ ID NO: 924552 - protein, 141 aa, Homo sapiens
MPGKFFIVFVSLLGSQQKQGQTSVPPNKLPLCLSAPHPNTTVGVDIWDGILGPSIQVWMNGEVLIICGLRCGIKRQMEFDKRMIDPPTVRTVHLEELHTQCQPVKAARREAVPCKATGAELPKTMGTHLLHQCDLDVGIEQ

SEQ ID NO: 924553 - protein, 145 aa, Homo sapiens
MWVASTFWPLLPGADLGTDLSNSGSTFDYFIISNAVTSAAAYTTIRKHASHTNLTTVHPGSCRLARAPDATSSLESTLTLESIALGWSLPSAIDYLSDSSFQFKFTLTEIQDGVVIWPQPRDIAMLALTTPLVKACVAADLSNSF

SEQ ID NO: 924554 - protein, 135 aa, Homo sapiens
MKKENESRRSFSEKEELTQSAMMVLFQADLFLEPVGRKHFSVTFLVSFATQESLNPNNLEYWMEDIYTPGYDSLLKRKEAEFRRAKVCKIAALIAAAACTVILVISDNTKSDAEVMNHYHGLELLDAWGLGIDRR

SEQ ID NO: 924555 - protein, 172 aa, Homo sapiens
MRVLIQLWCKVMNSAVNPSGPGLFLVEVVQGQWSGWLETILGKLPENQIARSECIHSSQKPLFLPNRMGHDPLGTSLPSPLPVEEMKAMGNQQRQRADNILFMPNVCCHLHLGSLSLHSKETVSKVSLQHKRNNIMTALFFPPSAKGSYRNCFCLFRIKFLYKNSQQIFQQK

SEQ ID NO: 924556 - protein, 209 aa, Homo sapiens
MKPQCQSSPRGAWDGGKRNKIEPRLRAMQQPSEPIWKETEVRSSLNPVDLWGHRNYFCNIIASWDLIAQPGCCHLLGSHGDVTRELGSSPAQGWWCLSGVTRCYTANTMASNVTNKTNPCSMNSHVFIGNLNTLVVKKSDVEAIFSNPLLHNTLNAPLNSNICGTLLLAMLRVKLENLARALEASKAIEMDKQQMEDRNENVKRLQLKE

SEQ ID NO: 924557 - protein, 147 aa, Homo sapiens
MAKPFHSVLIFPTLSPSFLLICSLHGSRVCRIEVLNLAFLYLNSFIRKSVTEAKKTSGKGHCSKCFRSIKPLNRHATQCKFSSEKLRIPKMSEESRVVCAKDIALFLGRRTAKEPVNEVHKDKLLRTWIKVESESGEADLEEIQHHP

SEQ ID NO: 924558 - protein, 144 aa, Homo sapiens
MAGDWQAAPPAAPVRDPLGEASWAPESGGDMENLYVCSFTPEASETTSPLGGMNNSRNAALRAVTLTMKVCSFTPEPARPRTHQKEETPNTSEHQKEQTPDTLPLRTVTLTVRVHGFILEVSETKNLPILDTVRPRTHQFRTQH

SEQ ID NO: 924559 - protein, 138 aa, Homo sapiens
MSDLGGILLHPGLGGYPSPFRTGFVLLHVELGGILLHSGIGEHPSPSRTWGTSFSIQTWTTIFLYRGLGGPSFSIQDSGDIILHLKYEFQCPSLDLLYPVSFFVCPGGTWMKLEIIILSKLSQEQKIKHRIFSLIGGN

SEQ ID NO: 924560 - protein, 149 aa, Homo sapiens
MTLEAEEGEGLKGYTLGRLREKEKLGGDKFLLEKNNDRGRARQWCRPLQLSYPYRNINMNNCPHVKLPLQEPTEPQYMNKVMKHLWPVKMGKTMAYRVREPILCDCDTPPSVPLCQGLPVDHPWAHPANVAAVVEPLEDLCLTWDLDSL

SEQ ID NO: 924561 - protein, 231 aa, Homo sapiens
MDGFDPLDVQWSLVFRTKRKFAWQIGSFPFGFFNHLLRSSDTPTSDEIRDSAQEHEAQQERHGGCRAVGGGCRCGFPGQPLSPPLSSCLQKWLCEPFEEKMGDFGLQPEENTVEMEEPLGVRRLTENMRGHKHGTKSVTNLGRALPCVSLRAARWCSWMSPPGAFETATGTGHQAPADWPPHAGFRDLQRSAVQAAGDLNVELLPAPQAPGEAQDAASPPQEGQFGGKSLA

SEQ ID NO: 924562 - protein, 166 aa, Homo sapiens
MYSQELPTPTLGSGYIIQGGAKIEHSLSGGGHTAQPGPDCSSLLRGPPGAVICQPCFPVEDPTRTSPRNLGKARAPQEPPGVRATTPGQAGWWPLGSLPPQPKDSQLQHRAALDRQHQLEGQGRSLQSRAAPGDEQRGPQSSCQRLCPQEPLPASLKPTRKVSTGA

SEQ ID NO: 924563 - protein, 145 aa, Homo sapiens
MSKGVWGNCHAFWQSGMQMGRSQITQSYHFGQRNRECAFLFLLIFALLEVWAMKMGKGRRSLWILPADRGHSGVGVDPKVRGVELLCSCLSCLSVLTQARLSFQGFHDKGIRILIYSFSTTFTQTVYNKKRDSASQTTRPSEAVP

SEQ ID NO: 924564 - protein, 213 aa, Homo sapiens
MYLEPLSMNRFTTALIGQLVVCTLCSCVMKTKQIWLFSAHVLPLLARLCLVPLETIVIINKFAMIFTGLEVLYFLGSNLLLPYNLAKSAYRELVQVVEVYGLLTLGMSLWNQLVVPVLFMVFWLILFALQIYSYFSTRDQPASRERLLFLFLTSIAECCSTPYSLLGLVFTVSFVALGVLTLCEFYLQGYRAFRNDPAMNWGMTGGLLSYSLC

SEQ ID NO: 924565 - protein, 137 aa, Homo sapiens
MHSGQPVALPTSLRHRSRVRQRQAHGPWLSATPDTSCKAREPLGNRTARMLALEQELKEMKKFKGICKFTQKSNRYKSLKDTTYRYFISSHMPNPAKPNFGASPASRPATGGEAAQTSLCSENATLCVLLTPSPLWK

SEQ ID NO: 924566 - protein, 175 aa, Homo sapiens
MFHCLDTQALARAPSIAEPGPNVTVAAAKPGGLPGGGCRGARTENLPLNPISVGCGVGSGLPRTAWPAVLRSGRGGGQEARRRQLPGNLQARQHPQPRRTRASVAVAAAKPGGRPGGGCTKNKNWPQPHPRWLRRAPASGPIFLQRRSRAARAAGRAARLRSYGVPGEPKRTALL

SEQ ID NO: 924567 - protein, 134 aa, Homo sapiens
MCFVKQMLEGSMLVKSHHHSLIASTQGHKHCGSELCVKVEGARGGNDTAVRGLFMEGLPGHKHLDKLLPGHASGMVSLVQLIRGSDPWIEGSRKIKSERIKVQSLQSHKPSVWASKPLGLRGISNCHPSWIELK

SEQ ID NO: 924568 - protein, 149 aa, Homo sapiens
MAWLPESLGTTAVLFETLKTWSKFGSNSRMIGETDQVHRPWWLASKFINSPNKHSRIAIYEGGGGGGVCAESVTMIGCHSCDCHKSVDIELIKRETIQVILGGPGPTRGAFERSHVRRRICFPFTFCPDCNCQTASQNGCATLYSRSNR

SEQ ID NO: 924569 - protein, 160 aa, Homo sapiens
MDLNGRPTKQSGQVFYTLLARVLPGVHRAAFCPAPTPAKVCRNQASALFAIPLKVEDTEEQGIQENEQHSLGNGGAVASKGAKRGPSASGPGRGESCCPLSRGRACYSVALKSGRLQWGSLVKEAPACSSNHTWLDKEAQITKGSLQKFFLAPLYHLFVP

SEQ ID NO: 924570 - protein, 152 aa, Homo sapiens
MESRTSGLPNRTSPSTFYCLCMYPVLKTSAPLSSARTIRAYYQRLKDIPGPPANAFWNHLHIQTHRKQQRGNTHASQKPFIPLGKGGREGSPTLEKPGLHRQGDEHSELGSDSENKLSIPNPNPKVKNPKCSQIENFLSANVYSKEKLTGVF

SEQ ID NO: 924571 - protein, 209 aa, Homo sapiens
MKMWLMRAMSSRWALLSGQAEESLSMATTVQAHGKYCLGTTDVDSRPREGHFSQLEVNVASAESLPSGQWAPLWPREGPEMPSRNQGLELGTPGVHLVLYPTVVKLVPKLFWARPSALLFCEALGPEYKQLVLANSLMENAAVVTAHDWCPYEKRKFEYTEKHQGCAWVEKDYLRGHEAVLDSLCKLSPRPLGIAVTYSIVIMVESPKL

SEQ ID NO: 924572 - protein, 326 aa, Homo sapiens
MYCFPCSPPKLFFTLTDFRPESLQQQLIHVMEHICKLIDTIPDDKLKLLDCGNELLQQRNIRRKLLTEVDFNKSDASLLGSLWRYRPDSLDGPMEGNVLTSTAVKDQNKHTASINDLERETQPSYDIDNFDIDDFDDDDDWEDIMHNLAASKSSTAAYQPIKEGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAGFNRNLCYQFCFEGGGFLMIPEGVNRRLYISQ

SEQ ID NO: 924573 - protein, 159 aa, Homo sapiens
MRNRIGSPHWGRRWQLFTVSAHSALRSSYPQHFPNLPTAPGGASQSNIVSPELTPKPTTALKHAECLLDLNSHSLYRKPRPKAAVYLNLSLPLKSVHRLSLKKSFGFGKRDFENNSVFIVDSGGTCADLREFFWWSNNLCGARARSLEAGLRTPTPAPP

SEQ ID NO: 924574 - protein, 135 aa, Homo sapiens
MLTDWPVTQPLDGGSGPGYSNVHVSKVEELREPQIHTIKGFDMLEVCKFLRNSQMGTQPYPPCLLFHPNLRPVTRRLSLTQMLRGGRPASSCQPGGGEVLPCKSRTDSEWGSVGEMAFILDGNYLVGSNGDIGKP

SEQ ID NO: 924575 - protein, 135 aa, Homo sapiens
MPLPLGLCPISPFATTLVQLFITFYLDHWNSLLAALLPPDFAIIQRPLHQVSLTAVQLETQKKKDGLDVSQVNGCLGKSLCVADANGVGEGEREDIGYLMAGRFATTLARLSQSLIGSAPGSKDFTVIDLQADEL

SEQ ID NO: 924576 - protein, 167 aa, Homo sapiens
MVNGTTISPGAQTPGEDISDTSFLHSKPVNGFLWQLESNIKSSRSRRALQYFGCSVASPGTPGRRPPRSWQPGTSRGSQPSPSCKMKLLLGNLLAQDAVFHIHDGISMLVRATSRTVLCAGRAPMAPLLLAASLSRSVPGTAKGTGPVVTVPAAREDAGEQHAGSER

SEQ ID NO: 924577 - protein, 176 aa, Homo sapiens
MQLMYGVLAIRQRGRSITHSAQGIAPGGYQQVGGQSPQDLPAGQGQLQAQGSHGQGQPGPLVACGLQVKGSPQPLLYTPSERHEQSFSGTGALPAPLPWPLTPQPCSPVLPLRAETREWRPYGNPGASSLRKMLHRALLYGPSSYSLWKEGFDVLPPSRSSPKTLLQPHISGRSRR

SEQ ID NO: 924578 - protein, 186 aa, Homo sapiens
MARGLLISRRPPLGQAALIVSPCLGLLARFTGQRQCHSSSPSRERDQQMLWEAGKEGIQPLAGSSFEQQGAAGPFHTCEGRLWIVTELPAFRNPRFFPTIAVFPSRDSRGRQLSCQHWVPGRPPAHLEMGSITLLRNKARDLSVSDELAPEALVECGEFALPRRPTHLSLGLGQASVERLAGPPLV

SEQ ID NO: 924579 - protein, 149 aa, Homo sapiens
MRTPLLHQHDLDMRHGVKGNYSGALRFDCPAGFQPCVGPEVLFLASFSHLECLYLSNACTPIARRTKQEVEAEAEAEAEEEEEEEEEEEEGKKEEEEKEEEEEEENVKKQQPQPYFTFASGQAPRPLTLFLPQDLDTGSSIKEVIIMDA

SEQ ID NO: 924580 - protein, 135 aa, Homo sapiens
MFSQCLDCPRKRMKALKALSHCRCTLPLWRSHPPELSGNPAPGQKYSGTLTLEPQARSHFQLLPAYEDSQRNVPPTCPWLTVLSPTTSQRLSFLFLSYPNSAAELISSHGTPTLQTGWLAQSSVKTHRIWIRTKP

SEQ ID NO: 924581 - protein, 164 aa, Homo sapiens [sequence omitted]

SEQ ID NO: 924582 - protein, 168 aa, Homo sapiens [sequence omitted]

SEQ ID NO: 924583 - protein, 127 aa, Homo sapiens
MCLVCWGHLLLRRSSWRGAGEALDAADPPALRTLLVVCCQAGSLGYWDEDNENMFVNCAALVTQQVVITIVTSSSSYPFIKPTVMPAHGQQKAQTPWMMGTFTKQSQLRFPNTSIKQGPHYCTLFHD

SEQ ID NO: 924584 - protein, 141 aa, Homo sapiens
MPLGLSSNPERAVCVLIVVLFASQAGREVRGEPEATDAPASHAVNSVPQSRLTKDKPVPWQPKKAVLRQTSAARRKLSEQPRSPLRLLAEPPPFLHVGTGGLAGGCPTSQSLDLEPLSGTQHTQLQINHPSPLLTAILWTT

SEQ ID NO: 924585 - protein, 223 aa, Homo sapiens
MTYGGATETKHPKILSQHSGDSTLESTLERQWVCLNDKYTCGLEEEEVRGRVEASPCQGPGRERIHSDGSNEESECRDFLPRGGQGGRGEGETLQPPEPGDGGKLPPEPGDGGKLPPEPGDGGKLPPEPGDGGKLPPEPGDGGKLPPEPGDGGKLPPEPGDGGKLPPEPGDGGKLLPALACYGNLVTVGPLEEEAWAQRMQGCQRHPLTSLLPPHLLLATPYG

SEQ ID NO: 924586 - protein, 137 aa, Homo sapiens
MHESFHPCCSVFRGGGVEGELALEPGGPAQSLALPLALPKDGGQFTVTAASLSIKQRHDAGPTSSTDKLHFAKHCARQEHAVDLGGHTVVLELLGGFQLFSASTDTYEGSQNAFSTYMAAPTSVTPIKGGPYCKRGK

SEQ ID NO: 924587 - protein, 140 aa, Homo sapiens
MPRAPLPASLPSPSRYPDQMIHGDSALVFLWAALRDGGTHPLRITSSYLGAPCDTDEPTSVFVYVPTVVGGPFVKGRGSLALLEGHVQTPKDVCARTRNTSLPGRQEGLVEELELLEDIPGTAWDMTCERDGAHGHHEGL

SEQ ID NO: 924588 - protein, 138 aa, Homo sapiens
MDFWGEKGRACWEQRQTETEKSSEISTRCEIHRTTQNISSQYYIVTPDSPVEWSTASDQICVFGRRACEQINKLVSESQRRDFVRQEFTKFTCEHMGIGEVLRDGFIQLVNFPDEDCEHPRGEITCPQSPIHSIGSRP

SEQ ID NO: 924589 - protein, 127 aa, Homo sapiens
MWRDSRPTRSPQTVGNKGQPPRVLLSQQEWMPLSTYTDSPELGAGANCRRPEAKQDIYSHRRPGQAVTTVYSFLLPTGKMGTHILESSLATFIKICLKGSQPLDTGIYPKKTIPNTERAICIKVFIM

SEQ ID NO: 924590 - protein, 152 aa, Homo sapiens
MREKPAGSREGHYQATATIWAKGDGGFYQGMERRGAFEGDPEGGANPRGMRKNEDSRKAPEGSALAPADKGHDVLEHVLSGSGLELGDAGAQNSQGKVSQILFSTSISSLAFFPGLSLTCHRKLQDLPPMEVPINALNRHSLICHYFKTDVK

SEQ ID NO: 924591 - protein, 146 aa, Homo sapiens
MAAFSGPAANPVAEPTERCGFQKEVAQVLRITQREKQEQLTPGVVYVCHLHNLLNETQILSYSSQCGTVTSFRLSRQKRTGNSKGYACVEYESEDVAKIVAETMNNYLFGERLWECHFMTPEKVQKELFKDWDIPFKQASYPSVKR

SEQ ID NO: 924592 - protein, 326 aa, Homo sapiens
MAKDAGLIEANGDLKVFTDQNLSPGKGVVSLVAVHPSTVNPLGEQLLAKTSGQSNVNIAQQVVVGTPQRPAASNALGNQPSDSSPWSAGKRNRKGEDNGRGLRHFSMKVCEKVQRKGTTSYNQVADELVAKFSAADNHILPNESACDQKNIRRRVCDALNVLRAVSIISKEKKEIKWIETVSTSKLILQQIAFKNLVQRNLHAERQASQPPPANSVIHLPFIIINTSKKTVIDCSISNDKFDYLFNFDNTFQIHDDIEVLKRVESGSFSAEDLKMAKSLVPKTLERRWPQSSNGSQYSSSRVETPVSYVGEDDEEDNDFNENEEDD

SEQ ID NO: 924593 - protein, 157 aa, Homo sapiens
MATAVATKMLYSPGPPCEVLQLPLEAGVCYEQEPQLHLWVGAHGPPCEVLELLLEAGVCYDQEPQLHLDFCGQRFSIQEEHQTLLCPSEEIDGPQPHFNAKDMRHQWKMKMWVLYLQPEFMASLQKAGTSYTFFCYPFPTKGWAQHVVQRGHFMNVC

SEQ ID NO: 924594 - protein, 261 aa, Homo sapiens
MNGDQKSDVYAQEKQDFFQHFSQIVGVLTEDEMGHSEIGDAIARLKDVLEYNAIGGKYHRGLTVLVAFQELDAINYAILLEACIYYLLKLYCQAQPYYLNLIELFLQISCQPEIGQTLDLITAPRTMWILADSLKTEDPTGDREFFQIQDGYLDLFGDPTVTRKVGTDIQDNKCSWLVVQCLQRSTLEQYQILKENYGQKKAKKVVQVKALYEELDLPAVFLQYEEDGYSHIMGLTEQYAAPLLPAMFLGLVYKIYKQKKQ

SEQ ID NO: 924595 - protein, 141 aa, Homo sapiens
MDVRVEENGIKLPGFISGAGEVGPFNMMGKTEGGPGLLSCDESHLTIQQLSGPLCIALMALGRPGDQQKHDTYVMVKWHVVPGLQYQRSGMEWKTLWKIGGHIPSEVPVRPANCCHRALMLPDLLLFQENPEIRILKCKLY

SEQ ID NO: 924596 - protein, 140 aa, Homo sapiens
MGHWGFRVPLPCSESVQTWGTGASPPPSSKYKRHPQKNPQLISYILNGNRLDAFPPKIRKKVVQGLSPETEMERLMAAWVGEEMLSLLGMGKPFLLAKNGSSEFTNSGSPASPGSSHTSSFQVAGSHSFPIHALTLTVDT

SEQ ID NO: 924597 - protein, 174 aa, Homo sapiens
MALAEQGSVVAVSQLGFSGLHSGSCQVSFTLSLKSWTFLDEKELGGLSRGPGVWGTGLKCGVPRTPGEGISAGGVMDLNTALQEVLKAALIHDGLARGIREAAKALDKCWAHPCAAPNSGMWEEQFQPKSKLKVFSGRSQVGRIGRALVCSSQCERRRKRVISAFPSEVSGSSH

SEQ ID NO: 924598 - protein, 168 aa, Homo sapiens
MLISHPSFGPNNFADSPFQKEALARPNMEPHGKAVLYPLKTGKDNGHFCSTYIAEAPTCPKSESSLIPPFSFSSTIKPSASTSNTTFKIYLQYPPTYFHNHHLTQGALMSYWHDWKGLLPYLLTSSPALLPITLHQQPKQPLPCLTPFHGCPMYPMHKILTVWPCSLA

SEQ ID NO: 924599 - protein, 127 aa, Homo sapiens
MMDAEYQGDRKAARNLATLRSRMTFTRTGTCHGVIGGNQIKAVKKDMFASPSAMIPCGPSFNSHERSRAFCPLDPPACAHQLRSSLRCQLKCLFFKETYLSPAPMEKERMPKSQALPVGPGIGLRPS

SEQ ID NO: 924600 - protein, 173 aa, Homo sapiens
MPQMKKLLFSVLPKLPFFSSDLSLAPAYKMCLHIVGNGSHIMVAKKSYDLLSSNWRTINVNGVIQSESEGLRTKRNDGIIPGLNPKAGEDVPVQAEGINSFFIFLLVLFVSSMDWMLTVHIGEGTSFLFSVLIEMLISSRNTLTDISRSNILIAIWISLNPIKLTHKINHQKL

SEQ ID NO: 924601 - protein, 149 aa, Homo sapiens
MWLKEAKMSRQTVAAGAELSWRASARAVQKENVGLKPSHRVPTGILPSGAVKRGPPSSSPQNCRSTKACTGHLEKPQKPSQPMKAPGMGAVPCKATGVELSKAVDHGKQRGQQLAQKLGNREVARSCEDLGYEECWISHQSEFKATEGF

SEQ ID NO: 924602 - protein, 137 aa, Homo sapiens
MSRERFSSPPPPPRSQGGPNSAAEVTSPHRFKTRENNAARSLPQRLQVPPLCHLSIFTPESLRRREKLINRTPRRESQIRFGPSQPVSGACSQPLWDREALERTTDSFEETEEKTPTRTQCLTRPGAARLNPTGTLV

SEQ ID NO: 924603 - protein, 139 aa, Homo sapiens [sequence omitted]

SEQ ID NO: 924604 - protein, 134 aa, Homo sapiens
MRISSASPFSAAAPGRTDCCSIDKTQSLSACTTRNCGAYSKCLCGKYAKPVGGIPQPLQESHPAPDVAELQHHEFRGGGLEPRHYVPKYPVLRAYQYGPELLTSYLSAYGEVPQLCVTPRWAVVLPCFSPFSMG

SEQ ID NO: 924605 - protein, 226 aa, Homo sapiens
MEGAFKPALREELPMSASVTLGEHFWTHLGPGVSRRPEGKVTSLAGIATCLLQSPRALGKHKQQPGNGGKNGFGGQAQGSHAVYSLGTWCSECQPLQPLLKGAKITAQPMVLEGASQKSRQLPCGVEPVGAQKSRIDIWEPSPGFQKMYGNSWMPRQKFAAGAGRTSPRVLWKENVGSEAPHRVPTGATPVGAVRRGPPFSRPQNGRSTNSLHHASGKATDINTSP

SEQ ID NO: 924606 - protein, 169 aa, Homo sapiens
MATGPNGSVGLDKIIIATQEQYQKGSQRLPQFVGGPLQTLLTWFLSHLEVSPVEAAEQQGWLPAPSSNVQTLQRQQAGKTKSAEPQRLWLPLPTGVLPRKIRVLSINLWLDTTRGKQPTGATVIVTTPSPGNSVILDSLQSAVTGHSLSGDDSLHNSVLGTQGPGGVGS

SEQ ID NO: 924607 - protein, 150 aa, Homo sapiens
MVIIWSWRHEEQQMEGRVTLKTDHDCKLSEAITKSRCLHHDSCTVCRTVRFQRMYGKAWMPRQKPATGLNPPQRNTTKALPRENVALEPPYKVSPDELSGESVEMGLLPLTVEDTVKGTVEPLTDCSFNIENLQTLNFNPQEQPQERHPV

SEQ ID NO: 924608 - protein, 165 aa, Homo sapiens
MKSQKFIDLIWLIPEKLLKDIKRYVDFSVTSGGCAGSWHHEQELDKMRKQSKEGMKRFIENESTLHIVGGGLSIGAQGPSYRILGSLNTLLGIPLVTCGMPYVNEEDEVKLQSHLLGVRLVERIFLDIAKLFMDLKFLASRPYFPAHSPLRDVIPINLYGRQRNR

SEQ ID NO: 924609 - protein, 330 aa, Homo sapiens
MFSTNYQSLGSIKPPSYGALPVSSMANIYAGAGGLGSQISMSHSTSFWGNLGSGGLAVGMARGLAGVEGIQNEKETMQGLNDSLAYCLDRVRSLETKKWKLESKMQEHLQKKGPQVRDWGHYFKNIKDLRAQIFANTVSHACISVESDIHGLHKITDDTNVTQLQLETEMEVLKEKLLFMKNHKEEVKGLQAQIASSGLTGEQFEKSTTVVTTQFAEIGAAENTLTELRHTVQSLEIDLDPMRNLKLSLQNSLREAQKYEALLNIKAKLEAEITTYHRLLEDREDFNLDDALDSSNSMQTIHKTTTCRIVDGKVVSETNDTEISSSIKFT

SEQ ID NO: 924610 - protein, 133 aa, Homo sapiens
MCSNFSIFKTVVFKSLSTTAPVHFPVFSFVCLVIFIENWTFDYYNVVTLKIIFSPSPGISMGGQESLELPTPPFLLTSLPLTFNSQELLGYKAPQISIVTQCFWSILRSTYLSNLVLLLMTDIVLNDDHNFRI

SEQ ID NO: 924611 - protein, 321 aa, Homo sapiens
MLADSVSVGSPLHQALPSLQHLLSAALTHGSCLEAGGHDPPGGGMKRRAVMGPPQVQAWKALDLWESSQVMEGKAVVPMGRNPMMRKATQGQLENSPALEKLLPPLQGNVGFAFTKEDLTEVRDLLLANKVPAATRAGAIGPCEVTVPAQNTGLGPEKISFFQALGITTKISRGTTEILSDVQLIKTGDRVGASEATLLNTPNISPFSFGLVIQQVFNNGSIYNPEVLDITEETLYSGFLEVPPSIISGYKGCLALSVETDYTFPPAEKIKTFLADPSAFVAAAPVATTATAAPAAAAAPTKFENEESEELDEDMGFGLFD

SEQ ID NO: 924612 - protein, 155 aa, Homo sapiens
MAADPRISLDLPCLSVHLGASTKGHERTEAEEDPESWLPKREKGPKEELRQVKDIALNKTPSPGSEADRAEAQGACPELQPGDGVEVPYLWGRPKALAEGLGTMRPVSGLAELHLRCSSQAGSQALSRLRRCLRALADLQETRPTQAYVSSRTMT

SEQ ID NO: 924613 - protein, 155 aa, Homo sapiens
MPTTSFADADSISNAQRGCASPPNADMDNEHFPLFSGSCSCKHWPYQCGILHPSRHSLFNTSVFENLWTFVTASRVAMTQPLISEAVHMESVNYPHKPAPSPGSGPAEGLAVPSSHYVSATAYSCPFCATRKIEQPQMLTHSNSTTSLPYAIYFI

SEQ ID NO: 924614 - protein, 156 aa, Homo sapiens
MALKAKKEALAPPKAEAKAKALKAKKAVMKDVHIHKKRRPARHPPSRGPGHCDSRPPKYPRKSAPRRNKLDRYAIIKFLWTTESAMKKIEDNTTYVFRVDVKANKQQIKQAVKKLPDNDAAKVNTLIRPDGEKKAYVQLAPDYDVLDASQRQLSWL

SEQ ID NO: 924615 - protein, 155 aa, Homo sapiens
MVLTVKPLCGGIKAFTASCSSRKSPKVLASRLSADIRVPRLPGHPRLLLGFSEVTTTRSALFLPWEPNVTPAFPSAGPGTLWLFISSFSFSFPHKQFPQCSWNSSAVSQQEGLRSRTQRLLWLSVGNTFSIEIFLDLKVRDDPRLINRDSQRQQE

SEQ ID NO: 924616 - protein, 141 aa, Homo sapiens
MSGELAVNGCRRRLRLGRNAGMKITEGLAYHGKGVWADREELPTEKTEKQQPEREKVNWEQGNVYISQDSLVANNRSQCKPTEGKKGESYTDTGVVRYADIGMNGSEMKFKDVKNKMSSLMTDVVGVHSSLGFLFQLNLQV

SEQ ID NO: 924617 - protein, 158 aa, Homo sapiens
MRNEKKCLQLLPHGKVPSIPPPFHPSSLSQGLIRLCLALSETPISCFSCSQSPGVKWRICFASQCAYKEANRNLALLGIGRYSPWDETGKSCRVRECASALVPQSEPQSPAPFLRVFCSHSPGSCGGSRAQDTDPQLRPPQADVTDLSSPKCLTLLEG

SEQ ID NO: 924618 - protein, 203 aa, Homo sapiens
MNAQEPLWGLVCTTKRTIQFVTQGIASFMYTMTLSFYLGLGVTSLYFDICQITSIDSLFPVIHSSMEYYNSCHKKPALTSSSVWLLKSSVIGRFCIAHWGKAFTNPVGELVCLGQQYYNETLGKTLWRGNNKQGKDTTRLPCHNPFSHFHSLNHSWYQLEAPNEHLASTFWPRLDLWAMSLLAITCQLDRGLCVGDNKTIFLP

SEQ ID NO: 924619 - protein, 198 aa, Homo sapiens
MACTRWTKLQGRDWSGSYINASGGGIYYSDSVKGRLTISRENTKNSLYLQINSFIADTMAVYYCKRHSEEKSVLSPDTNLSAETHEVNQLRGRSGPTDQIQPQRQMQIQAVVTFSFSFLLPEKERCGPCGLNSKAQALPLELRWGSGCGSCSRMGEADGAFFFPQCLGPSTVFHGDSCGNLSGPGELKGISLFGESET

SEQ ID NO: 924620 - protein, 182 aa, Homo sapiens
MDTLLGCELCMMAIVRSGWAQPEPMELAKRKDRTEFLGSPTAAVYHRVPLSSPLLGLNQTDQPIKCACIGRRRASTLLRENAWRVNEAGKLMAYDGSLSLSEGEREAGLGGTFLHFCAVQRNSRLSLSLLQVKVAPQETPITPSNDSAPDECKAHSIPEKGAQDMGFSMSHVMDVREQELGA

SEQ ID NO: 924621 - protein, 134 aa, Homo sapiens
MNNAIREHTNKADISLVSPGSLAVCNHPAKERDGPISMTDTIEVLPQAQMVCDGCHFTNLEFREYNALLPHASQMKKPPCDQLSLLLSEPISKCQQFRSGGIPHCGVFPYFRKNHSPDNATAWTSDFHFVRCTH

SEQ ID NO: 924622 - protein, 139 aa, Homo sapiens
MCKQQKQRHKGTQGAASVNGQSQAMVSAPERWTKLDTHEPPSLASKSASLDGNGELSGIYSVWFLLLLRALVWWLFQIPVVVVIYWVCEQARGLLRGWNHRSNEKLISFSTAVRAGYGGSRRVYALLVIKVGNLACSRS

SEQ ID NO: 924623 - protein, 128 aa, Homo sapiens
MVSQAGKAEYLCVSVLYSPVVVSGPAGQTPTAGAPCEDRCKGSVTDPMKTKVEEDCVVKSVKQDGFSPIIQRRTQKGEGGRNVTCLTTCSSQNNKEETEVLPEPPLSIDRKNRGNTLQLYVPVFDKQH

SEQ ID NO: 924624 - protein, 147 aa, Homo sapiens
MGGSGTTRPRGLEKESYSDHGEESDTVTPPGAFSTGLAPALIGDCIKYWPPHQYNTLEENIGKCKDNGRKKSRTVEQFEASDTNSLRTKVMTQLLVDTESLLLGKLQYSKVTICKHDECTLATSPIVYCFPYFCLKKGVVYSGLVSV

SEQ ID NO: 924625 - protein, 164 aa, Homo sapiens
MLRTPERTQLNQGALRTAECAQDTRGRSEPPAGAQNSRVCSGHQGALRTTSRSSEQQSVLRTPGGAQNHQRALRTAECAQDTRGRSEPPVGAQNSRVCSGHQGALRTTSGRSEQQSVLRTPGGAQNHQRALRTTRGRSGRQGSLRHHEQLIQKGRKAGIPLSLP

SEQ ID NO: 924626 - protein, 139 aa, Homo sapiens [sequence omitted]

SEQ ID NO: 924627 - protein, 140 aa, Homo sapiens
MLDTLNSMVKFSYETLSRARLTVFVCFHAADEDIPETRKLTTERVLLDLQFHVAGKASQSWWKVKGTSDMAADKRRELVLVSVDFPGTKCKLSVDLPFQGLEDSSPLLTAPLGSAPVGTLCGSSGPIFPFLTAVAEVPHE

SEQ ID NO: 924628 - protein, 221 aa, Homo sapiens
MGSALIWASLLITLNISVPCESGPAAAVPHGAVLPFPQCLQKSCVKFIDGVRGRKLETGGNCMVDAPHNHKGAVRTIRRSSGHLGVLRTMRGAQDIGGSQNHEGCSGHQGALRTTRGRSGHLGALRSIRGAQDIRVPSVPRGGAHDTRGTQNHQGGLKYARLPGDSLPSSPFSRVLHTSHSSHPLPSLSTTEWALQFLLPCVCSALGLTSALMMTFKSPCA

SEQ ID NO: 924629 - protein, 144 aa, Homo sapiens
MGSSGFTFSSSWMHWVCQAPEKGLEWVADIKCDGSEKYYVDSVKGRLTISRDNAKNSLYLQVNSLRAEDMTVYYCVRGTVRGGQCEPRHKPPAGASGATRGRSGYTEDRGSPRAGAGGGQGLLSFRVCGFLSSNSSAGSLLYLQ

SEQ ID NO: 924630 - protein, 156 aa, Homo sapiens
MTLIENTRAVGGSTWGKQEDSTPGKGARTPRPASHMEEGQEHSQGHAQTLGHNAFLGIWKKEYGPRNMESLAPFPGELRDPAPAGSTGCDGEAETAQMRERVCEGFARPRTHEKYRCRHAQVLNNTPEQQSWAVEVASHVERSDSAKLYMGVSAGP

SEQ ID NO: 924631 - protein, 139 aa, Homo sapiens
MNSLKTEDTAVYYCTRDTVRGGQYLTGSSRGPILTPVSRRLLERLQDGQKEEPRVSPHDLEPPSPWIRPSPRDHRALHYPYPAVVPNKQHHTSIHQGKECLLPATVFWRPSQPCGTVIPIKPLFVPSFGCVFVSSLKMD

SEQ ID NO: 924632 - protein, 154 aa, Homo sapiens
MDWTWRVFCLLAVAPGAHSQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDTVITVKLHRRCENSHESLPRTDTASSTTAILPHSHK

SEQ ID NO: 924633 - protein, 163 aa, Homo sapiens
MWRHSGLEGASQEEAAPRTNPASTWTLDIQTSEWEKQGPYPIEKEEKKQMGTPGESSLDLDTGFSGFPLETVEVNPGVPQSLPFFSSCQHRRTADKGADCGFFRSPGKSLQGLIVSHLTPLAHASKIKKKILTKYFQVSLFLSQYHTVAPALGSVTCGPQSSL

SEQ ID NO: 924634 - protein, 138 aa, Homo sapiens
MVHPSDIFRCFFLTGDTSQNAPASTPWDGAVWESKTATTAEMHPDTPPHHHYIAREIICRGAPSFDANLALKPHKTLPASRMLCPAPHQTMITTLSQSPSLPYQATLDLNERPALLSADTLRMQALSGTGTAPPSDSV

SEQ ID NO: 924635 - protein, 145 aa, Homo sapiens
MSPRGTQNHQGALRTTRGRSEPPGGAQHHQGALRTPGGAQKHSGTLRTRGGTQNQQGALRTTNGCSEPQGGAQDIGGAKDNNSGLRSPGGAQNHQGTLRTCRVPTMTLPSRAMEGGYQPPDPRMVDPQAACSSSLEKPQAPSSNP

SEQ ID NO: 924636 - protein, 144 aa, Homo sapiens
MKCVLGVISGGIESVLTGVYEVCATPIRINLSNQLQPIPWSLADTVHVVATEGELRGCTGESRGPRRLCQASPRLHQLHLTLDTCKHRDTPVRNCHTYPLFLTHIHSYSISLVLYRSRFKIATRKTQLSTNSMVSPLCSVLITR

SEQ ID NO: 924637 - protein, 227 aa, Homo sapiens
MNLIQLNGTMVYEYSGSEGQLLIAPPELHPRLRRAAPLLVSLLAGLSIAGSAAISTAALVRGETGLMSLSQQVDADLNNLQSAIDILHSQVESLAEVVLQNCRGLDLLFLSQGGLCAALGESCCFYANQSGVIKDTLQKVQKNLDRSQQERENNTAWYQSMFNWNPWLTTLITGLAGPIIIILLSLIFGPCILNWFLDFVKQRIASVKLMYLRTQYNPLVVTEESTT

SEQ ID NO: 924638 - protein, 152 aa, Homo sapiens
MELRSLRSDDTAVYYCARDTDQGHGPSVNGLRFTSHGASTGFPGENRQKQGEDTFQISSSTELALALFEETKQQQQTTTTANITRIKSVGLEEGDSAMGKNLTLSHPLCLRYWTAPALTMVIASDIASPPDNTLTWLLVPGFNQESCRLDSS

SEQ ID NO: 924639 - protein, 202 aa, Homo sapiens
MCEVNRDLCEVATGMCEVTWGMCKVTLGMCEVTQGTCEVTWGMCKVTLGECEVTLGMCKVTLCECVQCEVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRNPDTPLCFLETRLRTRVAISNEGTSFFGQNGVRMWN

SEQ ID NO: 924640 - protein, 136 aa, Homo sapiens
MESRCLLNVRDSDGLRNNPGAHSQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGTELHQELTEDKGEF

SEQ ID NO: 924641 - protein, 130 aa, Homo sapiens
MELGLSWIFLLAILKGDSWRNREIECVQCEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDTQ

SEQ ID NO: 924642 - protein, 186 aa, Homo sapiens
MELGLSWVFLVAILEGVQCEVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDTVRGSQCEPRHKPPCRGPLGPPGGDRALSTGLSPGQVQVLLRAGFLSRSGAASSSNFPRNFSRFTILY

SEQ ID NO: 924643 - protein, 151 aa, Homo sapiens
MDTLCSTLLLLTIPSWVLSQITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRPQRHSPGHLLYKNPGCFSLVLPPHLCRTGKCS

SEQ ID NO: 924644 - protein, 168 aa, Homo sapiens
MTHPTSDNSTVTHIHGGSSSHGKYFLRLMDLLHKNMKHLWFFLLLVAAPRWVLSQVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARDTVRGGKKEGRNFSVYH

SEQ ID NO: 924645 - protein, 139 aa, Homo sapiens
MDWTWRILFLVAAATGVHSQVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCARDTVLQSTHECLSFTYLIRGLST

SEQ ID NO: 924646 - protein, 177 aa, Homo sapiens
MLRNHQGAPTTPEGSQNHRGMLRTTRGRSGHQGMLRTLGALRNHQGTLRTLVGSQNHQGMLRTLGGAQEPPGVTQDTRGRSGNQRVPRKPGEVQEPPGGTEDTKGCSEPPGGAQEPPGGAQDTKVAQKTRGCSEPPGGTQEPPVGVQDSKNGSGHQGALRTSKGLFGGSSISGTWGG

SEQ ID NO: 924647 - protein, 362 aa, Homo sapiens
MDWTWRILFLVAAATGAHSQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYWWPDNECALTGNTYQFSGPIAAIGGYGRATEVRPVELRRAMGTSRDNWHKGRKAGGKRRPCHKKRKYELGRPAANSKTDPCRIHTVRVRGGNKKYCAPRLDVGNFSWGSECCAGETRVIDVVYNASNNELVRTKTVVKNCIVPIDSTPYRQWYESHCALPLGRKKGAKLTPEEEEILNKKRSKKIQKKYDERKKNAKMSSLLGEQFQQGKLLACMASRPGQCGRADGYVLEGKELEFYLRKIKAQKGK

SEQ ID NO: 924648 - protein, 115 aa, Homo sapiens
MAILAGNYVVMDGFFYTEFISYHMVTFYSTAYGTFSKTDRMIGHKASLNKFKKIEIISSTLSDHSGIKLEINSKRNLQNHANTWKLNKLLLNDYWVKNEIKMEIKKIFEPKAPVT

SEQ ID NO: 924649 - protein, 147 aa, Homo sapiens
MTQPYFILLLKLFWLWPLGALPVGSCVPLRIGDCSPKHGDLGPLGRDGRACLCPHTAVGLRGDSCTSLGSLAHTAQCGHKSPGYKAGTPDGEQLEHGGKEAKVFIHQVTMLPSPATWNTDNSSQEKLAEPCADHSSPMRSSSYVLTS

SEQ ID NO: 924650 - protein, 139 aa, Homo sapiens
MWNSAESVRIPFPPVKGTMCAAVLWLPKQILQIGIWRWEPTATEETQLQLEVPLEQREGEKGLTCPFIPPFNLGSAPPIGQIYWKTEGKGAWMLGHSAIEESSLNYGQAFVQTTQKPAAPHDRGVVRKSFVLNGNRGDG

SEQ ID NO: 924651 - protein, 170 aa, Homo sapiens
MEITFSSSGESSRSTPWLERTGASSQPPAKWAPFSFQTCQAPRSQCCIGHSHCQQQAGQALSTAPAAPGPGSTPTEQAHPSSPHRTTRDSPPQPSAAQSEASGFALPGCLPLSPWGGYQGNPPPIFQRRFFLFSLRFGWLRNKKKEYKERNFTAGPLGVTSHIGRTMMSS

SEQ ID NO: 924652 - protein, 144 aa, Homo sapiens
MVGAASGCCFSAGASFFQGSVKGDFPSAAGGTLASVVAWVTLVSGLGLLADFPLDSVVGRVYGTGRWLQQRGSGQLVTPGHSMDTSSGLAWVACSSAGRRRLQTQSRARKGVFHRDCKFPEASPTVQNCESIKPLLFINYPVTG

SEQ ID NO: 924653 - protein, 248 aa, Homo sapiens
MTTIHTPSPVRILPEEPLPGPYSWVFPNPPSTASSILSWEESVSHQNCWLKGAGMKRFTLRTFLFVRSRKDSICQPGEDSGFIDSSVLSFTGKGFSKCQSLTPSEALILSSVKADRDEEAAEEKLEAGRGRFVRLNVCPQNMKVQGEAASADGEAAASYPEDPAWIIDEGGYTKQQIFNVEDTAFHWKKMPSRTFIAREEKEAGTAHVVEIARELELEVEPEDVTELLQSHEETRMDEELLFTDEKRK

SEQ ID NO: 924654 - protein, 140 aa, Homo sapiens
MEPQWPPPSPHSACADATLLDTCGPDGQTLCNVIPKALARAHSRVWTRTLFVDCGALSKTEGSVEWERHFDWEDEDALQVDGGDGCTNATVLNAADYAREWKIKNKGTTVGVNIRKSDVPSTCDVDVDAGKQEDACLHSL

SEQ ID NO: 924655 - protein, 281 aa, Homo sapiens
MRELLICREEIAGPPPWSAGSKQEARRGSANSAPVNERAALYGPSKAVQDALVYSQGKFQVSPVHAPPSILARSPASAAAPGAAWRAPSITSCPGGEQMELGRDCCARHTPPQTLGHCPSMQPPTAIARGPNWEALWGSLLWLTVTHSGTTGAPTPAAGRLNLEPHSPPLPLHMQDPLVTCQHVLEKLPLVVVWRQSQLICWQAGRRRMGLESPGDPGTTSQDKSMGGAPQHHHLSPGVDKHAAAFVPGFRGDICHGDLSSLRPELVCLGSVFISEGAHSP

SEQ ID NO: 924656 - protein, 157 aa, Homo sapiens
MGCGCPSCSCLQGPGEGHADKGSCEQPRSRRTFHTYFWSMCSVPDATTGAGDTWGAPGSHPWGGRRQPHSPLSNCPAGWCSAVPAHTSIDSRWHIRAGSPSPSSSQRPPLSGCTLYVPCAQSPDSGCRGSWHQMCRHKVPGQVPRQKPQSGAMSCNM

SEQ ID NO: 924657 - protein, 136 aa, Homo sapiens
MKPCSQRTSPEQACRCHFQNALLLLVQGVAATPPFPWNRPPGHVDKEELARLGEHGAEPGADPTVLPLPAWLWGSWPWTGLLLQGRCFHPRRGERLSVPPLQEERHCSPSQGQSDVSGRVCVCAQHDASVCSGDEC

SEQ ID NO: 924658 - protein, 144 aa, Homo sapiens
MGRWGLLLLFGSMAFDRTRRVVGFGAEDAQEGREGKAHELDLYLFLEASYVRDWLEDLSWNISSTQVSSLLVSGLICHHQLSQGSSLLTRCSPGTFQKRACLQFLLCAYGQKMPISQAQDKSSRTGCFEAVATGEEDPSAGWAS

SEQ ID NO: 924659 - protein, 343 aa, Homo sapiens
MAIVRRQGLQPPALLWACLAALSWGDPAVVGECGWAEQEVEPESPAGMCGVSVQTEGPAGVCGVSVETEGPAGVCGVSVETEGPAGVCGVSVEPEGPAGVCGVSVETEGPAGVCGVSVQTEGPAGVCGVSVEPESPAGMCGVSVETEGPAGVCGVSVETEGPAGVCGVSVETEGPAGVCGVSVEPESPAGMCGVSVETEGPVGVCGVSVETEGPAGVCGVSVETEGPAGVCGVSVETEGPAGVCGVSVGSEGPAGGVWGQSLVIYELWPPSLWLHLKPMVDTSCCCWARPCTLRKALPSLEHAAGKEDLGPAPQALSALRVSEGLCAVGGGRLTRSSFRVHSQ

SEQ ID NO: 924660 - protein, 158 aa, Homo sapiens
MRGCAAAALLGLGPSRLALQGLSLATEPLRAVVASGAPGLHDECVLASCRGQAPLGHPKPVMDKEATWPFHQSKDAGCCSPRGLSTAFSSPSKAFKQTLPGPQIDSRITILLQNRNLGKNSSTLGCLCTHFSWLSIMVPGSRVLGLIVVYSLTWKTHS

SEQ ID NO: 924661 - protein, 146 aa, Homo sapiens
MHEFARDAESAVKKAHRASHRRTSQYGLLTLLILPQNHLRGCWIRSPPGQCPVNRSALTNKYRSVLTKELLELTKIYPGLLLDVATWVPEMKGCGSITAMQRWTESSHFPLAEIANKIWSGLCANKRDKDCRWLWDRFPGRGSSHS

SEQ ID NO: 924662 - protein, 279 aa, Homo sapiens
MGLKLLRINVDAAGGHYPKGINAETENQVLRVLTYKWKLNIGGLDRRSNQPQYSLKPKPNPEKGPLFNSVKADSGEEAPEEKFEASRGANAAGDFKLKPVLTDHSQNPRTLKNYPKSTLPVLYKWNNKAWFTAHLFTAWPTEYFKPNVEIYCLVKKVLFKILLLIDNVPGHPRALMEMYKEVNVVFMLASTISILQHMDQQVKCYQTALHATEKYLVKGRVTDAANFTVDLFEEIATGTPTFSNHHPDQSAAINIKGRPSLHQQKEYDLWKAEMFVNIF

SEQ ID NO: 924663 - protein, 167 aa, Homo sapiens
MTVDFSSETVEPQGSDTAFFKILKEKTCQPRILYSVKVSFRIEEEKFEASRSWSMRFKERSHLQNTKVQGKAASADVEAAASYPEDPAKIINEGGYTKHQIFNVDKTAFYWKKMSSRTFIARQKKEHHKPWPVMKWGTGRGITLGEIPNVNDGLMGAVGQHGTCIPM

SEQ ID NO: 924664 - protein, 171 aa, Homo sapiens
MAPCCYNLPRCQLIFIKISPSLFFKKPKRLETWVTWFPPALRTSFKGFSTYSSYRCLSDLDFLPCSTRSQCPTPSPGPGPATLLSGPEKKAAYWKPFYHIDIRNMGLLHSVQRTQTPLSVTSVDLSELLWNQESSGWFHFKNKTKSKTLSLSGVSLASVGALAYHPSGTLR

SEQ ID NO: 924665 - protein, 143 aa, Homo sapiens
MYSARSGKTSLTHSRNPTSSSRNKSCLPKSRWSKKNRAGEDCLASVRHHHLEIPTGGEWGHVFAGLELQHGPQGPPMSSRKRPAQFCYELSRGLHTVNSLGKGQECVLEVRLKINDFHLWPGTCFQNWEENLWQIAAPLSPET

SEQ ID NO: 924666 - protein, 173 aa, Homo sapiens
MLRFKDGNGAAADADEIDCPSAVLIKCIRKLLIRNGVTLKDKPSPKVMEEQTVSKGKNSYGALSWMAADTGRILPLSSGPCVWTHATPQYRKPPSGVSGEASQEGPVPRNSLQSHQGNTGGSHAHRGATPLELTGKLLLEPQEELCMACCAARRQCFSSTSRGTKGVFAAERQ

SEQ ID NO: 924667 - protein, 168 aa, Homo sapiens
MQDACSSFAFHHESKLPEAFLEADAAMLPVQLVELFHKDRQQQQQQQNVELGVAGTMKTGKQMSLLEVEDKLELSLSPSLKTPERKETEEDPHQDPNWMAPLTWTSSPPEVEEISVCCYTQSTVFCYSSLNRLRPSTFLFSDAKSYFRPIFYLLSLPTLRSAISLRNS

SEQ ID NO: 924668 - protein, 166 aa, Homo sapiens
MTQEVGSQGPGQLSLFGFAGCSPCRCFHRLALVPVAFPGAQCKLWVDLLFWGLEDREELTGSLGSAPVGTLCGGSNPTFPLCMALVKVLHEGSTPATDLGNLQLCDLSDRESKIAVLRKRKEIQGNTEKEFRILSDKFNKEIEIVKKNQTEILELKNVGEGSKMAK

SEQ ID NO: 924669 - protein, 145 aa, Homo sapiens
MVESYGEKMPMTCALKCQGEKRLDSRDVCVCTSEVTVVTYSDGQRERCLTHHQLLGCGPTEVVATDRKLIASSFHNTPHGSSTLVDQEIATTLDTLKQLLALCWILVFDHGPLSIMVISEILVHPFSPESPESIISFLCLCILIA

SEQ ID NO: 924670 - protein, 298 aa, Homo sapiens
MCLLSLDCRPQDISQGVPVLGALSHTLCVSSLMESEGLGKGHITLLYTGFPSKGTRNHYKHEVILIGMSQVYCSEKVNQCCQQQNMQPNGPKQEVTAPGPIKKMLLLPNPDHMASTAPKPRKGMPLPNLFYEVVFCTGKWTLGAAFATSRIQGSKSSGGPVYLSLGNEDMRSKMQECQLGRNFPCRKKCTDSERSLTVIVPAGGVGPPAAGAGCMSLGEVLLKSWEDGAGEKSRLGYMSQRLLSRIPMVCLQVQGIQKSPGVQEVTLNCLTLSPKFHHGKKRDTSLRLLAAIFAIMWA

SEQ ID NO: 924671 - protein, 182 aa, Homo sapiens
MAQDSIPWNPLICHRDWERSTGPKLKKCEPVDSIHEVWTGNRRLWIDPCVNWRRRRRLSLRTITTPGNHADEGPCSPLKKTLAHRFSFPNHSKHSLCPSLFGHFDQNFLLYIIRRKCTVCSGTLSSPASHVFSRSPLVSGLSVADHHSIKEPVRPLDAVWGSVTSEEIPSVSHGLCRSVHSE

SEQ ID NO: 924672 - protein, 308 aa, Homo sapiens
MGALLDQEHSRHPARSGGMEVSSRSQNSTSTGSLHPVSGKARHSTTYERSCGGGTLQSHRGGVAQRLGSPPLEPVCPGLTGAVTQQPVWCRLHCELLDLEVSGLQANIPTLCRECILMPGSDTVKTSRDQDSSPMMYHSYKDFEGYVICTCGTHGNIVLGLQGTASQGDGSEFRAPCQKSICGPAAGLETADRGLKIAVCLLHRDAFPFITREILHSCSPICPTVVSQDAVVHSSISQGSTVQDQGTGLSVFSDCQRGHSVVHIACKTMNHVLWTLGGKLSIPMYVISSTDCGVVTRQVNRLFFVTLH

SEQ ID NO: 924673 - protein, 186 aa, Homo sapiens
MVSFSLFQLQLYSPSPDEADDSSSVSHVHWSNYGEKVILYPLQQWGALVHISVFLAHSQEIRLKTGTIIDAKTTQPPSMDCAEGRAANLPCNHSTISGNEYVYWYRQIHSQGPQYIIHGLKNNETNEMASLIITEDRKSSTLILPHATLRDTAVYYCIVRVAHWDRWGCTCAISPWWQVRRRVAFT

SEQ ID NO: 924674 - protein, 136 aa, Homo sapiens
MRFCGGIAFQAEWAKALIWKPAWSRQKLAVRWSHFMGSPSSHNGNIRIWKKMIPIQMYDFKKFKTLVEKVTADVLKIVGELELEVEPEDVTELLQSHDKTLTNDKLLFMDKHRNCFLKMESTSGEDAYHNIYAVFR

SEQ ID NO: 924675 - protein, 136 aa, Homo sapiens
MLLLLVPAFQVIFTLGDIDVAGGTRAQSVTQLDSQVPVFEEAPVELRCNYSSSVSVYLFWYVQYPNQGLQLLLKYLSGSTLVKGINGFEAEFNKSQTSFHLRKPSVHISDTAEYFCAVSDTVPETAGELNTNLLRC

SEQ ID NO: 924676 - protein, 410 aa, Homo sapiens
MKNLCWEAAIDGPAALPLLSHAPAARPSARGDFYSGIGVAGGTRAQSVTQLDSHVSVSEGTPVLLRCNYSSSYSPSLFCETSSHLLVLVSSDTFLPVLWRSCRKEPAVFPLFSHAPGAYPTAGDTFCPEMERTVEEAFILLVCLKPWRVASSLEKKEKEDESFQLLLGSRYNVLEGRKLEFIGLRIHCEDDSISREAKPKFKPKCGSVTTHVEFQPYKVCYMNVREWTRKDWGPENQDEDKLADHIAEQRETEENPATLTSAVWVWERLGPISLTMRMESSNLLVNGENVEQHPSTLSVQEGDSAVIKCTYSDSASNYFPWYKQELGKGPQLIIDIRSNVGEKKDQRIAVTLNKTAKHFSLHITETQPEDSAVYFCAASTHCFPGTCYPYTNLRLELKLHPLSFVIDRQL

SEQ ID NO: 924677 - protein, 184 aa, Homo sapiens
MCYQKGVPIQTPKRGFLDLAQERIQEGSSGLPIQPINGKPVQPLTHTGLIQLCSELRFTSETGSEGVGNTALLCSESCYNNGTCSQLQVFWSLLEVHSRSCFPGYYQQRLQNNKYCCLILPLEASSQRGISLFEDSLSPYSEGFPSQATRRSGACLKRPSVHSWSTNAMLREPLLSSELSDRDV

SEQ ID NO: 924678 - protein, 176 aa, Homo sapiens
MLLSNDQNLRGNIIFNNDGASGGAALVTIMYLVIGTAGQSLEQPSEVTAVEGAIVQINCTYQTSGFYGLSWYQQHDGGAPTFLSYNALDGLEETGRFSSFLSRSDSYGYLLLQELQMKDSASYFCAYPVVPRMEDGIYFWRKLFIQGKDPLVSALVYAVKDTERLNGESNTEANDL

SEQ ID NO: 924679 - protein, 313 aa, Homo sapiens
MERINSTLLTAFILTGIPYPLRLRTLFFVFFFLIYILTQLGNLLILITVWADPRLHARPMYIFLGVLSVIDMSISSIIVPRLMMNFTLGVKPIPFGGCVAQLYFYHFLGSTQCFLYTLMAYDRYLAICQPLRYPVLMTAKLSALLVAGAWMAGSIHGALQAILTFRLPYCGPNQVDYFFCDIPAVLRLACADTTVNELVTFVDIGVVVASCFSLILLSYIQIIQAILRIHTADGRRRAFSTCGAHVTVVTVYYVPCAFIYLRPETNSPLDGAAALVPTAITPFLNPLIYTLRNQEVKLALKRMLRSPRTPSEV

SEQ ID NO: 924680 - protein, 345 aa, Homo sapiens
MAVKEAAFDDGVEDDEKGEFGGFGSVSGNIEIEIKINHEGEVNRARYMPQNSCIIKTKTPSSDVLVFDYTKYPSKPDPSGECNPDLRLCGHQKEGYGLSWNPNLSGHLLSASDDHTVCLWDISAIPKEGKVDARTIFTGHTAVVEDVFWNLLHESLFRLVADDQKLMIWDTRSKNTSKPSHSVDAYTAEVNCLSFNPYGEFILATGSADKTVALWDLRNLKLKVHSFESHKDEIFQVQWSPHNETILASSGTDHGLNVWDLSKITEEQSPEDAEDRPPELFIHGGHTAKIPDFSLNPSEPWMICSVSENNIMEVWQMAENISNGEDPEGSVDPEGQESQTYLYFL

SEQ ID NO: 924681 - protein, 115 aa, Homo sapiens
MKRVKLCNVFEKVCSEPNGSDQWPMTQPSRDPENMCPRWSGYNMVLYILGKHKPSVSTCKMYTGSVQKGRKTGSGQLPGNIPGKCIKNNDLLLGFVVNMIINNSTDSHGNHVRLI

SEQ ID NO: 924682 - protein, 445 aa, Homo sapiens
MVRGFLKQLLARWLAATCFIVLFGSDQVSAGEHPCFYHLRQRYVQCPFNLLVIGEQMIDVLGPEKRRRRTTQEKIAIVQQSFEPGMTVSLVARQHGVAASQLFLWRKQYQEGSLTAVAAGEQVVPASELAAAMKQIKELQRLLGKKTMENELLKEAVEYGRAKKWIAHAPLLPGDGERTDDWMDGRRSRHTDDTDVLLRIHHVIGELPTYGYRRVWALLRRQAELDGMPAINAKRVYRIMRQNALLLERKPAVPPSKRAHTGRVAVKESNQRWCSDGFEFCCDNGERLRVTFALDCCDREALHWAVTTGGFNSETVQDVMLGAVERRFGNDLPSSPVEWLTDNGSCYRANETRQFARMLGLEPKNTAVRSPESNGIAESFVKTIKRDYISIMPKPDGLTAAKNLAEAFEHYNEWHPHSALGYRSPREYLRQRACNGLSDNRCLEI

SEQ ID NO: 924683 - protein, 269 aa, Homo sapiens
MASVNGSSQNCVSVQERSRPGVLAMPCISELISKSCVPMEFEEYLLLMFQQTFYLLQKITKDNNAHTVKSRLEELDESFIEKFTDFLWLFVRRCPGAPPHRGVESNPVQIQPGQLEELDDETLDDDQQMELNIMAENDCWWLHCSLRDLSSLLQAMGHLAGYFIGDVFAAWFNDALTVVESLVKVTLYGSQIKLYNIEPVLKPDLIDVRAQSLAVLQAYTHWLVQYCSEAHQQNTQQFVTLIPITMNAITPLISTKFSKQQSLPSTPFI

SEQ ID NO: 924684 - protein, 217 aa, Homo sapiens
MLGPLGWLAVPPLGVQQGEEDTEMWESLELLRDLLNDFTQNADSDMDNKMQAEVVSDGDKELVGNWSKDYSCYVLAKKLTAFCLCPKDLWNFELEPQNGRSTDSLHRAPGKAADPQGQPRKAAWREAVSFKDTGVELPKTMGIHLLHQCDLDVRPEVKGDHFEALKFDSPAGFRTCMGSVTPSFWQISPIWNGCIYPIPVPPLCLGSNELAFDFTGS

SEQ ID NO: 924685 - protein, 310 aa, Homo sapiens
MSPDGNHSSDPTEFVLAGLPNLNSARVELFSVFLLVYLLNLTGNVLIVGVVRADTRLQTPMYFFLGNLSCLEILLTSVIIPKMLSNFLSRQHTISFAACITQFYFYFFLGASEFLLLAVMSADRYLAICHPLRYPLLMSGAVCFRVALACWVGGLVPVLGPTVAVALLPFCKQGAVVQHFFCDSGPLLRLACTNTKKLEETDFVLASLVIVSSLLITAVSYGLIVLAVLSIPSASGRQKAFSTCTSHLIVVTLFYGSAIFLYVRPSQSGSVDTNWAVTVITTFVTPLLNPFIYALRNEQVKEALKDMFRK

SEQ ID NO: 924686 - protein, 248 aa, Homo sapiens
MTLSASDLNRTCNWINWGYESHIMMKQHTISFAACITQFYFYFFLGASEFLLLAVMSADRYLAICHPLRYPLLMSGAVCFRVALACWVGGLVPVLGPTVAVALLPFCKQGAVVQHFFCDSGPLLRLACTNTKKLEETDFVLASLVIVSSLLITAVSYGLIVLAVLSIPSASGRQKAFSTCTSHLIVVTLFYGSAIFLYVRPSQSGSVDTNWAVTLGRCCCIAVLLTVYVVLYPETFLNSIDDIQELFG

SEQ ID NO: 924687 - protein, 218 aa, Homo sapiens
MFSPDQDVAEAPRSLSAGKMMRTLITTHPLPLLLLPQQLLQLVQFQEVDTDFDFPEEDKKEEFEECLEKFFSTGPARPPTKEKVKRRVLIEPGMPLNHIEYCNHEIMGKNVYYKHRWVAEHYFLLMQYDELQKICYNRFVPCKNGIRKCNRSKGLVEGVYCNLTEAFEIPACKYESLYRKGYVLITCSWQNEMQKRIPHTINDLVEPPEHRSFLKLSS

SEQ ID NO: 924688 - protein, 161 aa, Homo sapiens
MDAELQVTLTVEDTSAPSLVTDHAPLTISLKPNHPYPIQCQYPIPQHALKGLKPVITCLLWHGLLKPINSPYNSPILPVLKPDKPHELVQDLCLINQIVLAIHPMVPNPYTLLSSTPPSTIHYSVLDLKHAFLTISLYPASQPVFAFTWTDPDTHQAQPIT

SEQ ID NO: 924689 - protein, 124 aa, Homo sapiens
MLLFWPEISVASGAFAQVLVRHPGRMRYADKWRAGHPIERTALSREETLELRCVMFPSLCPCVLIVQLPLMSENMRRLVFCSCVSLLRMVTIIFSCQVDFIATLDKYGPEEKANSNQLTALEEC

SEQ ID NO: 924690 - protein, 143 aa, Homo sapiens
MVILARVSWHSIFWGTIEAITKVMSISPSPSLHSVTENRPSQSSVHSKYLLILANGRHLWKKKASDHVLSVFIQCDILGYSEDFLVESIPRSPLHAISNIMLGFLHLAGSDLISRSLMAEEYTIVLASFISCISSSMDGQVVC

SEQ ID NO: 924691 - protein, 244 aa, Homo sapiens [sequence omitted]

SEQ ID NO: 924692 - protein, 234 aa, Homo sapiens
MIADFVSEKKTISYWGCITQMFTFHFFGCAEIFVLTVMAFDRYAAICQPLRYTVIMSANACTVLASLSWLGALGHSFVQTLLTFQLPFCNAQVIDHYFCDVHPVLKLACADTTLINMLVVANSGLISLGCFLILLASYKVILLSLQKQSAESRRKALSTCGSHLTVVTFFFVPCIFIYLRPSTTFPLDKAVSVFYTTITPMLNPLIYTLRNEDVKNAMRQLWSSKISLKEKQRG

SEQ ID NO: 924693 - protein, 233 aa, Homo sapiens
MLIDFFVERKIISFGGCIAQLFFLHFVGASEMFLLTVMAYDRYAAICRPLHYATIMNRRLCCILVALSWMGGFIHSIIQVALIVRLPFCGPNELDSYFCDITQVVRIACANTFPEELVMICSSGLISVVCFIALLMSYAFLLALLKKHSGSGENTNRAMSTCYSHITIVVLMFGPSIYIYARPFDSFSLDKVVSVFHTVIFPLLNPIIYTLRNKEVKAAMRKVVTKYILCEEK

SEQ ID NO: 924694 - protein, 301 aa, Homo sapiens
MESENRTVIREFILLGLTQSQDIQLLVFVLVLIFYFIILPGNFLIIFTIKSDPGLTAPLYFFLGNLAFLDASYSFIVAPRMLVDFLSAKKIISYRGCITQLFFLHFLGGGEGLLLVVMAFDRYIAICRPLHYPTVMNPRTCYAMMLALWLGGFVHSIIQVVLILRLPFCGPNQLDNFFCDVPQVIKLACTDTFVVELLMVFNSGLMTLLCFLGLLASYAVILCRIRGSSSEAKNKAMSTCITHIIVIFFMFGPGIFIYTRPFRAFPADKVVSLFHTVIFPLLNPVIYTLRNQEVKASMKKV

SEQ ID NO: 924695 - protein, 187 aa, Homo sapiens
MKTHSRKWEMETNQRTPNWENKEEVKDLDNFFKVHLAFTVDLPFCGPNEVDSFFCDLPLVIELACMDTYEMEIMTLTNSGLISLSCFLALIISYTIILIGVRCRSSSGSSKALSTLTAHITVVILFFGPCIYFYIWPFSRLPVDKFLSVFYTVCTPLLNPIIYSLRNEDVKAAMWKLRNRHVNSWKN

SEQ ID NO: 924696 - protein, 140 aa, Homo sapiens
MGFYTETFHCPGTGRRQMPSSCLNCKEVFLPLMLILLSTDPSWVSGWGMDLLLVKGWQACTNGSDDSGAALWLPQRKAEAKAPAESTVGQRQANPPWWSRVYVCGRVFPGCSREKAMVVVLRSNYCVILTIQVRNGESLT

SEQ ID NO: 924697 - protein, 308 aa, Homo sapiens
METQNLTVVTEFILLGLTQSQDAQLLVFVLVLIFYLIILPGNFLIIFTIKSDPGLTAPLYFFLGNLALLDASYSFIVVPRMLVDFLSEKKVISYRSCITQLFFLHFLGAGEMFLLVVMAFDRYIAICRPLHYSTIMNPRACYALSLVLWLGGFIHSIVQVALILHLPFCGPNQLDNFFCDVPQVIKLACTNTFVVELLMVSNSGLLSLLCFLGLLASYAVILCRIREHSSEGKSKAISTCTTHIIIIFLMFGPAIFIYTCPFQAFPADKVVSLFHTVIFPLMNPVIYTLRNQEVKASMRKLLSQHMFC

SEQ ID NO: 924698 - protein, 152 aa, Homo sapiens
MLARLILNSWPRVICLPRPPKVLGLQANTNRACAFSLIHLFALCGLKTWSLTQRILGYIKVTVETPFSPFLKCSKGTLTGLHKGPQSPPGTQTFQLSHPAEKGQQEVVNNPRSTEGHLGDVDDRNQEPDETKYPAIDHKIGTETSGHNGWIA

SEQ ID NO: 924699 - protein, 195 aa, Homo sapiens [sequence omitted]

SEQ ID NO: 924700 - protein, 315 aa, Homo sapiens
MVSNGIYSNRMESNGMPSYGIESKGKESNGMDRKETDWNRMDSNALDCNLCDLNGMETNGKNAMEWNGKERNGLVWNRIIWNGIEWNGMEWNGVNQNVMDSNGMDSTTMDKKGMVSNGIYSNRMDVNGMQLYGMESNEMDWNGMDRNGMDSNVMNGMECNGMLSNGMQWNDMDLKGMDWNGMDSTGMDWSGMDSNGMLSNGVQSIAMESNGMELNRIERKRMEWSVMENYRMEWNGMDSTGMDWSGMDSNAMEVNGMDWNGMDSNGMDWNKNGIKRIGIEWNGMEWNAMKWNGKEWTRMEWSRMEWRRKEWNQKE

SEQ ID NO: 924701 - protein, 180 aa, Homo sapiens
MNKEETFLLLLCLEESSLSSKAWKRHHRLLTLLCAPPPLCVLWTWISARGEVLLEESRTLEGLSFFFETWCSIPISKASSQMPVVGEDVDAEAVSGLLYSTSPTTFGEDAGLSGVAVTRSHTWSDFEMDPWFYSSRDVKWVNDGATLMWLFNGTVKKASKMEPDRPGFNASNDLTCDLRQ

SEQ ID NO: 924702 - protein, 136 aa, Homo sapiens
MKLTNLGQVGEAAQGPGAATFEHSAALPKPIPRSGGGSLPPELCGAHRPRLATVRRSRSFGPGHSPALQTPAVARLGPRTLNLAPGSLGPDRGVPGTFLPGLFATFWKLYSSASFMHSLHQQGASLYLATQSSLLH

SEQ ID NO: 924703 - protein, 188 aa, Homo sapiens
MASQRHFEYELKANRPRASDEYLVRYYFESLHTACTNKHKPLSAQRVSHLTIKETRPDKGISVDTDIGLEVIGTCEKDGASQWEYTGSYGRKPSPKADASAASLSHCPASWKAQGTAASWPSLSLALRAGRLCTGSEASITWRRHRRPAAVGLDLSPGRWRGELHIRKPCELRQEHTKSLPGQGGALL

SEQ ID NO: 924704 - protein, 290 aa, Homo sapiens
MTQKGLVHQSAPSAAGLLQFAGGPLQTLFAWVLAAEAAEQQILVNSKCCCLIVPLEVLSQRSTRPSSSMVGAPPPTSLPPCSLISDCYASNERGSMGIIPSEACTGYNLLVCRLLRPLEKHSIRVGVTRFSRCHVSPLSLTRKGNSLIPCASQIIQGYCEHLYAHKLENLEEMDTFRKTYNHPRLNQEEIEALNRPIASSETESLIKKNCQQKSPGPDEFTAEFYLTFKKLVPILLKVFSKIEKEEFLSKSFCEASITIIPKSRKDIKENNRSISLINIDAKIFKKILDN

SEQ ID NO: 924705 - protein, 159 aa, Homo sapiens
MWQVLSSCPVSRKNEVCRQVEASCPDVCSAVAEPRAFMGLRGEEVHTNWSTGSHGLAWKTHHKFPFWSVGLEAQPAAFRPSLGRRNLCVSCYIHGARAVGANGHLQASIKLPSVPPWLPSYAQQCPKSGGGLGSRWLVCQHCPECVHTWLGCDSVRAWP

SEQ ID NO: 924706 - protein, 158 aa, Homo sapiens
MRLAGQPWGTGRSQEPQNDHTVNSSIQRFLVQCGRPNTPLRFVCEAGCGKRCPGREVHDNRAGRGGGGGGGNGGDGRACGDGACGGGGDDHGVPSISVAVDSQVRVSSPEPSPEPQFLHGSSSGHPVSVLRSNSACPNELFFNFHPGLKPTIILHSLS

SEQ ID NO: 924707 - protein, 1304 aa, Homo sapiens
MEESAEQAQRRDETRVGRRRHSWRSRQSRQTKEFIFSELLSNLYSRRNLQTLVEESAEQAQRCDEMLLLRAAVQPALAWEREDTRGGSCCPTCTRVGTRRHSWRRRQSRQTKEFIFSELLSNLYSRGNEKTLSCCPTCTRVGTRRHSWRRRQSRQTKEFIFSELLSKLHSRGNEKTLMEESAEQAQRCDETRVGRRRHSWRSRQSRPTKEFIFSELLSNLYSRRNLQTLVEESAEQAQRCDEMLLLRAAVQPALTWEREDTRGGSCCPTCTRVGTRRHSWRRRQSRQTKEFIFSELLSKLHSRGNEKTVMEESAEQAQRCDETRVGRRRHSWRSRQSRPTKEFIFSELLSNLYSRRNLQTLVEESAEQAQRCDEMLLLRAAVQPALAWEQEDTRGGVGRAGRPRSSSSQSCCPTCTRVGTRRHSWRHRQSRQTKEFIFSELLSNLHSRGNEKTLMEESAEQAQRRDETRVGRRRHSWRSRQSRQIKEFIFSELLSNLYSRRNLQTLVEESAEQAQRCDEMLLLRAAVQPALAWEREDTRGGSCCPTCTRVGTRRHSWRRRQSRQTKEFIFSELLSKLHLRGNEKTLMEESAEQAQRCDETRVGRRRHSWRSRQSRQTKEFIFSDLLSNLYSRRNLQTLVEESAEQSQRCDEMLLLRAAVQPALAWEQEDTRGGVGRAGRPRSSSSQSCCPTCTRVGTRRHSWRRRQSRQTKEFIFSELLSNLHSRGNEKTLMQTKEFIFSELLSNLYSRRNLQTLVEESAEQAQRCDEMLLLRAAVQPALAWEREDTQLLSNLYSRGNEKTLVEESAEQAQRCDETRVGRRRHSWRSRQSRQTKEFIFSELLSNLYSRRNLQTLVEESAEQADQGSCCPTCTRVGTRRHSWRRRQSRQTKEFIFSELLSNLHSRGNEKTLMETKEFIFSELLSNLYSRRNLQTLVEESAEQAQRCDEMLLLRAAVQPALAWEREDTRGGVGRAGRPRSSSSQSCCPTCTRVGTRRHSWRRRQSRQTKEFIFSELLSNLHSRGNEKKLMSWQSRQTKEFIFSELLSNLYSRRNLQILVEESAEQAQRSRQSRHSGVTRCCFSELLSNLHSRGNQKTLLEESAEQGDQGVHLRAAVQPALAWEREDTRGGVGRAGRLRSSSSQNCYPTCTRVGTRRHSWRRRQSRQTKEFIFSELLSNLHSRGNEKTLVEESAEEAQRRDETRVGRRRHSWRSRQSRQNKEFIFSELLSNLYSRGNEKTLLEESAEQADQGVHLLRAAVQPALAIIGDINMNTISTATGARGRLLAAALTFVTCNPQQAEAPLLDL

SEQ ID NO: 924708 - protein, 228 aa, Homo sapiens
MEYVPGCELFSYLRNRGLFYSAEIICAILHSKEIIYRDLKPENILLDRDGHIKLTDFGFAKKLVDRTWTLCGIPEYLAPEVIQSEGHGRAVDWWALSILIFEMLSGFPPFVCVCVCVCVCVCVCDNMFGIYQKILADKIDFPRHLDFHVKDLIKKLLVVDRTRWLGNMKNGANDVKRHRWFRSVDWEAVPQRKLKPPIVPKIAREGDTSNFGTYPENDWDTAATHRPA

SEQ ID NO: 924709 - protein, 150 aa, Homo sapiens
MHPYCSRQHLSTVMLNCLHFICQRHRGERAAHGKGPEAAHCCVWNLVGKGKRKSWSSRLRAGHCAKESGLDPIGDNWMKMEASCQETNSAVVSWQKMVLKMHEPITEKQNVFEEKGRPGSPDVGGTADVWFVRDTGINLLKLSTCQSTFK

SEQ ID NO: 924710 - protein, 142 aa, Homo sapiens
MVSNPYTLLSSIPHSIIHYCVLDLKHAFFTIPLHPSSQPLFTFTWTDPDTHQAQQITWAVLPQSFTDSPHYFSQAQISSLPVTYLSIILIKTHVLSLPIVFLVFSETFISLTVLSLQERIQACPWNATSFSIHTKLYPGHHQ

SEQ ID NO: 924711 - protein, 164 aa, Homo sapiens
MGLFSPALDIGVHQLWALGLEKALVSELWCSHSECPCLLQQIKMHKGGSTEQKWLCTFELAMRITVELQHVPEARVWTRDEMLELMKAHVMMWCPPSWILEEATGSSRKSRMRGSSAFVSCLTRNSASLLLAGLLTLVEPKAPLHVEALQEMADLAVKEALSSW

SEQ ID NO: 924712 - protein, 291 aa, Homo sapiens
MVGANHSVVSEFVFLGLTNSWEIRLLLLVFSSMFYMASMMGNSLILLTVTSDPHLHSPMYFLLANLSFIDLGVSSVTSPKMIYDLFRKHEVISFGGCIAQIFFIHVIGGVEMVLLIAMAFDRYVAICKPLQYLTIMSPRMCMFFLVAAWVTGLIHSVVQLVFVVNLPFCGPNVSDSFYCDLPRFIKLACTDSYRLEFMVTANSGFISLGSFFILIISYVVIILTVLKHSSAGLSKALSTLSAHVSVVVLFFGPLIFVYTWPSPSTHLDKFLAIFDAVLTPVLNPIIYTFRN

SEQ ID NO: 924713 - protein, 140 aa, Homo sapiens
MAPILSSSCNSLGELTSTHMPTCTYKHSGASSLSCDSTSTDSGSKGESPFAQPIVLWDGQVWKLYHRHSHGTGRLREHDSCRQLPGRQPMMVDERDSVALQKAKYRPDGQRSEPTQPRIQCESRQCGVLTPLATGASSFE

SEQ ID NO: 924714 - protein, 140 aa, Homo sapiens
MCVVVLSSSRWTAYELSEASPKLRCSITFVQHKRLKNNCKNGLKKKGCIFSHFLVLTHSRPSVGTSGERCRKAGEPESSGASARLQKQMLVPRLYSQQNCEPNKPLFFINYPVSDIPLQQYKQTNTSGIPSNRKKQENRH

SEQ ID NO: 924715 - protein, 158 aa, Homo sapiens [sequence omitted]

SEQ ID NO: 924716 - protein, 145 aa, Homo sapiens
MFSTIIVVRTHEEPLPSEGSPTVARDAGTEQSVPSPHPLESLDYSGNLLGNIGTISPRQGQLAKSEPFQRGRLQHWEEGREWSGSWQGVGKWFLIISLVLLVLAGCLPWGLGHSGLGTGMGPITAGAGHFREELRGASEEEMGAN

SEQ ID NO: 924717 - protein, 135 aa, Homo sapiens
MVPSQQRGSLPCLRALQVWCTTGAEDRNQPYTISVVEERKVTLREEPLNKKKPGLDRLKNSQSFQVVNDTKIERFIVRKACSREKADEWPCIQQDWVLIPRGSVDTETDVHRGVMIKATRSASPTSQGQKGEARG

SEQ ID NO: 924718 - protein, 153 aa, Homo sapiens
MNRPLIEKMDIKGAGVKSSEGSKEYILEIGGEIFLLLTFWVRISVKSCNTGRVCGFTPKSGRPRTPREKRTLDVTLLGAMDAKGQCVDTPSRPGGGHCALAGFITERGMSPANLTTWKAALRLAYKEARWKHVSSGQDTTAAEEFASEIIWAW

SEQ ID NO: 924719 - protein, 141 aa, Homo sapiens
MLACCGVTCLCPEEPRLQGAPGSFVHFLLQAYGQPFSKEPWFLLLENAIRNQGLGTSYAHSYLGVIDSEPSQLTEQGNAVNQGELLMQCLMSVPKSERTAFIRGQWGPARVNPIVGDQGGVPQCREQLQGNHIPLKSEESW

SEQ ID NO: 924720 - protein, 283 aa, Homo sapiens
MSPVEAAEQQRWLPAPSSGISVPERCRPDASGNAPVYGVRKPLAHPVRRHGIRDSLKEALWLSLGEGVHCAGGNSTRPDWLGSSEPAGGKTKSAGPWRPRPPLSPGAQSQGGQSSVPKPLVGVAEIPAWRPRPVRRDGSGSCLKRHSGHDLPQPLCWLWGIPPGSIPSSLPGAGRGKTADWSCSDGSRPSPGSSVTLGSSRCRSGGDGRPSPGSSVVLGSSRCRRSDGGAIAPPCFSSLSVGRTNCLVIPGDRIWIPRLPVQDLHTVFVLFHGNLASQLFLEP

SEQ ID NO: 924721 - protein, 144 aa, Homo sapiens
MESTHAKRHTIKLNLEMGQFSKKQESPSNPSKDSQSTGASLTRNFLCFNPYQESHFKMKNLLFLPCFCFLRSFLSMKPTRCAQLREPLSVSYRSCCLVHETTHKSQLDLQSQFVEMLFDTNYSDSRELSHILIYLEHEKDASFH

SEQ ID NO: 924722 - protein, 155 aa, Homo sapiens
MTDKLSEADFRRSVITNFSKLKEHVLTHHKEAKNLEKGVDEWLTRINSVGNNLNDLMELKTMVREVRDACTSFNSQFDQVEERISVIEDQINEIKRNDKFREKRVKGNKASKKYGNKQMLRDFVTTRPALQELLKEALNMERNNRYQPLQKHAKP

SEQ ID NO: 924723 - protein, 131 aa, Homo sapiens
MPETCSFLAILWVKRRREELLPFGKPRLGSSQSQGCGFLFGVFGSWCLQASRHHHIPQCQPGKLLTLSLIQLQSRRKLAPTPAPGSACSMAAASMSNCTVAGPHARSHTPCHSTPDSQSPLEAWDPGRYLK

SEQ ID NO: 924724 - protein, 186 aa, Homo sapiens
MLCLRVEVVILFADSSDEQEMTALHMAEDTIAYRTKMKRFYAGIRRAPLLRAPPHLSWLNVKLVKERVWSEHSRPNRRKELPFLFMASEPAEQCEGSWALLSSVSCVHKLCQSAPSSKCLHYPRTIAMDQLPSAASVKMKVQSDQNTSEAPQKERNYILHKYNGDLNVLENELMASAFIVSYSNGP

SEQ ID NO: 924725 - protein, 149 aa, Homo sapiens
MAISQKPWTKTGSSHFKRVWGNIQVTEAAKLKMISGACMVMWRDRERPVWLSVNGEGQRGGQRVGQAVTWGTDICVSVEYISRSGNTGSKGVADTNSNHILLAFTSTVRKWLAENTGISLLRDFYLAIVEYLAHTSPEEYCYRSKLFHS

SEQ ID NO: 924726 - protein, 128 aa, Homo sapiens
MEFHSCCPGWSAMVRSRLTARCNLRLPGSNDSPASASQVAGIIGMSHHARLIFCILVQTGSVTKAVECDSSILSIYSSAVQQMYNIRHIDNFESSHSHILKSKYIIELRSYSLTHDRVQWCNHGLRQP

SEQ ID NO: 924727 - protein, 140 aa, Homo sapiens
MSRSWLLWRKLGLEGTQFPVGKRGKLGFPRGDGIPPRGKLVFSVPNSRASYVKVKNTFGILNLCVWMQNMCEEKCINTPTAATIRPRNRRLPAPRCILPNHKSGVPQRPIQCLLFNACCLLFRHCSRNTAMNKTEKNSSS

SEQ ID NO: 924728 - protein, 160 aa, Homo sapiens
MELWCGRDRNCPRPLMILKLFPELPPSTAAGCAELNMLPYGKSVSSSVTVPTAGGHRQAQEHNTYLISKLNSSLNDMGGLCKQVEFETFSATSLHEELSIDYRRVELLVNTSFPGVSPGKHKRFSAERRKDRHKEEHGMLEDHPNFNLHHYDSDYRGLAA

SEQ ID NO: 924729 - protein, 285 aa, Homo sapiens
MNSTDNGKGVSEKKKEEEEEEKKQQQKREKEKQKQKKQNQKKQKKKKKKKKQEQQQKKQKKNSHYKTADISSLGLAVATVGDGDVVLRPMELCSYGDCGCLCCITQVAREVMESQQRQASIKAHTDRKASLTPTVFSNSTEFISRQLVSRPEILTQASSLLIEKASTAFRLRPSPPLLLRLYLHFPFSPQLPDSALENSHMVKIITNFSWKFPSLCGLSPVPLTTLPKGPSEIKSEMDSLGFLRGWECQRPESPWQTTGVSPRVQKLKNLESDVQGHGASSMAEK

SEQ ID NO: 924730 - protein, 143 aa, Homo sapiens
MIASEVVPIVWMRRLLLLCCLIPTCCGRGLEGGSRIMRASLSSAILMIVNKSHEIRWVYQGFPLFLCSHFLLPLPCKKCLSPPAMDLSPPKPCGTLGSVGVLIDGVLAGLLDFPRFDFSTTLRPHCPRHFFTLGFWEQVVSVT

SEQ ID NO: 924731 - protein, 178 aa, Homo sapiens
MLRTTRVPGGPSLKRAGFFLMQDPSLFHWPTLSTFIIIDRETRPLKTLVDVTLENSNIKDQIRNLQQTYEASMDKLREKQRQLEVESSQEANAEVMREMTKKLYSQYEEKLQEEQRKHSAEKEALLEETNSFLKAIEEANKKMQAAEISLEEKDQRIGELDRLIERMEKVFLQRKEAR

SEQ ID NO: 924732 - protein, 121 aa, Homo sapiens
MEDADGPQELPSTGVSCLPNLRSLPQGKPESRDWLTVLPSSLQDRESPKSTPQKPYCTQVPTSESVFQGTQAKTGMETHSTFWKVEIIRSSCFPPIEMKINAEATEVTLRAAHPLSAPVQS

SEQ ID NO: 924733 - protein, 165 aa, Homo sapiens
MRGGLLPYTCESNVTRFLGMDFSSLLNLNDLHCHPDSEFYVCHFSHFILVKNYCWGASAVIWSLGAAGAGTLAVAMVEGLSLVSWVSAPEKRRATANQNNQPKRNAELQRIEVIRQGLGSCAGGPEGRHQNEQREDTEARLKQEEAGSPAWGYYAPGLIPGPQKL

SEQ ID NO: 924734 - protein, 215 aa, Homo sapiens
MTDHLCTGSPSTPVENHSSCSKAESGPSAAGLLEFAGGPLQTLFAWISAAEAAEQRILLNSKCCCLIVPLEALSQRGTWPSSLPPCGWISDCCASNERGSMGVGPSEPGAGYNLLVCHLLRLLEKLSIRVGVTRFSRCYPSPIPLARKGNSLTPCTSRAPLLQVCWSLLEVHSRPSLPEYHQRRLQNSKDCCLHLPLEASSQRGTCQDASWRSPV

SEQ ID NO: 924735 - protein, 163 aa, Homo sapiens
MRPPRNIGGNHMRSLDFQLTQQQGNILPFLVGRCQRRPGRESRLSPTPTSNEITLTKVSVQTTWRARTLTPVQQLQKVPYLGCQQRPGGGTVRRGPPSYRPQNVRSTDSLNHVPAKATDTQHQPVKAARMSVPCKATERLNSRSESQITALLKITSQVWHCRP

SEQ ID NO: 924736 - protein, 179 aa, Homo sapiens
MGPAEDTEDLPLNTIPNAGMDSSADMDPVCRGETGKSYHLGTLLPTFWLLQLQPWLKGSQVQLRPYLHRVQAISLGSFHVVEHSGTGDEDSWEIIIEELVNSRPQGMGKFLEGHLLFWGVVSHDDFQIIAFWKLTEPTQNCDSWLNWSCGPYPEVDSVHEECFPYPCDFIPNQPAGPIP

SEQ ID NO: 924737 - protein, 140 aa, Homo sapiens
MADTGCPPPSLSVAGQLQTAVLAARISSQWILVCWAPWGRESSLAFVLKLAVKKFSGLTCLLPHLCMVVNHAYQTKSIAIESPRGQDPKSFQIAEHLRFLEEQPGNKVTCNGLRGSFWKEAIKRSLRQRHMSSYPRVHSS

SEQ ID NO: 924738 - protein, 234 aa, Homo sapiens
MPESYTDSVQCSHPISIFTIPIQRIALSSVLHSRCILPTLVPRDVLCAKQLLLGVGIPGHTPLNTFLYQTLWALQRLESYTSLQAQVSMGVMGSIAAMIPEVHSKNKSFLDCEIHPLPVVIGDHEGILSGHSATSLLEFAGGQLQSMFAWVSSAEAAEQQILQNGKCCSLILPLEGSSQRGTWLYEVSDGPYWEVSPTTLAVDWIVGPLWIDVDPSTVQSWRWGLMGGDWIIGA

SEQ ID NO: 924739 - protein, 143 aa, Homo sapiens
MVTIKKQCRYLSLQHTDFNSFGYTPRSGIAGSYNSSIFSFLRHFHTVFQSACTNLQYHQQHVWVHFYPHFHRYFLYYIFLIIANLIVNSAVNPSGPGLFLVGKLLIIATISDPVIGLFRDSSYSWFSLGRVVGKDYESELWLP

SEQ ID NO: 924740 - protein, 139 aa, Homo sapiens
MAIIFKRQKISDAGKDSKKQDIPREDQGPTTKNLDFWPQLITLMVTIIDEDKTAYTPVLNQGCNSEQDSPGPHPHQDCRGGLQECKQLQCGVVRTYDDGVSGEAPTADMGLGDKAGLLWELPLRKCNFDKDLKDRVTKR

SEQ ID NO: 924741 - protein, 170 aa, Homo sapiens
MLGSLELPRDLQNCFEENADSDMDNEFQAEVASYGDEELVENWSKGDSCYAKRLTAFCPCLRNLSKVFKRKQSIKVLKILQLDDEIEKDNPFSGQKFKPAAEICISNEELNINHQDNGKMSSGHVRDLHGYSNHHRPGDLGGKKWFHGPGAGTCSSVQSQGLVPCVPIMA

SEQ ID NO: 924742 - protein, 255 aa, Homo sapiens
MWDKHSDNSRSVLGSYVRDKHSDHNSNVLESWVRNKHSESCSSVLESYVRDKHSDHSRRVLESYVKDKHLDTRCSVVESYVRDTHSEPKSSVVESYVVDKYLDSRSSVLESYMRGKLSEHSSSVLKSYLREKHSDQSTSVLECYVWYNHLDSRSSVLESYVREKIPDPSNIVLESYVREKHSDHSRNILESYVRDKHLDTYHSSNVLEYYVTDKYSDHSWIFLESYVIPLDPRRSVLESYVRDKHSEPKSSVLQF

SEQ ID NO: 924743 - protein, 218 aa, Homo sapiens
MVLESYVRDKYLDPPSSVLESYQRLESYVKDKHSDPRGCVLESYKKDKDSEHNSNDSRSPLKSNVRNKHLYHSRSVLECYVRDKYSETQSSVLESYVRENHFDPCICVLESYMREKHSEPNRRSVLESYVKYKYSDDSRSVLKSYARNKHLDHSSCVWEYYMRDKPSHNSTSVLESYVRFSHSYSRSSVLESYVREKHAEPCSNVLESYVRDSHSHHS

SEQ ID NO: 924744 - protein, 599 aa, Homo sapiens
MELYVREKHSEPSSSVLESYVMDTHGEPSSSVLDSYVKDKHSVPGSSALVSYVRDNHSDTHPSSSVLEAPVRDKHSDPCSSVLESYVREKHSEPITIVLKSYVRENHSDPSSSVLESYHCSGIYVRKIHSEQRTRDLESYVLDKQSDPRSSVMESYQCSGILSEGKHSDPSSSVLESYLRDKHSHHSRMVLESLVRHEHPDHSRSVLESCERVNYSDHSSRVLESYMWDKHSDNSRRVLESYVRKKHSVHSRSALESYVRDNHSDNSWGVLESYVWDKLSEPCSIRVESYQCYGIIPEGQTLRTQQQYSGILSELQTFRLQQECSGILCEGETFRTQQQCSGILHHRRIVLESHIRHKHQDHSRSVLESYVRVNHSDHSRSVLESYVRVNHSDHSSSVLQCSMRDKHSDHSRCALESYVRNKHSDHSSSVLDSHVREKHSEPSSSVLESYVRDSNSDHSLGVLQSYVRDKHSDPLSIFLESYVRKIHSEYSRSVLESYVWDIYSDPRSSVLESYVSYEYLDPHISVLESYWRDKHSDYRRNVLESYVRESNSDPRCNVMESYVKDKHSDPSSSVLESYLRDKHSDHSRNVLESYVRVNH

SEQ ID NO: 924745 - protein, 188 aa, Homo sapiens
MFWNPISALESYVRNKLSDHSRSILESYLWDKHSDHSRNVLESYVRENHADHSRIVLESHVRHKHPDHNRSVLESYVRVNLSEHSSSVLESYRRDKHSDHSKRVLESYVRNKHSGHSSSVLEFYVRDNHSEHSWGVLESYVWDKHSDPRIIVPESYVRKNIQNTEGVFWSPMCMTNTHTLMVVFWNPM

SEQ ID NO: 924746 - protein, 159 aa, Homo sapiens
MASSGPSPPDPFKLFLLPGISKEICGSRVCLLILCSLVPSSNDGINPLLVPGWALELLCLISAVRSSQSVVSYELCGGVMGSRQDDNDNKQARERGNEGLWTTQGYQGICSPEAPPFSSRLAQVSYPLVSPFCTSFMLPRIIPHHYLSNGCVLPGLQIR

SEQ ID NO: 924747 - protein, 159 aa, Homo sapiens
MTRVLISRGPCKDTHRGYHVKMEAGARLRHLQIKEHRELIGERKGTDSPPSELSRGTNPPKTLNVCFLPFEDPAFLHSERGSLLEAENSLHQMLALNLGLPGLQNVYPVALADMWSWVLCLSSSLCLIMTSLIMDTQMLSMEAVLNIGHYTFPIPYKFS

SEQ ID NO: 924748 - protein, 139 aa, Homo sapiens
MYRASRLLADGLYGKFGKLQVNYTRNMCEKERLNNPAKIWYDSNSSSIYNELFGNLGDDPWVLMRVSLGNPGSKTSPRHSEQPAVESSMVHSHTTCLLEWFESRCSELCSVYQQLFINSSRGYGHSGFPYFRYIRRKYL

SEQ ID NO: 924749 - protein, 137 aa, Homo sapiens
MPLERSMAQNVPWGIWLILSKNPKEYSEQCSFQDRHANGCRSDTAIIVTSQSLQTAGTCFSCFTFTFSMFSNSATPEIARSTLSPSQPSQCEGDEDEDLYNDPLLFNKYGNSPQISAFFSFFSACMWKFFCFLQNLL

SEQ ID NO: 924750 - protein, 139 aa, Homo sapiens
MGKLQGRTRMKMSRVEMSFTDVFSANVKTELENKILSGIQRAASSALGFRYQRAPGLNGQDTVKWTNQHTVKWTNQQDMGRKNKGIRAAYPSQQRQTAQQHENGLITGGMADWVVIHSISFNGQVSNFPELPPPQSVGP

SEQ ID NO: 924751 - protein, 2269 aa, Homo sapiens
MEWFVMEWTQMEWTVTKWNGIGIGTECNGMEWNGLEWNRVEWNGVEWNVIKWNGIKWNGIELNIKEQNGMGCYRRISNGMEWSGIDLNGMDWNGMESNGMDWNGYGMISNGMDSNGMDLSGMNSNGMETNGMELNGIQWNGIGWNGMERNVKWIRMEWTGVKWIRMEWTGVEWTRMERKRVEWNGMEWNGLKWIRNEKNVMESDGMELNVVESSRTELNGMASNGMETKGMELNGLKCYGIKGNGLKTDSNVMDCYVIDSNGMESNGMQSNGMECNAMEWNRMECSGREWSGIKWNGMEWNGIERNGIESNGMESNGMDWNGMDSKGIEWNNMECIAMQWIRMEWNRMEWIGMEWTQMERTITKWNGIGIRTECNGMEWNGLEWNRVEWNGVEWNVIKWNGMKWNGIELNCKEQNGMGCYRKISNGMEWSGMDLNGMDWNGMDSNGMDWKWNGIVWKGMEWNGVEWNRIECNGIEWNGMDSNGMDLNGIEWNGLAPNGMEWKGMELKWIRMEWTGVKWIRMEWTGVEWTRMERKRVEWNGMEWNGLKWIRNEKNVMESDGMELNYGMESNGMESNGLERNRMERNRIDSNVMDCYVIDWNGMESNGMQSTGMECNAMEWNRMECSGREWSGIKWNGMEWNGIERNGIEMEWNAVDTNGMDWNGMDTNGMDWSGMNTNGMEANGMDWNGMEWKGIEWNGIRIRTECNGMEWNGLEWNRVEWNGVEWNVIKWNGIKWNGIELNCKEQNGMGCYRKISNGMEWSGMDLNGMDWNGMDSNGMDWSGNGIEWTVKEYNGMECNGKISNGMEWNGMEWNTLEWNALKRNGLQWNGMECNEMERNRMEWNPNLFQYDGIQWNVQKWNGIKGNGIDWNRPELNGLEQNYGMESNGMESNGLERNRMERNRIDSNVMDCYVIDWNGMESNGMQSNGMECNAMEWNRMECSGREWSGIKWNGMEWNGIERNGMESNGIQWKGMEWNQNGMEWNAIIWNGVEWNAVDTNGMDWNGMDTNGMDWSGVDTNGMEAKGMEWNEMEWKGIEWNGICWSRMEWNGDYGMESNGVKWNGMNVKGIDWNKMKSNSRNHTEQKEMERNGMHSNGKESNGRESNGMKWNGMELNGIERNRMEWINGMDSNDMDSNGIEMIGVTSNGMDGNGIEWNGPKLASNGMESNGMDRNGLDWNKMDSNVKHCNAMDSNGMESNGMEWNGMRRNALDWNRTRMQWIAMDSNGMQWNGMEWNGLEWNRVEWNGVEWNVIKWNVIKWNGIELNCKEQNGMGCYRKISNGMEWSGMDLNGMDWNGMDSNGMDWSGNGIEWTVKEYNGMECNGKISNGMEWNGMEWNGMEWNGMEYTGMECTEVEWSPNGMQSNGMECNAMEWNRMECSGREWSGIKWNGMEWNGIERNGMESNGIQWKGWSGIKWNGMEWNGIERNGMESNGMDWNGMDSNGIEWKNMECGMESSGVKWNGMNVKGIDWNKMKSNSRNHTEQKEIERNGMHSNGKESNGRESNGMKWNGMEVNGIERNRMEWINGKEWNGTHWIRVQWNQLEWNRMEWIGVEWTQMEWTGTKWNGIGIRTECNGMEWNGLEWNRVEWNGVEWNVIKWNGIKWNGIELNCKEQNGMGCYRKISNGMEWSGMDLNGMDWNGMDSNGMDWSGGMEWNGVEWNRIEYNGIEWNGMDSNGMELNGIEWNGMAPNGMEWKGMEYIEWNGMEWNGMEWNGIEWNGMEWNTLEWNALKWNGLQGNGMECNEMERNRMEWNPMELKGKECRRMEKNQIEWHRTEWDGMEKTQLMEWTVMGRYRMGWKEMDSIGMDWNGMDSNGMDLSGMNSNGMETNGMEWNAMEWNGMEYNGMESDGTEWKAMYAMECNGIIWNGVEWNAVDTNGMDWNGMDTNGMDWSGMDTNGMEANGMEWNEMEWKGIEWNGIKSNGMASNGMDSNGMCSNGMESNGLISNGMEWKEMEWNGIEPNVMDLNGMESYRMDSKAMNGMGCYRKISNGMEWSGMDLNGMDWNGMDSNGMAWSGVDSNGMETNGTNGIEWTVKEYNGMECNGKISNGMEWNGMEWNGMEWNALNWNGLQWNGMECNEMERNRMEWNPMELNGKEWRRMEKNQIEWHRTEWDGMEYTQIMEWSVMGRYRMEWKAMDSVGMDWNGMDSNGMDLSGMNSNGMETIGMEWKAIGMEWNGIDRNGMESNGMDWNGIDSNGIEWNNMEWYRMELEWNAVDTNGMDWNGMDTNGMDWSGMDTNGMEANGMEWNEMEWKGIEWNGISWSRMEWNGD

SEQ ID NO: 924752 - protein, 199 aa, Homo sapiens
MFSSRGAVLEGRTPAALTLLPLASHSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSQGSSPFSASTSVPSTGSSLMPQKKNPDSLELIRSKAGRVFGRCAGLLMTLKGLPSTYNKDLQVRGRGRPG

SEQ ID NO: 924753 - protein, 142 aa, Homo sapiens
MLAPGFLHSLQSHEDLSYLLESDTNITTADKIQIFTGTLEERKYIVCGFPKNGVRSVTVWKDSFVEEYVEAAREDIAASHSQLSEDHGEHQLREFLVSNEKYSKAFPSHHYSTKENVEASQSLQRALSLIKAKARMPSIYFR

SEQ ID NO: 924754 - protein, 150 aa, Homo sapiens
MGSTSSGLNGLYQCHPDISPGNSAFSGLSVSTPFPTETTLVSQQHLISVFIGAPADVREDLFQFYSRLKSPHLPETKVLCSKGKRRPVLQKAHKGVAYWKLRLGALSDFLRSWEEVYYGNKEGIIEQMTVNFISLLIIFDCLLFTKNWGG

SEQ ID NO: 924755 - protein, 139 aa, Homo sapiens
MVVRILLPQGWAWRVSVEHALIILRLQPHLGPWRKGLSDGQVIPKGSMAAAVRSAGFIPIDLAAKKTVRPRGIKTVYDSHRQQSHEQCGVRSLGPYSTGRLKQKGQVMAGLSVYLFLDDVFVLLVSYLRNHCLTQGHED

SEQ ID NO: 924756 - protein, 147 aa, Homo sapiens
MTIKQKVTLIFIFLLCGTSCCIEAINHNIVSFIKLQFYVVYVCLSCWRNFYGPGAVAHALTFDQRTVVPVDVWIPVGRGCEVNSHIEVRGTIDGQRSDTAAGQQRLKRRCLDHGPGGGSERPLRASLGVSFSHSPYSAPLVPDQSLL

SEQ ID NO: 924757 - protein, 174 aa, Homo sapiens
MNGKDKVGILQHSDGTALKQLQPPPRGPREHTVYAADCSDGVLLELRKYLPKYGICYDIQNQHYGRSLTKGTTKDGVSGFFHNGYCLRKDAVAASIQKIEKILQWFENQKQLNFYASSLLLVYESSSQPTTTKLNDRTLAEKFLSKGQLSDTEVLEYNNNFHVLSSTVNGKIEA

SEQ ID NO: 924758 - protein, 211 aa, Homo sapiens
MRSHSATQVGVQCCHLGSLQVPPPRIPSMLLRWPEISTARGAYTGLRRGLWTTGLALPTRPSRQRLAAATGPGSQACRRSVLSPQLARTCRTSFHLECRGLNKEDAAAPENGDASNWRAPRGVTSFAQGVSRSEPAGSVTALSRSCHPQLSEWGVSQLLWSHCPQLTLQRSLPWRAGIPSANPRPQTLKGTYRILDNTQWNKWRDRNKWLL

SEQ ID NO: 924759 - protein, 134 aa, Homo sapiens
MFPFLCPCVLIVQFPPMSESIRCLVHMILLKVCEGTKTTGPFAAGLLEFAGGPLQTLFAWVSPVETQLEMQKSPTFWVDLALELHTGAGSLKKWLISKCGHGECKIVLEHLAVPESETVLKREWGHLKKAQKPT

SEQ ID NO: 924760 - protein, 231 aa, Homo sapiens
MRIYLIPDDLRWSSFIPKPYPFRPVCGKIVFHGIGPWCQKESSAAKLILKASFLLLYFSKNFIEQDCCQKGLFALTMAVAVVMRPFNGISESSLTLSCQGFWRLSSLIFKGIFTKNFHPKFWNPCKHLIYFRPLLWDCRQKCDKGLKAGKQQRNINNNRGNYEAFAYGAIWFDLRGPPYLDIEIFCIDEKKNGKMQPSALLAPSPGKNMSVSLGTAEAEGRICYQLGSLSH

SEQ ID NO: 924761 - protein, 141 aa, Homo sapiens
MKVCSFTPEVSKTVNPPEGRNSGHVGTSEGTNSRHTIFRNCNTHCEDISTGSPEPQSKHNIHCEEKALPTLLSQIYKALHTPHHSPTLPCPTLLQPHWPPDHSWSTRCPSTVGPVPWLPTLPVTSFPRYMMVNCFIFQLLV

SEQ ID NO: 924762 - protein, 151 aa, Homo sapiens
MHIPVALYRQQTLGIFFRMLFAVVGHCRQGSVRLRDFTLHFQVAPPEFCLTEQTSYVKNMKNRTCTWEFLYITSLLAVQCIMFLRFLYIVMHIDQKPRQTTQNKPGDESTPRKHKDATELLSCFKCANFSLEKSVIFEKGPMLLEEEALPC

SEQ ID NO: 924763 - protein, 137 aa, Homo sapiens
MHMVHKGTSGPRGHKHLFSLSSLGALHSIQQNLFWTVFHPTKRSYSSGSQESRCKFWPVRFKCKWMQLAEMFLERRKYDIFHYFIHTFDQNSNEMAGLLAATLDYEEEVFYQGISLHSTWLQSHFQVLDSSALSRLT

SEQ ID NO: 924764 - protein, 346 aa, Homo sapiens
MALLAQEADKLTLGQNLTVVTLMNTKGHHWLTNARLIKYQSLLCENPCITIEICNTLNPATLLPVSESLVEHNCVEVLDSVYSSRPDIRDQPWESADWELYVDGSSFINPQGERCAGYAVVTLDAIIEAKLFPQGTSAQKAELIALTRALEFSEGKTVNIYTDTRCAFLTLQVHGALYKEKGLLNSGGKDIKYQQEILQLLEAVWKPQKDFYISHFSVLAKAVAQRCVTCQQHNARQGTSVLPGIRAYGAAPFEDLQVDFTEMPKCGGDCVWIKDWNVAPLQPWWERPQTVILTTLMAVKVEGIPAWIHHSRVKPAAAETWEAKPSLDNPCKVTLRRRQALLQSHL

SEQ ID NO: 924765 - protein, 159 aa, Homo sapiens
MSVTSVAFQWVRCTVMAEGQPEIVLMSQCGTEDLIAARPVKASTWTDNWLPCVLSCLGFWFLLIFLGEFQIEIVWSEETRNCMNVMICVKIIAVNEPPYCFHKWLQQSAFPPTGYRRSPFFTPSPTLAISCLFDTCNSHSNKYKVIYHVVLICVALMMI

SEQ ID NO: 924766 - protein, 163 aa, Homo sapiens
MDIETQRPSKTPHLPFASESTKHPCLPLFDIHPLSPYRSENTSWSPISETYSRTHSEVLSLKRNKEEEEEEEKEDEEEEEEEEEEEEEEEEEEGEGEGEGEGEGEGEGEGGGGDGGGGGRKKEERGRGGGGRKKEERGRGGGKRSKKEGGGGRKRKKEGRRKE

SEQ ID NO: 924767 - protein, 142 aa, Homo sapiens
MSWGLGNHLKFLAMLAQETQSVGEAVLDSDENVGTSRASVKITALMKQMKQAIKDVRHKSCRPSGVIIHLFMSLPVFTEQVRKRNCYCLSGCVIATWVGLDNNSERCVKKIAGPLILKLPNQNTKSCEHTEYLSMNKSEGGG

SEQ ID NO: 924768 - protein, 158 aa, Homo sapiens
MWQTSEATFSCSFIHLCTYQAAGTIGTCHHIQLIKTRDLVSTKETMFPSLAYFTLRTCSFCPLWLRARTLSLKKQNKTKQNTATRTIKLLIKAEDRMAYCLGHSKQTSHHVYKTKRSAQLVTVSPADYGKGSYPFISVQSSVKVSRNQLNLSQSTPST

SEQ ID NO: 924769 - protein, 134 aa, Homo sapiens
MYYMQHYYFTRNQTVITVPICEHKLQSAHIFWTFVIGPSGCIHRHHLTWQCNVKSGVGWGLNGLCHTMIQNVPTLGSEGFGSHEELRNQQFCLERVYSPWIWWIWRFCMVILCLDKCLNMKSRENHYVFLCITL

SEQ ID NO: 924770 - protein, 140 aa, Homo sapiens
MYHNTVIRPGQLASWLAFPAQQVWTAGPLQILSSSGPQMPIFFNKVRLSAQQVLPAPWHVVSLLLVFSRAEVPHWSLSFISSTVGNFYSLALSCQQYSNSANFPNIQETVATPSTSRSVISALVMGGLASKIIPSLCTQT

SEQ ID NO: 924771 - protein, 180 aa, Homo sapiens
MNDIIKFKRDSMVSVIIILLKHLNKKFEVEEVKYHMKRVVKKKFMREYILLCAGSFPKLISGFVNHGTIDILDQIILCCMACSVFCQIFGIIPGLNLPDANSTFSLKTIEIFQDVAKCPSGLKVAPNSNHCFEACHHREGCLRLNVCLRLIYTPKSNSTVTLISRKAGTLTSYYVNFCLC

SEQ ID NO: 924772 - protein, 225 aa, Homo sapiens
MLPVGLSDTEPLLEPAPGSSQCALIICFLSASTDNENLSKAGPCLHCPVVSRRKMFGDRQGPTHWANADVGPAGFWGWSRSRELLLPVLLQLLLPPLLLWLSLPPLPPQLSLHHRYRGCHCHHCYCSCHYHHCHHSCHSTTATAATAAVTTTTATAAVTATTATTAVTATTATAAVTTTTAPMASTTTTTATEAITTTTATAVTAAITLAVAMVTVVLGRGVLGI

SEQ ID NO: 924773 - protein, 151 aa, Homo sapiens
MQRGYWGCMGTLTKVLSLEDCPGKLEKEATFLPSCVWCEERCLTSKCLHGEDKLTGSRKKHNCKNNNGEKAGSKYFESQSQERASRLSVAPGKLSHDAVGVGSHLVCTVHMAMSCLQRQKASYCVGGTQRVGGVAPQSKEKALTRWRADFR

SEQ ID NO: 924774 - protein, 135 aa, Homo sapiens
MRKAAGEGEDAPIVFVCDNSSDSPSFPQPPTPVSLFLAQVDGCQVTCSQALQYQAFPWAKACMWYKTANAVNYDNALGPWKDKSSCPDFKEIPERHSCCYISRTPASTNQENGFQVQTVSPSSPLTLKSSDCSKL

SEQ ID NO: 924775 - protein, 143 aa, Homo sapiens [sequence omitted]

SEQ ID NO: 924776 - protein, 161 aa, Homo sapiens
MVSCLDFNHSSRCVVISCRFNFIDNKRPPAEDNSSGKKQSHLMGQCEPEEYGDLGLWALMKLETNSQQTNTETENQTLHVLTRKWELNNENTWTQGGEHHTLGPVVGKQAAQPEVSSESITFWAPPPVRSAAALDSHRIHRIPSPTASVSCTCKESRLRAP

SEQ ID NO: 924777 - protein, 178 aa, Homo sapiens
MEANASLVIAPECQSHLMCVFRPRCKEETQSLRSLHTSLHWGSFGVMIPQEVNTLDLERGALVKLNHDGTLIDLGHPASRTVRSKFLLLVSHLVYGTLLEQPKLRHMLTDLGLSNTKTRFKARSGVGTKTAFLSSSQLIQLLLVWPPLLGSSGVYAADVSKVSVVLSAAKDESFLQIK

SEQ ID NO: 924778 - protein, 159 aa, Homo sapiens [sequence omitted]

SEQ ID NO: 924779 - protein, 155 aa, Homo sapiens
MECSLRLCRWNRHGRRIYYVGIAELSTWLGGLTIMAEGKEDQVISYMDGRRSKESLCWATSSLKPSDLGRRIHYHENNTGKTRPHNSLISHQVPPTTCGNYGSYKMRFQWGHRVKPYHSAPGRFQISYLHISKPIMPCNSNFSAAPHSAGTNLLY

SEQ ID NO: 924780 - protein, 213 aa, Homo sapiens
MKRILDKFHWGTFTEYLTSTLLRLSKTSLKNSYSPGELKERHHNQMLCGILDGILEQKKGIRVIERSWRHHIIQLQTILQGYSKQTACYWHKNRHIDQKNRKENPEIKPLAYNHLIFNKVNTLRARAEADFIVVDKFFDVLLDAVCQYFIEDIRFNSGPFSPSLLQFAEISPQTLFAWVSPVEAAEQQRLLPAPSSGSFIPEGHWPDARGSPV

SEQ ID NO: 924781 - protein, 136 aa, Homo sapiens
MVNEEFELMILKIISSVLVSQGCHNKTPQTGGFQNRNLFSHSSGGLFSHWLSLHQGSPALRPWTGTSLWRVRNWAAQQEAPASCDQPIRTQGPYPCLRDSYLFAWKLSEQRIRTNLAGSWALQHQELDRCTAITFT

SEQ ID NO: 924782 - protein, 199 aa, Homo sapiens
MLAKIWVHDPGRQHEEKDLTAIAGFKDGRDPWAKECNQLLEAGKGVKMDSPTGPSESHAAMPTPSFQPNESHFKILSVLSGNLTEDVPHVKNKDGTMSRKEEIRHESSKKNHWAYTSWMELEAIILSEVTQEWKTKNRYVLTYKWELSYEYTNKKFGVQGVVGSGTADQQVELFSLIIYLPQYHQQQPFPPPLYREFIG

SEQ ID NO: 924783 - protein, 135 aa, Homo sapiens
MHFESLSAPVKKPIHRRDHLWRPLWSHCVQSYEEAIAFSSSSILTQHQKDIKSFLNAFRENPGLAHGLGGEAQKADDKQVGKAAPSLQSCITYAILPLESRSIPSNSMEIIPSNSVESTFHYGHVPALPNNVSNK

SEQ ID NO: 924784 - protein, 179 aa, Homo sapiens
MTPPFFNSLIATSPIEGNPWPYHVLSFAGITSMVGLISSDWCPQKKRRHRYKGKKVLYKQKQRLNFCYHKPRNAGGLPDTERQEESVLGTSEEQGLADALISVFWPPELYIIAVLKAQRENKHFSEDIGGGEATTSSMRAEGLLSIFPMQKNIVFEKKMIECIIMQLFNTWDLRVLKVK

SEQ ID NO: 924785 - protein, 140 aa, Homo sapiens
MRASSFGACGSWDLQYPFPWFSGLQSWAASYISSPPKFSSFGLGLDYTTGFSGFPACGQHIMEVLGLPLNANIKKLDRSQINTLESQLRELENQEQTNHKARRRQEITKIRVELKEMEAQKNSSKKSMNPGDGFVNKIIK

SEQ ID NO: 924786 - protein, 165 aa, Homo sapiens
MGTHLLHQHDPDVRHGIKDDHFGPLRFGCPAGFLTCMGPVDTLFWLIFPIWNGCIYPMPVPPLYLGKFYFIIEVVARKTLSMAVLSGKTRLYDNGKAKDPKYVDEWAQQNACGLGSVTDPAERIADARHYALLYKILSFAVETWIPLLAFSEKWVPGRPVFSMCI

SEQ ID NO: 924787 - protein, 168 aa, Homo sapiens
MTMYTISQQIVTFTGASKLTPSAFVQFFKIMATSRQKDGKEKQHNDNLHILWTTEVPFSISLDKERLVQPCVFTMALEALHNDDKNCDGEKITIIFNEQDDSEYEGTPKETPLLHFTMLYVFFRAGPQVLVRKYIRTSSPTLCCPVPLHSDRLHNQKVSEFDKNVLFS

SEQ ID NO: 924788 - protein, 172 aa, Homo sapiens
MEELKQVIPIHPPEFLDKIKRSFLQSTKEMHLSKREKRSGSLQMFKVREETSEEKGSRSMWCLGKQLRTMFNEEGAINCVKHNLIDDPGDSQMKSGRYPQVISILVRKECKKILSLMFNKEEQSWAKLSKRLPPSPATRLWSSTFAMSPDIFQLQQLSVSHSRTSYAVPFTF

SEQ ID NO: 924789 - protein, 137 aa, Homo sapiens
MVVTSFLRNLHSDSSCTYLHPHQECIGVPFCLHPCQHLLFSFLFIIAILTEAKHRVCAIAGGKATSHSPTQVTLRLWKARALDLFLPGAVFLVYCTVISLGSSISCGLEYWGPHSTFRSSQYCEDMEAVLSRQDAVP

SEQ ID NO: 924790 - protein, 141 aa, Homo sapiens
MKVKRMHSQAALVLLYTEEPKKGREEEPSPTLPPPPSPSALPLLGKDTKEKMEISPEPPPPINWKKDKGYTTAMGPCLRQAALEGELLACLVMQDQQGNQKVLPQGMLNSPTMCQYHIQALLPSRKEFHNCKIIHFMVIFY

SEQ ID NO: 924791 - protein, 136 aa, Homo sapiens
MAAFFWSCLQISLQAEQEQPLVGARTSSTISTPLSLNAITDGQRDAKCRVSLPQVQNQLKDEYMKKLTDIKLLALLLIIYVHRAVKTTQDGNVKGNIGKRWKNLYANISSAEYNNLLRKHHGLDLNHDEDESEKKI

SEQ ID NO: 924792 - protein, 197 aa, Homo sapiens [sequence omitted]

SEQ ID NO: 924793 - protein, 130 aa, Homo sapiens
MPALKVDKSGAISCKATGAELPKAIGLHLLHQCDLDVKHGVKGGHFGALRFDCSAGFQICMGPVAPLFGPISFIWNACIYPIPVPSFYLVKDSDETISHPTLWSYLLRAHRDQLLEEYTLVEFEEGSIII

SEQ ID NO: 924794 - protein, 146 aa, Homo sapiens
MCQIPCELVLSHTADKDIPKSSLNKGGSLLTSPLDIAQVGTLCRGSNPTIPLCTAPVEVLHEGSVPTAGFFLDIQAFPYILGNIGCTEQQGSAPGPQNHSVLLGLQACDGEGCHEEEVLTLLVVPYEGWSSLNCFFNQRYTKCNIR

SEQ ID NO: 924795 - protein, 172 aa, Homo sapiens
MLINSGLDKENVIHILHGIQCGHKMNEIICSNIDGAKAPDWGCCFSFRDALPREQESKEAVWQQGISRAAVSSVQSKLPRSLVYTASGKLLTQASVMTDTPSPTKLEHPRLTSDSYAGSQNFKPVDISFLGSMVVGSTELDHLAPCLQPPFQRNEKFYLTDVPVTIGVGGGA

SEQ ID NO: 924796 - protein, 153 aa, Homo sapiens
MSCFPFTFYHNYKFPEASPAMLNFSIVIQNERIPPCYWTEVPTETSGLYMGSMMVKALFILSVDESPDSLPSSDTAHVERDKGENRFKGKLEANGSVMKTDSKVKEKMIMEEPGGSDVNFRLNDKDFESIHLWVINLVALPPREPSCLPMIKG

SEQ ID NO: 924797 - protein, 183 aa, Homo sapiens
MGKGTTGHRAKRVNQVLLERDPFPVLMVNTKSQLDWIEGCKVLTLDVNSLDLGSADMIGSLIPVSAFRGWAFTVDIYGPKPKNQKSDVQGQEERKKTSITGERRKPEDSASQLTPPSSLLYSSLMSKGRKRERRHPSGEKDGSRKTQQASLSHLLPCFIVAVLAVDWMVSTHIKDECLSLPVH

SEQ ID NO: 924798 - protein, 146 aa, Homo sapiens
MVPASAFGEGLKLLPLMVERDEAHLIMVDKLFDVLLDSQTGPSAAGLLEFARGTLQTLFAWVSAAVAAEQQILVNHRCCCLMVSLEVLSQRSTQLYLKLRAGRTTTLFKAVREGHLSLQRLLLSFCLSVPCPQRWSLQRQAGLLEL

SEQ ID NO: 924799 - protein, 136 aa, Homo sapiens
MYYNHLPEFWFLLRCFFFVWIVVKFSVPVGRTISGEKEEKMKKNLKLSRNLLNRCDQKVDSDMDNEVQAEEVSDVNEKPTGHWSKGHICYVLAKSLAALCSCSSNLGTMKLKEMFKSSLMERTCLVSDILDFGLLS

SEQ ID NO: 924800 - protein, 149 aa, Homo sapiens
MGETAPLIQIISHCVLLTTCGNYGSTIQDEIQSNGIIVSPGRNILLLGAEISSQQENKVMKARSKSFHTTERIPGESPTHPTSVCVRCYCADEAAGSGACLGVPKTDSGARLHNGKVGWSHWEFMPCAGRRSLASAAPPPCTRWPGIQS

SEQ ID NO: 924801 - protein, 137 aa, Homo sapiens
MSELLKIYIFFEIYKDFSSSSRRPIPLAMFSCSGIGEEKYIVRENQRRTFFQVNAMKELFLVSSRLHRQCQWEDLGLKGCCSDSFIPWGAPWIWVSRLFLSESPTAVIVISLLDLAIQWSYHAPGRYWRVSTKSPVM

SEQ ID NO: 924802 - protein, 129 aa, Homo sapiens
MTIFTSPASPSKEFYLSNSEKERYGKEFSQERQQEILRRAARALPICTTPVSKTIRYCEKCQLIKPDRAHHCSTCDSCILKMDHHCPWVNNCVGFSNYKFFLLFLLYSLLYCLFVAAYSFRVLYKILDE

SEQ ID NO: 924803 - protein, 160 aa, Homo sapiens
MPSQSPPTCNSFSYPFIVFMTLNRLKISAQYTEDNRRLDKVRIKMKYNITMCYRQKFDLVEGDWKNLHGNGDIPNDCSIMCSLQKKIACEAIRSRAFLYHGNEKNGKKWFESGLDTIERICRNPSSLNIHTEKYCIGFLKMEGETTKLYSLDDINYRVKC

SEQ ID NO: 924804 - protein, 166 aa, Homo sapiens
MSLLIFLPNGYFHFREKGIKVSNYVCYTGIHVPWWFAAPINLSSTLGITPNAIPPLDPTPQQAPVCDVPLPVSMCSHCSTPTYDFPSNSQDPLLQVCWSLLGVHSRPSLPGYHQQRLQNSKDCCLVLPLEALFQRGTCQMPARALLYEVSIDPCWIVFQMALLSSH

SEQ ID NO: 924805 - protein, 134 aa, Homo sapiens
MLHLPLFHSSLIAVTSLTDFCCYLIFFEKHAYKSHTLTCKDIKESRPSSADVVLTEEIGQLTLAKDPSSDPIGAAPWLWQKPNPFMHLVTSMQYANLTGDSETEHCPVVNPSDQGSRVNFMCSGTKRIHAGLSP

SEQ ID NO: 924806 - protein, 174 aa, Homo sapiens
MAEDEAVSASCDQNGRKTESRGRRCHTLETTRSHKNAIKGKALKWEICPHDPGDLSSDYPWVGLATVTVRDGGVVLEPMGFRGKCGCLCRQGSGGKPVAVGLTQLPHSWCGRHCPKNLPHFQGTRIAGEISIAETSGDGLQQRRRTRAISISHKRVPPWSLVTCSAQDASGLHH

SEQ ID NO: 924807 - protein, 181 aa, Homo sapiens
MEDSMDMDISELKANKDDHFKVDNDENEHQLSLRTVSLAAGAKDELHVVEAEAMNYEGIPIKVTLTTLTMPVHPMVSLGGFEITPPVLLRLKWGSGPVHISGQHLVAGEENAESEDEEEEDLKLLSISGKPSPPGGGSKFPQKKVKLASDEDDDEADDDEDDGDDFDDEETEEKAPVKKSI

SEQ ID NO: 924808 - protein, 144 aa, Homo sapiens
MPQHLLSQNKCHGLGKAGFLFQGVTSMDEQRLPHAQHLVTSLLSVHVDCSRYSVIQQPVEESYFDGNFEQHCIIAFHFAEDLSAGHTRACPHGIDMQRCDLQPRRLGPVLSPPSVLPSCGDSSRLSRMKRPCLDCTLLPTTRTF

SEQ ID NO: 924809 - protein, 145 aa, Homo sapiens
MAFLLTRLVLLFPSSLFHCLGATSWLSWPLPTCEGSLDSALKGIRRFSDPGAQRLEQLCQGTIWAQRHESIWKYTKAISVDVIQTVSNSSIPANAVFILPSPGLMVIKSPQWDKYCISCENHWITKMLAAPWTSRSLSLVRKCAI

SEQ ID NO: 924810 - protein, 147 aa, Homo sapiens
MAKIHVCLSECYKVPSQINNSNKVFGNTERSRNFDVVIMKMHPKTSEKTVACMKELLKSMEEDVERSEPDNKGPDGACDSRWHLQERLSGIELHERPGRLLEFLLLIKPILEKEEEEKKPKHFYRLVEKQKAAAESSQGPRPMRTST

SEQ ID NO: 924811 - protein, 164 aa, Homo sapiens
MGLGTVEQGVALVGEARAAQEPMERVGGSGMAGCRSRALPRGKAAKARTPSTAAGPGAKSLIARGQQGWPAALSAGPAKPMPTRNSSWPASAAHSPGSRWRLSLHTSLQAEGVGSGLGQPRKGLPQRSGGLEGSSSAAKVGAHAEEAPRASEGCEDCQHAVTSQ

SEQ ID NO: 924812 - protein, 125 aa, Homo sapiens
MQRINKVNGVALEVVEGDDDLRVSGFPIAVDREKLNQLKKGTMEENWVWWGEDHMDNFGDVELKRTLDIEEMLSTQQEKGESWREVEGFSPKILGDDVASAVAYSAQARNCPLQLKHWNRNEEDS

SEQ ID NO: 924813 - protein, 164 aa, Homo sapiens
MDRHQWPSKGLGWGNGGSGLGCRGRAELLPKLNAVSPTQVRAGSAYALQSRQDSPALLTPRRNPTAQPPAPPCPRDRPSWSHKPSIPLGIFNPKDPGGITRGDPTERSVRAPISRIVFLALSKLLSPAIREIRHLFLTLHHHVEIIENGNPGGVSGRARLCRGA

SEQ ID NO: 924814 - protein, 159 aa, Homo sapiens
MQIASIHFFSIHAQFGGIKDIHVVVQPSLLSRSRTFSSWKTKTMCPLNPFPLLPSSSPSPPPPTVSLNLTTLGTSFWWSSIRGVAIPTACASVSLSQRRFISQIQMSLSCCRRTEPPSPKVQAGALTAPETLSVWRKWEGGSCTGGEPSEVKENSIHAA

SEQ ID NO: 924815 - protein, 139 aa, Homo sapiens
MPDLMILRQCCKTERADFLKHPRTLEHAGKSLNWNSSLESRLESRSTRVSKGAVIVCSCWDLHLHPEHPDNFCQTVQLSPTMYECGPRCPVPRKSFLSPLVNQTLLSSGMYSAFYVPGYGVLVNVPHELEKDAYSAVVG

SEQ ID NO: 924816 - protein, 143 aa, Homo sapiens
MRVSCYTPGEQAVKLPRAFSMGATGIQQVETRDAAKYPPMHRTAPPTNKKLSSPQSAEISLTGGCTKAQLFSVNGCQLPTTSHTDGSHLNVCEISCPSFSIPSRHPLPMTDGYRDTKAQTPIFQEEKTLWWCHLCSRATAGSS

SEQ ID NO: 924817 - protein, 186 aa, Homo sapiens
MTSSRINLIPSLIPRASSGVTGLLCCSSGVAVLRNGPETVTGHSAERIGLTLKPVYEELELRERERERSQGLIVSLRAFSSWLLGTAPANWSWLLLLVTQRGLYDMPGTQALLTQWASCHQHHCAAPSSSWVLTDTALTIPRAGLNLAFTLTKLELSLKSSEHQGGKVISAWFSCALDWPFPLFPA

SEQ ID NO: 924818 - protein, 162 aa, Homo sapiens
MTLSLPYNPYQSCCDEKIIESKEHIFLLHFTGKLLHSLFPVCKRIVYTAAAAEDRDTPTFPNLPLKLRFFQMQILRKGFMRGLLIWEVQTLKAGAVYQGLEMSYVFKDIGSLPVLRAKQNTTALSSGGGFRVSLCPTYKSRYVADQSAASSTTISTLPLLPC

SEQ ID NO: 924819 - protein, 142 aa, Homo sapiens
MPPDLFCLLDIVPQLQVCWSLLEVHSRPCLPGYHQWSLQNSKYCCLILPLEALSQRGTCQMPARALLYEVSVGPYWEVSPSQATRGDALPTEVESREAVGLAELRWAPPSSKFLAALFTLLSQLTLARKRKSPDPLHFPGLL

SEQ ID NO: 924820 - protein, 156 aa, Homo sapiens
MQGRLSLLKLCPQPPLPSGALSQGDGGFILRQCPTLLRLALHGLHLLSDQSQDEADLIVMDKLSDVLLDLQSSSTVLGEPSLSGSTALFRAGRQKCLSLVKLRPQPPLPPGTLSQGDGSFIYKLLTGAAAFLSEMPFPVKRNLERKSGHSCFAVLC

SEQ ID NO: 924821 - protein, 160 aa, Homo sapiens
MGYSVHCLGHQGPALWLGVQRVMPGPAPTLPCPSGGGRQGHRVGPLRMKGSSSSEQEQEQEQVTQTQVREVGRRQEAGPHRSRASRPWGTSPIVPDFTYRTKGRITVLRISRWCPWSLEAQVGGPLRAWGPAGVPRHTPVQRVEEVPVVSYITSPNRDAH

SEQ ID NO: 924822 - protein, 170 aa, Homo sapiens
MHFILGSGHPQKSFKKLWGGEDGGGRWSGRKVGSGELAAATVALKTHEKEEMTCGKDAMLWTQSMWPKFLLSQCAVLYLGWQEKPARKSPKVLRNDEWDKCSFSWLVEQAVRMGEHLPLVHQGPLDGRLSQAVHNSLLVGIRSFEGSDSTYLDKERDLKEYFYIVRKLKK

SEQ ID NO: 924823 - protein, 151 aa, Homo sapiens
MKNATTLRALSAVRCACKAAIPLQMPTALIPGGIVQPELQAGEISVEANVDVMRNGGAYRGIECIRKVSKFETSKKAVEEETNLKDQLSLQSRKGIEVAQRKNSQGHPKESTCPCSEGVGGWCMEAHLAVGVRFIVTVLFQPWPCCLVAHR

SEQ ID NO: 924824 - protein, 199 aa, Homo sapiens
MGCSCSGGTTQMIWGTREAQASLLPTDGPSQRDHQRGLAAAFNFACLSPDCPRWVGFLWLLWRMGVWFSGQWSYDSREIMPASAGSRRLPGDWGKAGSDRPYPMPIQPARPVSLPPCPPNSTRGTCPRLQASLLRKQAGLSGFTPPHLQQLLCAYLYSQITSSPDSVQETAQIVSKFSWKFPSPCDLSPVPLAPLPKNS

SEQ ID NO: 924825 - protein, 335 aa, Homo sapiens
MVKVKARVDRFGHVRCLVTRAAFNSAKVDIVAISDPFIDLNYMVYMFQYGSTHGKFHGTVKAENRKLVITGNLITIFQERDPSKIKWGDAGTEYSVESTSIFTIMEKSGAHLQGGAKRVILSAPSANTLMFVMGVTHENYDSSLKIISNASCTMNCLAPLAKVIRDNFGIMEGLMTTVHAVPATQKTVDGPSRRLWCDSHGALQNIIPAPSDAAKAVAKVIPELNGKLTGMAFCVPTANLSVVDLTCCLEKPAKYDDIKKVVKQVSEGPLKGILGYTEYQLVSSDFNSDTHSSTFDAGASIALNDHFFKLISWYDNEFGYSNRVMDLMAHMSSKE

SEQ ID NO: 924826 - protein, 196 aa, Homo sapiens
MFPSLCSLCPYVLVIQLPLMSPSAAGPLEFAGGPLQTLLAWVSRAEAAEQQKLLPVPSSGSFVPKGHPPDASWSFPNSLPREEESREAVWLQRLCSTEVGSAQFKPPSSFVYTVRGKPPTQASVMADAPSPTKLKGPRLTSECCAGSENFKPVDLSLLGSVGMGSAELDHLAPWLQPPFQGGEQFSLTGDPDTTGI

SEQ ID NO: 924827 - protein, 145 aa, Homo sapiens
MPFRFRLWRRFDHYGRKFPMILSSVGALATSVWLCLLCYFAFPFQLLIASTFIGAFCGNYTTFWGACFAYIVDQCKEHKQKTIRIAIIDFLLGLVTGLTGLSSGYFIRELGFENGYDRVCQYNTDDVFRSITKRSHGRATLDGGI

SEQ ID NO: 924828 - protein, 147 aa, Homo sapiens
MKYRVYNYFPMSPHVVFIRITTQVLGVIAKPAASSTMFYNNRDWDETVSPVKGDSTQQLLKTLRRYRRCNVSVIVLGKDFMEKNSKEEITKAKIDKWNYIKLQSFCTVKETINRVKRQLRQLEEWEKMFSNYSFNKRLISRLKKELK

SEQ ID NO: 924829 - protein, 141 aa, Homo sapiens
MSGACQGCQAWGIKRWKRKGECLLSLSITLQVFTERGKGNFLSFRISNQLSSPSPAYTPLEHILNHGNCFDPQNLKEKCLIALCTKVWLNYEGLVGLRKEPFISIKPGSWKFSVMFDPCQPRNTEVPGALQEINRVGVRRL

SEQ ID NO: 924830 - protein, 143 aa, Homo sapiens [sequence omitted]

SEQ ID NO: 924831 - protein, 134 aa, Homo sapiens
MGKDQQLFVRLWPFLPPPPDHLLKGEMLKRTTFSIPQSQTNTESRLSLSKSVTARGVLSTGSARYVLPCPRWGQERKFCSSSKAQLSRPLLQRLPPSPRTDLLLICLFPQYFFENLFHREPQGSTRWPQGFVNS

SEQ ID NO: 924832 - protein, 138 aa, Homo sapiens
MLGKPLTVVLLGLSQAVVRAVLLSGGSRENPFTFPTFRCCPYSLDHGTIPPSLKPVMWDVYGVLMLHLPETRNTVSSHGGRQESKRDELPPWSPFMRAPKPIPEQNKYVLVSGIIEALKMDLSTSNQWDIFLCGLLPC

SEQ ID NO: 924833 - protein, 163 aa, Homo sapiens
MAQTENLQIPLTDDTGHLEHTLPTDKLLQFLSRTPVIMPTKVVPSPIPNALTLFTDAQLSQKHFAKTSQDIKPAVLWKGVNTNEWCGPNDLLTWRRGYAFVHTPSGPLWIPAQCIKPYYGMARTQPSTRNEENDPIGPAAPDNAASVDDTGPRQNAEEDNSEG

SEQ ID NO: 924834 - protein, 138 aa, Homo sapiens
MPAPGAAFPEAAAGVSDCAVARPYNHSHPPPPPPTAPHLTCSLPWRRGIQASSETLEVVHTILIKHAAVYKPQKTWHLSRKLPEKTCLLSNRNQAFQFCRNNCSTLKDLHATFPTELWLSTHCLGCVVVIGEQRFINN

SEQ ID NO: 924835 - protein, 175 aa, Homo sapiens
MGREDFAKLCSENWIFTCRRIKLDPRLRCHPTSCLSNRPSGDADGPRMTLSKSAPRGCAYAEVSRRSCLSHKKPGEEAYDFPAGKGSGKLNAQVVLPFLPINGKLEGGAGGLFHSVQLSWCLLPICSGPNTAKYMDLWDPGFFCLVVSLDMAFLLKELHHPKWLQELQPSDPHSS

SEQ ID NO: 924836 - protein, 217 aa, Homo sapiens
MKLPEERSGSIICRSAIFAALQPPLVTPRQTGSGVDLQQTPTDLQLRVLTVRRKTNKQKGHPQQNPINKRLNRINSVEKTLNDLMELKTMAQELCNACTSFSSRFDQVEERVSVIEDQMNEMKREEKFREKRVKRNKQSLQEIWDYVKRPNLRLIGLPESDRGKGIKLENTLQDIIQENFPNLARQANIQIQEIQRMPQRYSLRRATPRHNCQIHQS

SEQ ID NO: 924837 - protein, 153 aa, Homo sapiens
MVTLACSEVAFGLRGNNLEDSVHCPSQKDPGARCHGFEGVAKVTSSRKPSRASAAHVGLALHREKSLTPTRMDEMLPYLNQAPALAAPAQHPEELPDSYLPIKGSLIMEAEKSHDELPASWRTGEARSMAQSKPEGLRPREADDVTLSPRPQA

SEQ ID NO: 924838 - protein, 149 aa, Homo sapiens
MTLLIQMANKDDEDAVFYLYFFEDAPNGSLLCECYTWVESPLSSFTVESQQLETVNNDLRTRNGKGQNAQPQERSSVPMNVIKTLRSLGVDSYIELDALHDSLQTRYHGPLIPAMATAVFPGDHWLLSSECTLLGMVPHGPGTHRVAMP

SEQ ID NO: 924839 - protein, 143 aa, Homo sapiens
MITKKNPNKAEIGEQEEINIIPLLLLRQKQRQEMMTLTFQPPVCCLQGAFWFENECSTYWPVRQCYSKCGPQAGSNIIGEYVNNADSPAPAPDSVLTVYPVLLLQQSGIYEVPRWPLQPMNHCDSIHFCECLDPGRRCPLGKD

SEQ ID NO: 924840 - protein, 285 aa, Homo sapiens
MLPWSAPSAAGLLQFAGGPLQTLFAWVLAAEAAEQQILVNSKCCCLIVPLEVLSQRSTRPSSSMVGAPPPTSLPPCSLISDCYASNERGSMGIIPSEACTGYNLLVCRLLRPLEKHSIRVGVTRFSRCHVSPLSLTRKGNSLIPCASQIIQGYCEHLYAHKLENLEEMDTFRKTYNHPRLNQEEIEALNRPIASSETESLIKKNCQQKSPGPDEFTAEFYLTFKKLVPILLKVFSKIEKEEFLSKSFCEASITIIPKSRKDIKENNRSISLINIDAKIFKKILDN

SEQ ID NO: 924841 - protein, 157 aa, Homo sapiens
MMVFGDGARKKLSMLYDLERDFCINRSLRQGLPKHRTGSINITWEFVRNIQPEASSRTYKIENSERGTKKPLQGVHVQVCYTGKFHVTGVWCTDNFVTQIYSAQNAFPLVFLSSSHRLPGKYLFILQEEVHLSSILQQAEHVASFSLLLQHSAPGLL

SEQ ID NO: 924842 - protein, 144 aa, Homo sapiens
MWIICRGRDIHTVLCSGSVVLKVCSLNLQLHCHLGNVKSENSQIHFRPAESETQEWDLGICVLTRPPDDPDATEAREEVHIRRTSLFVRYCESSSYMKKPQRRKFTVNSGGKRKDETLRDLPLTSSRMHHLHESLNMQIEAPEG

SEQ ID NO: 924843 - protein, 142 aa, Homo sapiens
MGNENHILIFSIGVQIKTCKRLTQQWEKWVGQVCKWECLQAFGAGSAPDEMLKVLNMCSSSGSMVAINPFIKKKICPTKTSVLRISRHWLQMPEKNRKIMRVGNNQGSRQGYHISGVHLLRELQGCKHFKAKNAAFLDKLDI

SEQ ID NO: 924844 - protein, 140 aa, Homo sapiens
MQSGYRGFGELWWAPPSPNFLMALFTLYRVHLTGACRTVGAGEWMQPTECQPKKGKALPHPGDEAFRGMIRQQHLLFSNIRCSAASAANTQAKGSGVDLRQTPTDLQLRVLNVRRKTNKQKGHLHQNPICTSPSSKTKGR

SEQ ID NO: 924845 - protein, 149 aa, Homo sapiens
MGKMSPGHVRDLHNSLSHHRPRGLGGKTGFMEQGLGLSCCMQPRDLVPCFPAAPAMAEMGQSTTQAVASEGASPKPWQLPWGVEPACAQKSRIEVWEPPSRFQRMYGNAWMFRQKFASGVWSSWRTCARAVQKGNVELEPPHSPHWDTA

SEQ ID NO: 924846 - protein, 136 aa, Homo sapiens
MPVLPVCIEQAHFPADPDPLDTSLLSCKASSLLASTFVLPIIRATSYMNLGQVWKNSVSKMLSLPFRICTTEYISNSCQDLSGWTHGNDSFISGAYAGPAKRQRSCYGPNVCVSQSSYPEIPTPNMMMLGDNVLGR

SEQ ID NO: 924847 - protein, 157 aa, Homo sapiens
MHKDEEKCPKMLKIPKTRMPLLQNLTTPHQQGNKTGWRMEKNINDLMELKNTAGELHEACTSINSQINQVKERISEFEDQLNEIKCEDVIREKRMKRSEQILQEIWDYVKRSNLCLIGVPESDGENGTKLENTLQDIIRENFPNLAKQANIPIQEIQ

SEQ ID NO: 924848 - protein, 145 aa, Homo sapiens
MRFQVKSSFSHILQEALEYKVNGRAHLASDKGPQRLQTYMENHLEKVVEMTRYPRYLWQVGIKNKNQTEEEDSGDLGKASTMSTKVHLLHHSGPFAFHVSEQFGGIKHIPTVVSHYRYPFPKLFIIQTETLSPLNNNYPSSLSQP

SEQ ID NO: 924849 - protein, 405 aa, Homo sapiens
MVLPAWGRGHIAMANPQMLPVGSSSFQGGLGGGYGRASSIGGITAVMIIQSLLSPLNLEVDPNIQAMHTQEKEHIKSLNNKFASFIDKVQFLEQQNKMLETKWSLVQQQKKARSNVDHQFESYINNLWQQLETLGQDKLKLEAGLGNMQGLDDEINERAEMENEFVLLKKDVDEAYINKVQLESGLEALTDEINFLRQLYEEEIQELPSQISHTPVVLSMDNSRCLDTDSIITEVKAQYEEIANRSRAEAESMHQSKHEELQTLAGKHGDDLQCTKTEISEMNWNISRLQAEIEGLKDRRASLEAAMVDAEQRGELAVKDANAKLSELEAALRQAKQDMVRQLPEYQELMNVRLVLDMEIPPTGSCWRARRAGWPLALAGGSSSFSRTSSMVVKKMETRDGKLVS

SEQ ID NO: 924850 - protein, 161 aa, Homo sapiens
MVCLFTGAIISGSGRHWMYSCALAGIQPPAPFLPCPGGPLPPLRTSWGQEMGSALQSLWVALPGVSRDGRRATWVQYLQQGGGRAACGPCSGQPGAAEQSTAPRLGQRAESVRIQATLWGCNQAPFRVQLGSLGKNSEKGACFGAKSGMGAQPLGLRTEKI

SEQ ID NO: 924851 - protein, 148 aa, Homo sapiens
MQRPKEGSEKSSLNSTVCLILNLSMRTQREASLSKTDRVLEALPQTGRQQSLLPDESNDVRRTTHIGSKHNRGPKQIPADTICSHMTGVDRDPGGPCDAEEYGLRDRREWQGEGLVEEGSHLQTKQRALTRNHQPLDVRLPSLQNCEE

SEQ ID NO: 924852 - protein, 155 aa, Homo sapiens
MRESAVYMRRHHGQSWSSDVSEKIGRCCFTLAPGLLGGPASIPELPERKTKSHPRSRGCLGIGRHQAPHSKNRSLICLGENNDEEASQQRRPWRAVYTLCLSPHSLGSDVDVAKLPADLLFPFILACSGHQGPSWDVGCLGTKFQFLIPQCHTVP

SEQ ID NO: 924853 - protein, 192 aa, Homo sapiens
MASAKNICGARRWCPRSEMWLLHTWSRTSAPKTASSSRRSSLVTAKRMAPTMCCASVGRAQWVTETCSIQGKLATLWGHGALLLSWSLRPPPPPRLCTRHPPSVSGDLTLAHVSFNALKDMTSSLHPPASRPAQPPSSEGGAVWTFARLTPGRGLGLQPSHPHKGCELPPQRGAREVVPRQREDGELPKCVL

SEQ ID NO: 924854 - protein, 180 aa, Homo sapiens
MGLGTVEQGAVHTGEAPAAQEPTEVGEAQAWRAAGPEPCPAGRQLRPGEKLSTAATGPHAKPLTARAGGLAGRSECGAAEPMPTQNSRWPASTRHSPGSCSRLSLHTSLQAKGTGSSLGQPRKGLPQCSSGLKGSSSTARVGTKAEEAPRAREGCEGCQHAVTSQKQEKSRPRENKNYTH

SEQ ID NO: 924855 - protein, 304 aa, Homo sapiens
MLQKPRNRGRSGGQAERDRDWSHSGNPGASRAGEDARVLRDGFAEEAPSTSRGPGGSQGSQGPSPQGARRAQAAPAVGPRSQKQLELKVSELVQFLLIKDQKKIPIKRADILKHVIGDYKDIFPDLFKRAAERLQYVFGYKLVELEPKSNTYILINTLEPVEEDAEMRGDQGTPTTGLLMIVLGLIFMKGNTIKETEAWDFLRRLGVYPTKKHLIFGDPKKLITEDFVRQRYLEYRRIPHTDPVDYEFQWGPRTNLETSKMKVLKFVAKVHNQDPKDWPAQYCEALADEENRARPQPSGPAPSS

SEQ ID NO: 924856 - protein, 140 aa, Homo sapiens
MSPLHLTPTTTKPQCHTPFRRHGCFFIIHPAARSTFPATRQSRAAATVRHPSQEQMVLTVGTLSVPKDTQGPAGFPPASSLPRQCTCARASGATSICQEQIMFPCECLLSITQIRPPCKDNHWSIYHLSFPVPKYKSSSC

SEQ ID NO: 924857 - protein, 125 aa, Homo sapiens
MGNFRPVLRRVIKLTTANHSCGSVRFDQFVSLPFQLQHSAGLVIKLVKLFCGPWLFLITVEAPAGQAYASPMGLSQSAMLCSFAKSPSDHQAISSVPPVTIWVPGDASPRRSGLHFLQVEECEYT

SEQ ID NO: 924858 - protein, 751 aa, Homo sapiens
MSLLLDAFQKETLHCVMRAVPQATLQDPEKRQSQGEGNGDCHIIYDRCGDRGCHGGCDRDCGVDCDTHRDKVCDTDCDRDYDRGQAVIETVIETVTETVTEAVIEAVTEAVTEAVTETVIEAVTEAVTETVIEAVTEAVTEAVTEAVVEAVTETVTEAVTEAVIDTVTEAVIETVMQTVIEAVIEAVIETVIEAVTEAVIEAVREAVTEAVIETVIEAVTEAVIETVTGAVTEAVIETVIEAVTDAVTEAVIEAVIEAVTEAVTETVIEAVVEAVVEAVTEAVTETVTEAVTEAVIDTVTEAVIETVIQTVIEAVIEAVIETVIEAVIQTVTEAVIEAVTETVTEAVTEAVIEAVTETVIEAVTEAVTEVVIEAVTEAVTEAVIEAVTEAVTEAVTETVIEAVTEAVIEAVTEAVTEAVTEAVIETVTGAATEAVIEAATEAVIEAVIEAVTEAVIEAVTEAVTEAVIEAVTEAVIEAVTEAVTETVTGTVTEAVREAVTEAVTEAVIETVTGAVTEAVTEAVTEAVIEAVTEAVTETATETVREAVTEAVIEAVTGAVTETVIEAVTGAVIEAVTEAVTRAVTRAVTETLTATVTGIVTGAVTEAVDRDRHCDGDWDRNVTKSGTTIRVGTTVPGARAHTPTVDRAVGGDSSNTANTEAQPGPGICGDASRLKLPREDSEREIPESDITTCPMGSLLASRISLLSTQGCLSPRSKAFAKQQEGEAPSLVPTTLLKIPTMMVKETQFISDS

SEQ ID NO: 924859 - protein, 203 aa, Homo sapiens
MGLTAGRVSPIREHLYRAAFLSQDASAQQGFYYTKSKDLKYSTRTTVIKTKSFSKYNINPPGFLVGVRQKMKAVGAFSEKINLESVKGSRGGRSLRNCVLQPRYCTFPMVFTTHRPADSLQCLPHQGPEFQAQNWADTKLAAEVFFPNPSGTSNVSETEPFTPLERGAEARDPSGLALWAPCHGAQQTKIHWLEILAASTAAV

SEQ ID NO: 924860 - protein, 137 aa, Homo sapiens
MLLTQSLFAMKHINEAYQSKLVEEILLNAQVQALPYRRSTWDTGVNGHRSGGDTKQRPEQQEERGARNMQPRSLKCTVHNRVHAPRESNAATDLTGGGAQAVMLAHPPLTFCCVAQFLTGHRLDKCSGSENKEIGQT

SEQ ID NO: 924861 - protein, 154 aa, Homo sapiens
MILESQGNLALMLFNKINAKGWRNEGWGTARGKVLMYDKTWCLLSGKESVSYNTFNGLPLGFHSTQRFSNSMDDEQLSKDISLVHHWENLSKVLKIEDPSNYDLKTVLPGCLTRGNAAMLADLGMSVHSENGALGGGGANEHSIPWIVNCTEGL

SEQ ID NO: 924862 - protein, 161 aa, Homo sapiens
MGTPGLIYNSQDPLMELEQDGHPNTTEVLLERRGHNNCSSCKVELLYSLSGSKKGSPEEQYSFLSPLSHLIPSHWSTGRQEQSLEEKQEVDESRWQQSRFSSRKHTHDPLNSLKGTQTKTQVLVLLTGERHQSSEVISQEDKNELKLKHYKNPRSVRNMKE

SEQ ID NO: 924863 - protein, 134 aa, Homo sapiens
MTVKTRSDLLVCKISSLGYSWMSDPWINKETRSLVVCVPNFLKLISLKQLLSAAIQKQIPICYHEYWGGDENMGRYLEDKIIEFSELNIDLNYVNGLKKKYWLKAMMFIWGRKIFGYGRLLPSLDEKGTEMFPS

SEQ ID NO: 924864 - protein, 149 aa, Homo sapiens
MTVLSVFWNHVNDGSITRLQEFRAIFQLFTRMAINLFFSSANLHASKVATTKILDRHILDIEAHIVPRKSFTQIFMVPFDRFYFSCNVDWSKDDHHTRFENTSLHLANRNSTNTINFVDILEKQGLSVGRVGGRMQSRASSSVGPMALQ

SEQ ID NO: 924865 - protein, 172 aa, Homo sapiens
MHLEKLQTLNANCESSQEGLLEGECGAELSQPSQPPDLCSPNQQPTIPQSREIPSPGSNAGSRRGVLHFPTEYGVALMVKVSIASGEMPCGHHQSVPNRRERRPVGEAMPEEVMCKGITELGVLEPGEGKTVATAMLQLAQFFPEHVLPDLGDQSGFRAFVTKVSDQQCLSK

SEQ ID NO: 924866 - protein, 142 aa, Homo sapiens
MPWTKVIEAVNGLDRDFNWDKNKARSPSWGAFLLERLPKASWYEQQNPKLEALCGMRTTDCYHWELLNQDVLEVAQPVSWCNWDLKGTLTYSLSLNSSGMQTNSQFFTLMSKLLADLYQALGLFRGESDSSTQCSLGFRGNV

SEQ ID NO: 924867 - protein, 172 aa, Homo sapiens
MRILKCLLSGYPPFSEHRTQVSLKDQITSGKHNFIPKVWAEVSEKEVVGSGSKGMFYNRRSLKTLWLQGLGLPLLNADLIWNCQELEDEDMKRKFQDLLCEKNESTALLQVLAQGPLESSRERSIARLGVEFVETGWLAADIFMRTAGTLVHNNRPGYILILALIKIQVYSL

SEQ ID NO: 924868 - protein, 317 aa, Homo sapiens
MDTAASQSVERHRGVTARLGWLVGCAIWGCAACTGGWFGGPNRGCTAFGGEPVGGTIPDCIAGNSEKMATETDSSVVRVVGAGHQRELLHAWLLGARVCGPLACLTVVGGGGIRYWRHWGTEVGGAIEGRTSRGVGDEFGAIRLHCWWRSTELASKEGVVLLSLTPHSRGRPTLGHTGMRQGTQRFSGFARPAAPCQEEEETPRACNTTARLATGPAPAAALALAWNLVLSRTCPDSAMALALLCLVPGPDPDPDPFLALHWPFPGPELAVMNMGLPLPLPCHGNGIGQSVVLTLALPWRCHSLGPALALALPRPQP

SEQ ID NO: 924869 - protein, 300 aa, Homo sapiens
MTLRGLPVVAIGESARQCFNIVTALLSLMLSKSISLTCDRLPIPNSLQKCSRPDLGLAPWVQHDRGGQGLALGQRTLSDGLQLLAFQGRLINLTRVIRWEYQVETKDTFLEELLFEPALRTGGDRTGEEKGVPYEQRLATTQSNTPTGPLWHPCPVPVTTQFFPLDPGIQSKQGGPLLQLAAYNYNLEPKQHFGSWFGTMKRLDPVVWQCLGYPDLTLDRPWEGALEPIDFRIEHWDSLSTKGGKLQTELKVQCAKKNIKDKSTTKIILSVEKVKDFTVNKKKILLEQEKDAYSHQSYFT

SEQ ID NO: 924870 - protein, 1141 aa, Homo sapiens
MMSVSCVVAFVSVILEQPASQASQASQPARKTSQASQPGKPAKPANPAKLPASQASQANQPAKPASQPSQQSQPASQASQQAQPPQPANQPNQPRKPSQPAKTGKPASKASQASQPSQPSHSARQVSQASQASPASQPAKRASQPAKPAKPIKQAKPASQPGQPSHLASQASQATQPAKPAKPHSQPRHPASQACQPPSQPSQPCQPASQDSQPAKPTKPPSQPSQPASQPASQAAKPVDRPASQASQATQPAKPAKPLSQPSWPSHPNSQASEANHASQPAKPASQPSQPSNPAKPTSQPSKPSQPAIQATKPPKPAKPAKPPSQQSQTATQPAKPVKPPSQPSQPRQPASQASQATQTAKPAKPPSQPSQRSHPASQASQATQPAKPASHPASQACQATQPAKPPSQPSQPATQPAKPAKPPRQPSPPATQSAKPAMPASHTRQPASQASQASQPCKPAQPASQSSQATQPPKPAKPAKPPSQPSQRSHPASQASQATQTAKPAKPPSQPSQRSHPASQASQATQPAKPASHPASQACQATQPAKPPSQPSQPATQPAKPAKPPRQPSPPATQSAKPAMPASHTRQPASQASQASQPCKPAQPASQSSQATQPPKPAKPAKPPSQPSQPGTQSAKPAMPARKPRQPASQGSQPTQPTKPASQARQTSQPAKPPSQPSQPSRPSQPASKASQASQPAKPAKAAKPAQPASQPSRASQPASPASPASPAGQASQRAQPAQPVSQPNQTTSQASQPPSKASHPAKPAKRAKPAKPPDSPASQPAQAAKPDKPANQPDSPASQPAQAAKQAMPASQPSRPRQPASQPSQASQACQPAKPAKPPKPASQADQASQASKPAKPAKPASQPSQPSHPARQASQATQPAKPPKQSSQRSQPCQSASQASQPAQPAKPASQATQPPKPAKPAKPPSQPSQPGTQSAKPAMPARKPRQPASQGSQPTQPAKPASQARQTSQPAKPPSQPSQPSQPSQPASKAGQASQRAQPAQPAKPGKPASEPSQPSQSASQTRPPAKPASHPAKPASQPSQPREQSQPSRSVKPAKPAKPANQPDSPASQPAQAAKPDKPANQPDSPASQPAQAAKQAKPAKTASQPTQPSQPSLPASQASQATQASQPSRPSQPSQ

SEQ ID NO: 924871 - protein, 116 aa, Homo sapiens
MSLKPGSGFLRGGSSLQPLSLRWVGWGAVTVVPSGAPEFGTLKRQCPNYLQGPIRMLEADSIRRIITPPSGAGPGHIEDVLYEEQALIDTQSTDALFVDFSASRTMSNIFLLFIYY

SEQ ID NO: 924872 - protein, 813 aa, Homo sapiens
MMSKETRQSKLAEAKEQLTDHHPQTNPSVGTAASDTKKKKINNGTNPETTTSGGCHSPEDEQKASHQHQEALRRELEAQVQTIRILTCQKTELQMALYYSQHAVKQLEGEARDLISRLHDSWKFAGELEQALSAVATQKKKADRLLLCLLYPDLTFLYLQYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEREEKIQEQEEKIREQEEKMRRQEEMMWEKEEKMRRQEEMMWEKEEKIRELEEKMHEQEKIREQEEKRQEEEKIREQEKRQEQEAKMWRQEEKIREQEEKIREQEKKMWRQEEKIHEQEKIREEEKRQEQEEMWRQEEKIREQEEIWRQKEKMHEQEEKIRKQEEKVWRQEEKMHDQEEKIREQEEKVWRQEEKIREQEEKMWRQEEKIREQEEMWREEEKMHEQEKIWEEEKRQEQEDKMWRQEEKIREQEEKVWRQEEKIREQEEKRQEQEEKMWKQEEKIREQEEKTREQEKIREQEEKIREQEEMMQEQEEKMGEQEEKMQEQEKMRRQEEKIREQEEKIREQKEKIREQEEKIWEQEEKIREQEEMMQEQEEKMGEQEEKMWEQEEEMQEQEEKMRRQEEKIREQEKKIREQEEKIREQEEMMQEQEEKMGEQEGKMCEQEAKMQEQEEKMRRQEEKIREQEKKIREQEEKIREQEEMMQEQEEKMWEQEEKMCEQEEKMQEQEEKMRRQEEKMREQEVRLRQQEEKMQEH

SEQ ID NO: 924873 - protein, 174 aa, Homo sapiens
MHSGQPVALPTSLRHRSGVRQRQAHGPWLSATPDTSCKAREPLGNRTARMLALEQELKEMKKCGKAVKGICKFTQKSNRYKSLKDTTYRYFISSHMPNPAKPNFGASPASRPATGGEAAQTSLCSENATLCVLLTPSPLWKWPHSVLAENRFPHTTLSSSPQDTLDNSVPGKSL

SEQ ID NO: 924874 - protein, 156 aa, Homo sapiens
MMAAPQFARGLQPVSTCDRSRTRARDLCTYVRMHSGQPVALPTSLRHRSRVRQRQAHGPWLSATPDTSCKAREPLGNRTARMLALEQELKEMKKWICKFTQKSNRYKSLKDTTYRYFISSHMPNPAKPNFGASPASRPATGGEAAQTSLCSENATL

SEQ ID NO: 924875 - protein, 461 aa, Homo sapiens
MEWKLEQSMREQALLKAQLTQGPFPLCFGQVCSLKKEKKHDKYRVEKLERSLSKLKHQMAEPLPPEPPAVPSEVELQHLRKELERVAGELQAQVEYNQRISLLNEGQKERLREQEERLQEQQERLPEQEERLQQLAEPQNSFKELNNENKSVLQLEQQVKELQEKLGKVKETVTSTPSKKVWEVELKSQEAQSLQQQPDHYLGHLQQYVATYQQQERLEAASQQKQQLTAQLSLMALPGEGDGGGHLDSEGEEAPRPIPSIPQDLESREAMVAFFKSAGASAQEKQAQLQEQVKEQRVCCQRLAHPVASAQKEPEAARGPGAPGPGGESVSGETHRALQESGFMDHLEEKADLSELVEKEELGFFQYYRERCHQKVYHPITKPGGSAKDAAPGGGHHQAGPGQGGDEGRVCNISAGVGVAVTVSAGSSVTAEHPSLQVKLLELQEMVLQLVATTRDTANSW

SEQ ID NO: 924876 - protein, 115 aa, Homo sapiens
MDMSLDNWGCFPIILSAALLIFTPSSFLEILDFIFFFFGKFKYVFARIIEHVYLLNHIIRNRKSVQILVLSCSDFLNSKNSHLLPDTLMLEDKAYLKFKDSALVKVAKGLFVFPR

SEQ ID NO: 924877 - protein, 118 aa, Homo sapiens
MLLSFVVKTMGSLSSAYVFTCRPETWEEAGEKMPSESLCLAAQARLDSKWLKTDIQLIFLPKVICFGSKYVYGSYPVSDVNRKNNSAEGKLFLLQKLKDAGLVSVATEQVTKHKFGSL

SEQ ID NO: 924878 - protein, 180 aa, Homo sapiens
MDWTWRILFLVAAATVKVSCKASGYTFTDYFMNWMRQAPGQRLEWMGWINAGNGNTKYSQKLQGRVTITRDTSSSTAYMQLSSLRSEDTAVYYYKCTVTHVDSFLRQTHMSPRGLFPQTTTYVLTFTLSSENRHFLMWTLVSDKQTCLHVNSIQISTHMSTLTVSLHKHIYPMSNCSVAK

SEQ ID NO: 924879 - protein, 134 aa, Homo sapiens
MNTYHRPNQPSPQKQGTSRQEKNDSSLSHNSEVIRAATPTTGPECKGSKEITISERPPAPSGPWRAMGPGREPLWWQGCPEPLGQTLQEPSELNSYPARLQRQDHHLSSNTVKIKLSHSFSPCTHGSQGDKRPL

SEQ ID NO: 924880 - protein, 171 aa, Homo sapiens
MAPPSRVLSLRWMVSSVLPNPTSAECWAALLHDPMTLDMDAVLSDFVRSTGAEPGLARDLLEEDNHPKWVQTTNSKFLQDLCGLWLLSCIDSTLGRLEEGKCLAHLQLCGTSNCGLLSASAPPTVIHLPEPGRCCLHAVQGSRLHPVGQRVAVVSAHSPHPLLGPALGFHR

SEQ ID NO: 924881 - protein, 166 aa, Homo sapiens [sequence omitted]

SEQ ID NO: 924882 - protein, 149 aa, Homo sapiens
MGSLRLYLCLWLLLHFLTDLYDRTAAPSHELWADPVAGSLSCGPESVFGWGSCCRGPAVPAARASPACSEQLGHTEHLPCPAWQKRALSRLRPKLSYGLRIQRRSPGEQHAEPFGFEKEGDEGQGAGATASHEPYLPSTSHDPHLPTLD

SEQ ID NO: 924883 - protein, 141 aa, Homo sapiens
MTACLGQDRAAAQRCQCQPGHHRRYRSRAYGQDVACVPCKFSQISHICNLGKSQKSLLFWELRKCPFLWGPWLEPCLKKGAVLLPLAHEGAQKGPHMLKAGPERQFLAPRKLRMAAWSTAWHLGDTTHVQIPVPLPAGLIL

SEQ ID NO: 924884 - protein, 147 aa, Homo sapiens
MPSSSICIAAHYASGTGKYPQDGFKDPLDQLPIYLVTKNAASFEWGPEQEKAMQQAQAAAQAALPLGPHGLVNPMVLEVSVADVEAVWSLWKASKASSCGTMPLSGTAIKDSSEGKSSQWEEMARCAIVYQILGCSLWVGWMVRDLE

SEQ ID NO: 924885 - protein, 142 aa, Homo sapiens
MTQHNKGSSINSQFYFGWNASWLDVGTQQPSINLQSLVLYRKCGAGIFLVSGEASGSLQSWHKAKGKLVFHMARAAAREGGEMLHSFGSCKNSLTIVKTASSHEGFARRTQTPLTRHHLQHWGLHFNMRSRGDIHSNHINGL

SEQ ID NO: 924886 - protein, 168 aa, Homo sapiens [sequence omitted]

SEQ ID NO: 924887 - protein, 143 aa, Homo sapiens
MPRLQAISRQEGGARGAQLSPTRGPGSSVNHPGSQKSLPKKAGVKLVLLPSCPVRGGLELRRPGPSKCCILPEKLELKKIKSTIQCKTMKKKHDCFRLCSVRAQSLPWEFTTDEGRGASWCWFDMSSRTQEIPAPIVVACKVV

SEQ ID NO: 924888 - protein, 181 aa, Homo sapiens
MVPAPLYLWQNSAVNLSGPGLFWVASLQWVRTCSFSLEKFLIADLLKPTSVNSSKSFSIQFCSIAGKELRSFGEEGVLCKAPQLQVCWSLLEVHSRPCLPEYHQQRLQNSKHCCLILLLEALSQRSTHLYEVSVGPYWEMSPSQATRGSGTHLRRQSIHSQSLNAVLGEPVLSSEVSDRDV

SEQ ID NO: 924889 - protein, 153 aa, Homo sapiens
MFQLERQMETTQNLVDSYMAIVNKTVWDLMVGVMPKTIMHVMINNTKEFIFSELLSNLYSRGDQKTLMEESAEQAQWRDEMLRMYHVLKEALGIIGDINTTTISTHMGARGQLLPAGAERPCRMQEPCHTRTCTLYSLALPQLLWHTCKSIPS

SEQ ID NO: 924890 - protein, 158 aa, Homo sapiens
MSHIEKNGLGPWRTTAIKQSIGSIHQIPDGGKKGKTEAHRGRYHERQFSRTQRGILTNSASFCTKILCSRQHFLHLKRELEEQYKKCDKPHNGYTTIFDQFYNCYCSPLNAHQSLTGMHQEKRISSRRPRGGRGRDAKKQRRLEGTGEKWGQRECVCS

SEQ ID NO: 924891 - protein, 134 aa, Homo sapiens
MEDAGESPSKPVEPKEAEFPISSRHQFFFPKALFWIAGLGQDGSHIELGPRHMTSFNLNCLFKHSSSKSSHVLNFEAPKGWLELQHLNLGGMQFILQHPRWFLHPFSASDVLSPGAAYVACLRAELTASLVLHS

SEQ ID NO: 924892 - protein, 153 aa, Homo sapiens
MVQAKHVQACPAARGLGVSPAECPEELRIPPTALMMTMEGYACCSPVHGAVSKSAIAQIYAMWKLPSKHPLPGRLCCCSHSSNYIQTSDFSRESNMPKWTLNQRAPSRMTLLQKPEPLSTPQSQRALGYEVVAAGWSQAGGPLPPRAIFLPKA

SEQ ID NO: 924893 - protein, 148 aa, Homo sapiens
MIVFSYSFKPCKYALMNRRSGIFNTEIIRKFEVMFDTLLSLCTPKPISHEVTRSYSPNYFLSIIITDLLLPLLGPSASGQYCCRHPSPGLQGHPHHLPYPARFPCSVSPCQQCLPVHSSIEGLCHCASRLRTPLQSTYQSVRKTHSLT

SEQ ID NO: 924894 - protein, 167 aa, Homo sapiens
MSHIEKNGLGPWRTTAIKQSIGSIHQIPDGGKKGKTEAHRGRYHERQFSRTQRGILTNSASFCTKILCSRQHFLHLKRELEEQYKKCDKPHNGYMTIFDQFYNCYCSPLNAHQSLTGMHQEKRISSRRPRGGRGRDAKKQRRLEGTGREVGTAGVFLVFDDTDKFEE

SEQ ID NO: 924895 - protein, 137 aa, Homo sapiens
MEDAGESPSKPPDFRAKVWFNFRDPEVVAVPYQFQTSVFLPKSVVLDCRPRSDLPLKTPVTFVLFGIKLIHTGASLPYCSSLSEICLAASNSVQCSFSDKGRCLTNPEISVRKMLLWHYAPSEPIPRYSAETMAQRH

SEQ ID NO: 924896 - protein, 134 aa, Homo sapiens
MRSGFLGLRCCSVYFTRTLLYHLYEKIFSNIESSGAGRPVAYRREKGPLKFCTVVEKPDAKSVPKTGALKKMAADFTTCFSQIAKPQRVSKILAGLHQTLHFIGAREECALLSNEMWAFSLTSTVILEKHLFPH

SEQ ID NO: 924897 - protein, 166 aa, Homo sapiens
MKRCKSQGEPGRSYRSTRQPTRLEIKTTGCLLLPLLFNMILEVLVCALRQEIARKACIIFKCQNNENAQKSKKDGAYQRDIKDVDQNANLLHKISSQRVLGESGSKAQHCFLLLSRHGPVAFGRASLKVRGGLEHAGRGQAASERKRGGTSDLDATRPGPGGIGYS

SEQ ID NO: 924898 - protein, 148 aa, Homo sapiens
MSSGNYQQSEALSKPTFSEEQASALVESVFGLKVSKVRPLPSYDDQNFHVYVSKTKDGPTEYVLKISNTKASKNPDLIEVQNHIIMFLKAAGFPTASVCHTKGDNTASLVSVGRPIAELPVSPQLLYEIGKLAAKLDKTLQGSLFFIA

SEQ ID NO: 924899 - protein, 139 aa, Homo sapiens
MVSVFFLFLIQELLPDILLYHSFLNAFHKEGLNTSYNPEQLPGSGQRSSKGAVPPCRLHIPEVMAAVITDKDVPMLVGLDRRKWKTSKCSMCTLTFEKSFSGAQPRTKEQQVKNNKKKKKKKVWWIGEQLSQILCTFLI

SEQ ID NO: 924900 - protein, 138 aa, Homo sapiens
MGPCTVERKNAPCSPAAGLTEQAIRTSWDWVTGVPTLGGPASRKKQSILLHTQEPEGRPGEPGLGQSSRLTLRSLPNPHSLGLMGRGRPEAPLGELQFQHSAEFLQKSYNPHIHPPNSWIEETETQKGATTCPVCTAS

SEQ ID NO: 924901 - protein, 383 aa, Homo sapiens
MSNKLPATAYHWQSQEAFQIQQPCTCPRSHPGPGHMLGPLSGHPHPLVASMSVPTSTSCGRGPPLHPALEDWNAKQVPPAFWLRDILCFQAQTYTCCHKPLRLFRGPMGSHTHAGPACWAHLHPGDSSLISPWAKYPKQRPGQGVFIRVPKKHMQKGSACPLWPARARSHPRAPVGVLTVVVLMFTDVAGCLRQHVALAQHLAAPLCLLCQLLHQRVLVPMRVQMRLLHCFNLKICVPTAFSHSDGDTEVQRKSHLSKEPSLATRSLPVLGHPHPYIPWTAAVGCSDPESRFGQWELRCWLRPCQASWRRCQEEPRRVGVALASARPFPGTAGRPGPSHTAGPCMVLQRLLVSGSRLWMRVKHVQVVVGVLKHKRLHPRVCLC

SEQ ID NO: 924902 - protein, 123 aa, Homo sapiens
MTECNLSDKQNLSGRGTLLVLGSEDLLAEVGYERGWGGGKGLGRALLELALFLAGAQAQCEYVSLNGELHACSSLIRLSPIPVPKAEPQEGWTEGPGGNRKQLGFGFQVKLCHDLLCNIRQYN

SEQ ID NO: 924903 - protein, 198 aa, Homo sapiens
MIWFCSLIQGTALKSLFVCGRHQTSIVTGSWTLKAPRRSTVPVAVDDGSWYTLGAAGVFDLVQAPFKDFITLESLTSGRQWPSKLFYPLPDTQFQSYFHIFGYLFSNTPLYSYQLTVLVCFHMADKDIPKPGKKKRFNWTFSSTWLQRPQNHGEYPYCPGKDKNSKFEVQFLLNAYCFHTIIKVEKSEKSGTICINKP

SEQ ID NO: 924904 - protein, 135 aa, Homo sapiens
MPISPPGPLLIQKPLGSTGPGSGQRGAFEDAQSFEDDFEDQQPEARHPCASQTGAQSLWPLLADDCGPQQWFKHRRKHHVDAGGSQRGASQLAVFLPPLREGLLGEDIPVPKEPELGAHLWIFSLPIDELLPLAT

SEQ ID NO: 924905 - protein, 132 aa, Homo sapiens
MGRNQSRKAEISKKQSTSSPPKDRSSSPATEQSWMENDFDELSEVGFRRSVITNFSELKEDVQTHRKEAKNFEKRLEEWLTRINSVQKTLNDQMELKTMAGELREACISFSSQFDQLEERVSVSGDQMNEMK

SEQ ID NO: 924906 - protein, 444 aa, Homo sapiens
MPLFGWKDRNGSSGTSHIPGWELPQFSPLAIEWSRGTGLCENWESKLVQFEPLAVREVLQGIPVGKGDSKEIWHGWCLLTAYKLMCQDRIPILVATIKKLALAQCQAYVLTDQAQSYQAIADKTAVWVAWYKYKNRQGKVDRQKVQMVWRDAVEDFTQQEITDILQTFRQKGGESVITWLVRINEQGANGIRVDSGNVLKFVTLSWVPKIQLALRNWATAPHPTNDEGNVLDEISLWQLAINVARQKYSTEDAWPDGGKPWHTLKEYAMRLKEEAMETAVVLGMADNIEATPLSPTIRNKILKIAPPAYRMVLTSLLFSHTDTPTREVLEQLGQLQDLGDRMPCGEERIKEWGRQTRDQSQVSQKDMFADLLKAGVPREQIDGKEAKELWKLYQQKVRNVRQITTGGPSSLGPGVTPGVPPLSTPVTQPSGGSYQELLDSLAGL

SEQ ID NO: 924907 - protein, 155 aa, Homo sapiens
MRKFSRLEKQRTHVLSCSDLQAVRRFRGVVSEGSFEMGEKVYKRKDMFQGRSMLKKRIQRYFSHLLLKEEKYDSVLRGSPAPQQLGMCWVTSQANLSLSLTQGPQRNYESRRGKEEATESQEQCPATQRGKRIQRFGRTQVLVGIIAIAGFYNTD

SEQ ID NO: 924908 - protein, 149 aa, Homo sapiens
MVMQGSQAWQCNRITGKLQKSAEIWASSKNHWEGQRKELEAKLLGKMPQTTLQAWLDELNSTLLLRHETSVPGACPHFSRCCRQHGAHYATGSSTLQPLPPKPATSATDTSTFSWGQWHPAPSTIPVGQSELSPTTSAAPSARSRMGRM

SEQ ID NO: 924909 - protein, 269 aa, Homo sapiens
MTLVLSIGFYCESNGRRAVNRGYVTSLLGLHQDWHSHDTANAYVQIRRGLLLCLRHIAALRRHGSHWMANLGALDLVMLFQLPFANYAAVAAAAAIATASDSDDNVNEAAAAEGGGGRGREEVGEGEDSYFELLLLIHPLAVLAIYADSPILIISKAFENCLDDKSMEPVISVVLQILRQCYPTSPLPLVTASSAYAFPVPGCITTEPPHDLPEEDFEDDGDDEVDKDSDTEDGKVEVGTPAHASNDVHSHIMHRKILLPVFAQAQCKF

SEQ ID NO: 924910 - protein, 142 aa, Homo sapiens
MGLNGCDQVAAQSEPPGGVGFTPGFLIHHPAVLRKWPLMGTGAEQGQCGSPAVPRALLEGATGVCCPRMSCFLQGNQEVPHPGLQHCGYHHVLVPEGHANPRVTQKLGWAGLCPLWAWSCEPGSADRVRNKHLNFKMLPSFQ

SEQ ID NO: 924911 - protein, 376 aa, Homo sapiens
MESGRVSAFQLLQNTSLPGMAQCRHFISCRTGLFRRWPSVDISARAEQAIRDASPRSCSSSFLPISPVSIEHLPQILKHSHPGARCAGDETYPKSRLGCASVTGPRVCLMHLPLCCVTAQGEPPGARPAPWIRLHILSFSVNSHHARHRTRDFRVDPSDLESLDACIQRTLSALYPPFEATAATVLWQLFSVAERCHGGDGLHCLTSFLLPAKRALQHLQQEACCTCSLLGLTIVRKVSTNTKEFISKGHSAIKLEINNKKPLHLENVFTHLCLMFHYWNTKLVGVIYILLLNVIAKSQRTDVSSYNVEEHEDLYHQNNKKPLEEPTQLHRPSKPPKRYGYGRHLKGPNCGETEARHHLTEEGGKLHASGNSKNDR

SEQ ID NO: 924912 - protein, 182 aa, Homo sapiens
MSSNIPQTAQKALCLCGLGGSSSTGGGNKVHEKPEEVTAGQQKRQQHQASSSFLEVSILELPFCELPTQHPGQDTLTTLGILCQNEVGVHCQKVGILCQNENKEQNGREIAQGQTEKKKHFRKVYVSSLEPKTAWGSRSDCFSMPNLTLMRKICMSDDAPKKLSEGSPEADATMLPGQPAEL

SEQ ID NO: 924913 - protein, 143 aa, Homo sapiens
MLHFPPSSPVVDFFLLAGSISSQPVKAGNGMSLYVSGMKMKAIGLPSECGGHYGAFHPGTERNWDVITRLPGKQLGCDRVATTATRATEGVSASGRNLRLQDKAKSFKMAPSKRFFGLDLGNFEKMCLIGRHVNIPGASNQRP

SEQ ID NO: 924914 - protein, 153 aa, Homo sapiens
MGLGVKAVGRQRVFSTDILGKISHLLPENSREPTRAYNSRCSKKAEILGCTHSPLSTHDLLCAQGAEPANERNRKTHTERMHIFSTHGKIDNGNTVFSNSQCTAPLLQTNSESEVKREGVGRNKAPPSVKLPDDLGATRCRCYQQVAGCMAGL

SEQ ID NO: 924915 - protein, 144 aa, Homo sapiens
MYTIQIMDTRKARLHHCAVYPKLMCSQKISLGKSILSSTSTKKLKRNSQMEMEKPSKDKVENFHKGGVSNNGQLCGTELLPLLQDGSELAPPCEDVLASPSPSAMITYSLSQEQHGKDPHPHDSITSRWVPTMTCGNYGSCNSR

SEQ ID NO: 924916 - protein, 160 aa, Homo sapiens
MQGRQAPTWGVADEGSSLCQERIQGCSNPIETREFPDPTEGCVTGVWLVFSLTADAQIPYGRKSTQTDRCRSPSGRVLQRGLLALLSVDGLSVNQLSGPSNFLKGQRASLQVSRLESEAFAGELPSSTQYFPVSCPYHYGRKSCLSPFFDFPMCWLWAPE

SEQ ID NO: 924917 - protein, 169 aa, Homo sapiens
MQETDGQTLAPGLIRTNLRPVGGGTKGLFLGALTLHTLAQTQREAEPLHVRFTEKHGRARGLGRLLPGSSPHSAVSQPPERPNHNENVAVVGEDKNHQGLSGSYEDVQGLEVEGCELKQHRTGEQKKRPTNLLLLNFMCIGASWKEVNTQRRGGQMGHVVACDDVWVWR

SEQ ID NO: 924918 - protein, 138 aa, Homo sapiens
MECEGRVTANGHWVHFWGYGQIIRKALLFGSLNFSPTQPCLTVTVTTPHGLQQCIRLLGLPWQCTTDRGLQQQKFIPSQFRRLEAPDQGASRMGQMGKTCEMVKTEEGRVRRVAGKPRGTETDWQYRCSSEINPQAVD

SEQ ID NO: 924919 - protein, 148 aa, Homo sapiens
MSHTRWVCATAKIPGRTNTLGKPHQGILSYENQRKAKRKVLKDATGKKNHLHIEEQELELQQMYHQKPSKQEESGVKLDIEGIKRPIYNYIQRNGSSEVKEKQAFLIQNLREFITSRPPLVWSQVVFKLLETLGLKVFFVEGSVNGLR

SEQ ID NO: 924920 - protein, 136 aa, Homo sapiens
MWVFTTVVEEAQLRGEGPLMVTAHVVMLVVVLAAGDWLWVHGKLQCGEGACRIVCGHKGCPDGALHWMGIVYQGAGGMMRVRRVSKAALPVQLGEPHSKPRRERSHRATARMFRIQVHPMPTESLGMKGSVDSQPS

SEQ ID NO: 924921 - protein, 180 aa, Homo sapiens
MSGLLDMEIFGGCYSAKHKCLLGINREKSRKEAVPMSLGSSWICNPDLRGRPHSEGSGGGEDSLFPAHFTSKQTRLLGETSWTSARDTGLCEKRAPLAEISDNTVPDSEEWGMMSCLLLLSMMLDEEKNSLRKCESPLWASGCPGPLYLPASCVISIITRLELQSQDLSVCVLEGIPGMI

SEQ ID NO: 924922 - protein, 136 aa, Homo sapiens
MWLLSRVVYTFLTAFIPKNISWRQSFLGDRSRSGCNRCDKLPSYNLMGFVVLWTNERHQAAENRFQLEWCMDVSPVCISHQVNSHDSCNGCGRRSKNAINVPSVDQGREAVTQVDFNLFSFVPSQTALHKLAAVAV

SEQ ID NO: 924923 - protein, 145 aa, Homo sapiens
MPWVVLFSWCGLYGIPLTDRTFVQSPRSSTPFREDSNLNLLPSSRHTKRCASKIVCTNNVIYAEHLLSSGNLEERYLLVRGCFCDHTPIKTLDADSIMGSPGRDIAHSTVLSVAGERNMLSCVPSQEGMGIRKPGIDFSACVFPL

SEQ ID NO: 924924 - protein, 141 aa, Homo sapiens
MQISPTKDSFAGFLNSHLKIHQIQNENFWCSSRAINTMKTQLQGPSPNYYDGLSAGSLRRGNPVVKNNVEKLIISGSICHSLENIHQARQVSPPPDPCICISHHYLGVLETMTYQWNSGLLDTINLLLEGGTRQKPEVTSV

SEQ ID NO: 924925 - protein, 256 aa, Homo sapiens
MGLPRQLGSVSLQLLSREDLGRSQSESLMPEFQGLWEWLPAQTLTLDTPPPVQTWCQLPMNDDIFTLAVTMPPRDDMEIWNHTFYNKLHMAPEEHPMLLTEALLNPKANCEKMTQIIAILCLDLAGWDLTDYFTKILTERGYSFTTTAQQEIMRDIKKKLRYIALDFKARSSPSATSSSTALASPPAFLPGHGTRDIHETTFNSIMKCDVDIHKGLYANAVLSSGTTMYPGIAQQDAKGDHCPGSQHDEDQDYCSC

SEQ ID NO: 924926 - protein, 157 aa, Homo sapiens
MWGAGCVFRPVAFLCASMFQDSKAEENGSDSFMHSMDPQLERQMETTQNLVDSYAAIVNKTVWDLMVGVTPKTIMHCPYLSEKRAVGRQIFESKRCRSRVCKAILRAPSPAHCPSTGIRPAHASGPNLLPSLPPLRPRSSYYQSCCPTCTCMGTRTR

SEQ ID NO: 924927 - protein, 309 aa, Homo sapiens
MAHQKRQSAGSSMLDHRARPGPVPHHQEPESEDVELPLEDYVPEGLELVTLRPESPTPKKQECHNHSPDGDSSSDYVNDTSEEDDYDEGLPEEEEGIPYYIRYCPEDQSYLEGMDCNGQVYLAHGAHPMDTDGCQDAVDWTAWAGLHPHGHGAKGSQDYPDGQLPITEDVSSVLEAHDQEEDGHYCPSKEGYQDYYPVEANGNTSASAYPLRCGDGDLEDQEEDIDQIVAEIKISLSMTSITSTSEAIPEHGPEPGPADSAEGCPPIKASCSPSRQEARPKSLNLLPEAKHPGDPQRGFKSKTRPQKRG

SEQ ID NO: 924928 - protein, 133 aa, Homo sapiens
MARVRSFILEVSETKNTPIPDTMVQRIQMKRCIGQAVQKVSEPSPLGFSRKLYYVRMGDEIIGHCGDGGNLDYRGAGGDNDKWSLPDHSRYDLDLEPTELSDGFTAQWSTFPTTVEVYLAVIISSNTTFLAVC

SEQ ID NO: 924929 - protein, 161 aa, Homo sapiens
MSSGIIFSTMTSPVLKACSETLSCPVAWLETGSTKRIRDCKVSRVVSRRQVVIMELHQDQAGVQKHPSTDLVMIDSASRQALAPSARQDPKCWAKPGGPPPPEHQSCLQVQFFSGEEPWAPPGGHEAQQALCWAEHRCPSPPTEKEGFQGVMTSTPTPALQ

SEQ ID NO: 924930 - protein, 137 aa, Homo sapiens
MGDHTHVPSALRAIPPFNKIILCPPHPSVVSVTSFFLNAGKNSGPTERERRYQLKCGVHTGTQVRLQKSLADKNSDCLGRLALPIPSSQLRETTGCGLGFPALHCHLQAFSRQHAEKLNPLQLLHLDQKWKPIIHLM

SEQ ID NO: 924931 - protein, 146 aa, Homo sapiens
MGPWVDVSVVPMTTLRFDDLLEGLTGLRRVIVCDCERTQIKISKEKRHTGKVAVSETVNPPGGTDSELDVTDTSTVVRWDGVVKNQDFHHCPRVIITEHLLLHGATGCHVGSSKGTLGSSQGAISSLLYPTISNKDGVLPSKTNEG

SEQ ID NO: 924932 - protein, 154 aa, Homo sapiens
MVRTQAKVASSSHQPLWVTGFEEARISETGKEYYRGALLCPYKLMCCKLVTSEDAGEGCLRLLQPPPLPLDTSSLVHPAQRAAQMHLLLDVRGFHVQISYGTFGRMLHATSSVHLWGFIMQQLTSDSEEALNPTVACVSFSWMCPQPRQSKPLN

SEQ ID NO: 924933 - protein, 150 aa, Homo sapiens
MDSLRRPSFKEKTGWLKQQNLFLAVQESGIPRSRCQQIRCLGMRKSFMEEVCLVQDSKTEKGSGSLKREGRKSQKKSVSMKTQMREGPGSWEDIKGPPTQICQLEKCFLGTAKLTLKDVRKQVEFIAIGLGMRGKKQLKPGAKGPAFAMG

SEQ ID NO: 924934 - protein, 222 aa, Homo sapiens
MQSSGTEHSDRDCHQLRATSSGSSGQPWAPRARKLQQSISGFDSGVVPVAMVCPAEVLHGKLLPAVDQVSPSSSGTLDCELTQFLVLDDTKHLHSKSADNTTGTTQAADVAVNQLLVMATVRAGHSLHTISASGNAESHRQLWQILLEMPKLPEPGVNHYSRKEKEKNCLFLLPSNLPSMIPKAKLTVPAIDKVQIDGENLSEHVLFSQFNIPRDDYQLQWS

SEQ ID NO: 924935 - protein, 140 aa, Homo sapiens
MSSGEFHAHPGSHSSASPAPHCRSGSSAALWMGTRGQQACSCTAWRNAILRLRAKVLESLAAQTRPGADQALQKGLANTQVRWRGSQAVTLTVKLHGFILEGRETESPLEGTNSGPNVMYLLAHALVSCVPNCITNQKNA

SEQ ID NO: 924936 - protein, 147 aa, Homo sapiens
MCRHGNKAGGRRTSHVCVNIRASDLHTTEYQLWKIPINCHLFQRYTLGYVKHSNSWGSKELLPVCYVGELVPMVGLWELKGSSQYVYPCAVTGYKSQPGASIATTNSVTFENTFSPLVAYFLPHKAVNESIIILISMHTHQLGTDRS

SEQ ID NO: 924937 - protein, 146 aa, Homo sapiens
MSPVGWRAKWPLVENHWGKLNLQFGQGLVGTAVSLPLDINWGSLRPRGWNHEKAPSLPCLVADAGWTLAGAVSWTTSMCPLYMALYFLTIDGWTPKGNIQNLDLPFSSLSWLFCLCPPGTSAVTAGTSTKDTPPPPALIHKEHNLV

SEQ ID NO: 924938 - protein, 151 aa, Homo sapiens
MIASVLFHWSMYLFWYQYHAVFVTTTYVYGHTTVNMPDLIFDHIFNSEQMEVCGPEEVDTPELGVRLRSGVSYLKPSCLNQPNSTVPSYYNAGPGIGGHVELEVILEDSCRAELSVLLSKAQSSLFTCATSYSCCLCKNSAPRISSIGQFL

SEQ ID NO: 924939 - protein, 154 aa, Homo sapiens
MLGPSGSRLSLPELVGEFLEAGAAEISVVSLTQYTSLLVLGSPGSPEKEGPPPTQNTCFARFGPDLFLKWVPRQFLLTGWGLPAGGLQSLRPGLHGQNLPWEAAPGGGMAAISVVQLTRLFQPSGSGESGLSRQGRVPPNAAHMFYQKTARQLL

SEQ ID NO: 924940 - protein, 261 aa, Homo sapiens
MLFSGEHDYKAWDLRKSELYKPERTYHPPTVKFGNSTTFQDDFVPQEIKPRQSFKPFSVVKRSTAPFNGITSNRLDYIPHQLELKFERPKEVYKPTDQRFEDFTTHRVTQNARFEGSTEFRESFQPWEIPRPEVKKVPEYVPPTGSMLLNSTSHLDYVPYQANRVVPIRPVSRRRSNSFPFQGKSTMKDFPAWESCRQGLIKKQQQIPNPSGKFDEEEPAPAGGIITWFTSSGVKISDKVKNDARHQSHCIKAHPDNLTLT

SEQ ID NO: 924941 - protein, 379 aa, Homo sapiens
MILTRRVLQQGGPVTGVPQEIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKDR

SEQ ID NO: 924942 - protein, 152 aa, Homo sapiens
MRFARGDEMIWWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKLLNISTRSGWNYYGARW

SEQ ID NO: 924943 - protein, 131 aa, Homo sapiens
MDRLPPQEHSSSPATEQSWMENDFDELREEGFRQSNYSELKEEVRTHGKEVKNLENKLDEWLTRITNAEKSLKNLMELKTKARERDECTSLSSQFDQLEERKLYKPEESGGQYSKFLKKRIFNLEFHIQPN

SEQ ID NO: 924944 - protein, 171 aa, Homo sapiens
MRDSEKQRKTEERGQRTPVKQINGAPLIQVSTLQGKVQETVSQPHPGPWESDKSPLAYATDKDSEPLVESRTCHTGQPAETIQAKKRDCAMEQTQKRQLRFLFNRMNIHGGSPKGKKVFWEQHDIAKMQSLIFALTKVQWKTTFIHNGLSFPLLSHSANLQGIVRITFPIS

SEQ ID NO: 924945 - protein, 134 aa, Homo sapiens
MVLGIISRSFRNAEPSLPRVDITTKQFQSWICALVQKGSQATMPSTLVTVSVGGEKPTEQVDPENPLITWNEMDRRKDHGCSPGEETHEEDIRVLPSDLNPATEDPEGGFSLGPVWKAVLRAGPKLGSTFAYAR

SEQ ID NO: 924946 - protein, 151 aa, Homo sapiens
MLLHQGPRERKDAGGSSPPWRVARGVGWLWHQEDSVFTYTPCLMSLLSKPVIPNARTSRSISCLRLWFSVKTEPSHLRGRKQQQHPCPQQCPAVGDGALCAPKSEVVPAWPPPAGTGMDQSHHVWEVGVSSLDSLQHVWEEETFTVTFLQT

SEQ ID NO: 924947 - protein, 147 aa, Homo sapiens
MYAILLGAELEEKTHDCEYSSAWPPGARRLQAQRPCHGPVLLNMGCKEVERAGRGKRKKEEQMEPAAAMFCIHSYTAAHPHLSNTYPPVLFRQGNRYLGGVTYQDPLHREQHWAQCRQVYFHAPSMIFHLQGERGWSLLKFVMKWTV

SEQ ID NO: 924948 - protein, 142 aa, Homo sapiens
MVAAVAAVMVVNRHASCNDMQREQWRAQRNMEGQPLQSCPLLGMMLLKHEGLLPMAPEPWAHGRSRWQLERRPPPRIRGPQWKEATSFLPCRPEGVDLQVEAPQAQRPGNGARCSAENCSPWEDCAGVHQVESCPCEEAGPL

SEQ ID NO: 924949 - protein, 150 aa, Homo sapiens
MGSLFLLPNDGNGLLLLELSICPLWIKTHHIHFLSASMGWKSGVGLCSWWGWLAEHHASALGCRDGSSHCGPVAPEDSFTLKDSLHCPHWGQLWLNPPKSVQVKALEDEEANVDNVISNVPTTSNIQCDVRTWHMFNGYIPLKVTEGNKS

SEQ ID NO: 924950 - protein, 149 aa, Homo sapiens
MKSLVWVVRECIFERETFELIPAYCDTAPVKCMGIKLFKKREQQQVFEPFARYQEEEESWCWCCYPNNFRCERKEVIDFRITPSRTEILLKITGRLHDHLLFRVFEGLKASVTVYRFDLQMKFSSLLGSYDYLIYLTWKLTLDRGVYFI

SEQ ID NO: 924951 - protein, 151 aa, Homo sapiens
MQQESSGWHLMGARLGRSFQRKANRVWRGPPADLHRRGLTVRRKTNKQKGMASTSTKKDIHAKTPSEEHWRQRPKVAREQNWMENEFDKLTEVGFRRWIITNSSKLKEHVLTQCKEAKNLEKRLEELLARITSLEKNINDLMELKNSMRTS

SEQ ID NO: 924952 - protein, 192 aa, Homo sapiens
MVSLPSLPLGRRGTGASPCGHHHHRPTRSTARLLRVFSYGTRALQSSCGENYLAWGSSFRAEVEYPQPQPFKLKGSSLHFLVDKGANRIGYSYPGLGAIKEKKYQPPRHRNGGADSHAETVSIAQCVQHQQQCPVQSHCDITVAMTSCPAFLRVCPYSEFSSLTFIPSVSYLINHHYHHHHHHHHHQQNLSA

SEQ ID NO: 924953 - protein, 159 aa, Homo sapiens
MGSGKVKESLEGKEIGCSHWVFLKDNFAGYRILGGHFCFLHNLIITSLSFTSIVSDEKFAIVFIFVLLTFSFFFPDSFLPQPPDFIDDLQQFDYDVSSCDFLHNSSAWDLLRFWELRVYHFHQIWLFSKFIFLFILPLILDSYYMVVTAAFNGIIYLHY

SEQ ID NO: 924954 - protein, 140 aa, Homo sapiens
MPKTHLPAVYTGVWLLGPVWSVSPSPRRRLWHASPPPAHAFCVCLPSIPQDRNAKGWARQIIWSPDNGCTHGEKPRRVHGTFHYRGRQRKPKGVREGRSLNGNAKKRHKERHITKERPKENGSMTTVHLKNEGVPSTKEQ

SEQ ID NO: 924955 - protein, 179 aa, Homo sapiens
MPFSLELSFSSCEWLAQPLSPAMGTQGETYMRANTGEQVKTDTIREMTKLAYDKNSQELSSLPLLLPPVWALHSNLKEKEKYYTARLIKKQKIQINTIRNDKGDTTTDPKEIQKPLRDYCEQLYAHKLENLKEMDKFLQTYSLPRLNHKEIESSNRPIMSSKTEPVIKSLPTSGSGLQS

SEQ ID NO: 924956 - protein, 143 aa, Homo sapiens
MGSNVETGQIRSGLTITSGFGYKEVIGVDSKGTRGSKLEIDLRCRIWVSLLVIQGPRAFHLAGDECCQDWVLSFKSLLQQYEIKTRWFKLKQYTSRTDCVWQWRCCKRQAKSEVGGGNRNILSIFRKHTSQSVTIRTIKQPCH

SEQ ID NO: 924957 - protein, 145 aa, Homo sapiens
MAVLWSRKGGKVGKGLRNRMVAMSVRRERACGDQPGESSPTQDQGAGSKPRTGKAARRVKEGKEERLAQSQRVRELIVYKIRCLKGSHIGLQPHRESGDYWSFSMCPCEDHSIAIPPQASSAVCASDLCAHLFPMIPTGPQGGAV

SEQ ID NO: 924958 - protein, 282 aa, Homo sapiens
MPIVLVDWSDIQQCSKKAHDQFLADLASILPSNTTPLIVSDAGFKVPWYKSVEKLGWYWLSRVRGKVQYADLGAENWKPISNLHDMSSSHSKTLGYKRLTKSNPISCQILLYKSRSKGRKNQRSTRTHCHHPSPKIYSASAKEPWVLATNLPVEIRTPKQLVNIYSKRMQIEETFRDLKSPAYGLGLRHSRTSSSERFDIMLLIALMLQLTCWLAGVHAQKQGWDKHFQANTVRNRNVLSTVRLGMEVLRHSGYTITREDLLVAATLLAQNLFTHGYALGKL

SEQ ID NO: 924959 - protein, 191 aa, Homo sapiens
MSRRTAAEWKTDTGKTSRKHKGKRVEGFLTDARVRKWIQVMREAAEISRIIWVSSSHCRPRIRDPDGGRAQQVAGKVKSISVPLEAVVLVQELQKQDCKEPKQHTAHTHFQRSSPGKCHSLQSPGPRIELNLRPRRSKQFRLKNLFSKASLLRVRATGPQYGHHWMPVGSAGSQPRPRPSESASGFYKTHR

SEQ ID NO: 924960 - protein, 162 aa, Homo sapiens
MHRYTNKYISSLFPISTQLSAYWTHCAHCTYFKKRIIETQKYGNCCFLKLACGPVISSYFDGYTYSRSLWAHLDPEYLQKGQIGSQLHAGFFTTQSFRKPGSCLDISPLSETTHTCYISHLGIQTDTERRKYLESNSIANCEKLVVAFCVKIMCLCKPWVLW

SEQ ID NO: 924961 - protein, 154 aa, Homo sapiens
MHLPYNTPEPNTQILCLLGSLTGAVRCGPNSQKPLPLRPKSIKENLYSKKGNEAGGLKWTVSEGKAAPAHESSREGAVSCKATGVELPKTMGAHPLHRPDLDVRHGVKGDYFGALRLNDCPVGFWACTEPVAPLFWPISPFWNKSIYSMPVPPL

SEQ ID NO: 924962 - protein, 135 aa, Homo sapiens
MEHGARPAEMILSTGFAMKLTQKPTVISQMLSLICVLADPLAQLVGNLLALPSFDVESHQDGNISSLPSCTCSFSNVPTLADLGGLIWNVNFREPSAQQQACSVLSAPYFCITAPNCLKYPQWRFVLRSEDWSAV

SEQ ID NO: 924963 - protein, 136 aa, Homo sapiens
MEQSWMENDFDELKEDVQTHHKEAKNLEKRLDEWLTRINSIENTLKDLMELKTRARELRDACRSFSSQFDQVEERVSVIEDQMNEMKKEEKFREKRVKRNEQSLQEIWDYVKRPNLHLIGVPESDGENGIKLENTL

SEQ ID NO: 924964 - protein, 151 aa, Homo sapiens
MCSHRVTLTTSHSISPPPSLSYHHLSPGLQQLPTCSTQIHSLPCSKTCSHASSPPPPYPTTTIVTGPLLMVYCMPRDSPPPIHTHTQPSSYLLLILQTYITFPDPGHVPSLETCLQSCSGHVYLRFVITLLHSLNSSLLSTYFVPGTVLGN

SEQ ID NO: 924965 - protein, 144 aa, Homo sapiens
MHSGLVDTLRTTPWDAIQSQKGGKKSLCLETLLRCKIWVAEAFSPSEECLWKEDVFWLTGLITPSVSERTCPSTFDDLLSIDSGHRELLLLLQQPPVQLEPDIPSSAVLPFSCPHSQASVSTALVHAHKTQEIKKKNDKSSYLC

SEQ ID NO: 924966 - protein, 150 aa, Homo sapiens
MSLGALVNWNWGLGAAGLVELPLLGHLNPQQADDRLQEKLHSDSKGPSPAPFHDALNDPASKALRKYPEEGPPFGIYTSSPDSCFVFISTVGPFQFGAFIHYISKYLLKDQARDENLEVSFSSPAHAPGSDSILPLALSRCLCLEKASSP

SEQ ID NO: 924967 - protein, 176 aa, Homo sapiens
MFTGYNSVPEAAAEQLLQALPLRKQAGLSGPTLPCLLQLLCLYLLPILSWAESPPTPEFCPGKTVFGSPVRMCVWRQTFPPHAVGPQFFVCLVELAGASHFFQRVCGFFWFSWYVPVVVLGAEVHDMSLHTLFHLSEWELQVSSCLLVTIFLGNPQLSCMCISQGIGQHGPHIQKG

SEQ ID NO: 924968 - protein, 182 aa, Homo sapiens
MHHILPLHYVHHTLVLPTLTSLSLVFLITTQDKTPVTAPSAFHCSVDSELLLRAGSTANAALLSKSYLDVASPRKPSPASPEQTQASFCSTSTLQPSFANYRMISHLGASTPALSRAFAQIARHNAVGTEEKKPEGVWEQASVDSTSATSSSYSLNSRSSALYPYSSSRTVGLQRIVDLVIT

SEQ ID NO: 924969 - protein, 143 aa, Homo sapiens
MESSWEDLPLALATGVYSGTGCGRQGQGSLQVTGEMLRGWVEVACGSSAFILAVAAVGSGSSMVELLLPLGIPVFNWGFCQKSQNALNLLFPHETHSFGSSQILQILAVLSYSPVLSQHHMAFDKVRPQLQPKQLNIIESPAH

SEQ ID NO: 924970 - protein, 139 aa, Homo sapiens
MGCQENVAVTARTASPKEASSFIKGTQATLGREKSLHCADESSGLQQCSRNESKGTVHELEKSRTVELSTAKQLGSVLDVHAELETGLRENSCGDKEVAILAFSQQQFTDGPERAFMSTPIADTFQLFSAELPLFPTLG

SEQ ID NO: 924971 - protein, 149 aa, Homo sapiens
MVWYCVLLNMLAQNVPTHIHLSYKSSPHRLQLVSPSNAALRRAGVCINISLRICQFQLHRIVCLQGPCQHCLDLKIKSKEGTSMQLIHKAGLNFRQSSYPVLLAELKLPSKICVKVLTFSTPECDCVFVETGPLKRYLRLNEMTGVTAN

SEQ ID NO: 924972 - protein, 129 aa, Homo sapiens
MAPLCGQMDTARNGCVRLMTPIELRVGYSWEKELCFSLCEQFFPPREKQEELARKHARFVLSLNQTMEKKATTTVYINETYTKINLKREDIALQKKCIQEAEELMEKERAEYLIRKQELTAQLMIKRKN

SEQ ID NO: 924973 - protein, 152 aa, Homo sapiens
MADNVNVECILALDLVVATTEPWIVCRRLNVLCTFTPHSSFYPINDSGINPENYVGNPEGANAAPCKTRPTAEESEKSTQFLTTSTHLDCKVSKAVCCPPGVYSTLSTAVMKDNEQKIQEGESAVRIQVRECLFLLVGQGRISQRNWCFMDG

SEQ ID NO: 924974 - protein, 136 aa, Homo sapiens
MRILRISYLSIGIFKGQLQDHSDLKSAQYCLLPKARSYHHLATTNVHSRTNGSTISRWQIQPGLCPSLQGSEFPQPWEGPEMSSESQGLELGSLGIYPVLYSTAYKMAPKLQEKALSTLPSPFLNQRLGVISKKNA

SEQ ID NO: 924975 - protein, 177 aa, Homo sapiens
MPKYRNIHSVPENYSCGLNLGSSVEVVADEHMVGQEGSDTSKLEMFFLGYPRIVGLSLFPNLTSLTIVAQDIKEISGLEPCLQLKELWIAECCIEDLNVKPNIKTLEHHLGNIILDIRTGKDFMTKTPKAIATKAKMDKWDLIKLKSFCRAKETINRVNRQSTEWEKIFANYALTKV

SEQ ID NO: 924976 - protein, 141 aa, Homo sapiens
MPRNWKTTELFLAAAATSSFQELPGQSCQRGVWCPVSNNQAQCQQWQALIRPQWQWQRKDLEVQVVFGYMDELYRGEVWAFSSSHETTVKVLAMACSHLKARLGMGPFPSSFRWLLAGFRFSHVVAPRASVPHWLLARSNP

SEQ ID NO: 924977 - protein, 137 aa, Homo sapiens
MDNEAQAEEASDADEELIGNYSKDHFCYALAKNLEALCPWPKDLWNFGLVSRDLGYLAKEMSNQQSIQDVALLLLTAYAVICPWLKGAQVQLRPLLQRVQAISLGGFHMVLTLQVHRMQELRLESLHLDFRGCMGKP

SEQ ID NO: 924978 - protein, 190 aa, Homo sapiens
MHPFLPFSVAAHLENCSFPIQCVLVEAVKQYLPLPQPTARDEADLIVVDKLFDMLLDLSGPSAADLLEVSGGPLQTLFAWVSPAEAAEQQILLPDPSSGSFVPEGHPPVCGVCRPLLRGVSQSGYMGVRDPLKEAVCPFLELERRAERTTALFSTVRQGCLSLQKLSGAVRRSCLLPFVLLCPAPRGGIY

SEQ ID NO: 924979 - protein, 139 aa, Homo sapiens
MTPPLGPETDPQSIASKKSVPSVIQSQGNEVYQQLEELGNGFFPKNAAIMTQLFLEKHHQEPHAFPAWFLLPDLLSTYASHRKSVTVNMMKSVTGNMMKKRSSLPHCESFTNKRPSISVWFLPWVIEQKEVFLKACTGP

SEQ ID NO: 924980 - protein, 172 aa, Homo sapiens
MGNTLGVFQHVCFSLLPARNMKNLLGFLLSAVKDKKQEKENWRAQKKAGRCGKVWNFLETCEWLDQSADSDMDNKVQTEVVSDVNEELVGNWSKGHSCNAKRLVAFCPCSRDLWNFELERDDLRYLAEEISKWQRVQEEAEHKSLENLQPDDVIKKKNPFLERNLSWLQKFA

SEQ ID NO: 924981 - protein, 124 aa, Homo sapiens
MDQSAHSDVKPICPGGGGRREREKKQLAHSGSINHWKGEPLPGEVGDSTWKLPDGALSRGVVNHQGSANGSPAHWPIEKGLVVLLAADAVHCPRKPGTGQGCVASCVHPCPFDESQVDKLPIGP

SEQ ID NO: 924982 - protein, 170 aa, Homo sapiens
MRQALTPAPILLAFKALTQVTSLLVVVVMLLVVVGVGGGSGEGSDDSGGSGGGGGGSGDSGSSGGGGGGDIEHTVEACKPRKAGPRLSGSSGSGSGSGSGSGTGIERRSAPSEENTGCGGDSQSSQRPSAPARPGQRPRSLQGEARRCLGIPAGSPACRSPSPDLTEISH

SEQ ID NO: 924983 - protein, 134 aa, Homo sapiens
MIMRQALTPAPILLAFKALTQVTSQKLCFLIWGGGSGGNGSNGSTGDSRNGSDDGGSGGGNNGNNNGSDVAGVGGSGVFVGSAGCGGDVIGSGEHLIASLLFFLLLHPHFLLLFVILLFFLLLPCLQINLSRES

SEQ ID NO: 924984 - protein, 166 aa, Homo sapiens
MKKIIINKKSDSVACGQDLGEYNSAQKRENLTSLSLKKVEKFSPSSFRESQGDSTLMSGINALIKETPGEILHPFYHVKTQQEGIIYKPESRPSPDTKFAFILDIPISRTELLKTHVSVKSLVRGCFLACRWPPSYYVVTWTSLSGHGGERESKLLVSLLIRTLIL

SEQ ID NO: 924985 - protein, 161 aa, Homo sapiens
MRSSKLCFNKLHWRVPYSLKFGNHDPEPGGLLPSALHFSGKFKRTQEPLQKHTPRPYKEVLQLHHCEMTLDDYISKLMEYPVFESHFRIIENKAHGDMEVSLPMPVFPDDLYCCLQEKVDYQMPVTVAPESTKPLSYSRTSGVFWQLPLPFKSPGGQDMPS

SEQ ID NO: 924986 - protein, 155 aa, Homo sapiens
MVRTRMQVRPNTPGPHQTYAAALILDFPASRTVKNVCHSQVTQSKVFCYSSPNGLRKIPDTTQGVAANKDQSHLQEYDEAWQMSTHVCAPLQLFLHQTFWAPSCSGPGISSGAQQAHAEIPASSQDLSPPPVHSQYLLSKISLKCAGLLDVDIIA

SEQ ID NO: 924987 - protein, 170 aa, Homo sapiens
MPVKLEFQRVQSLKPWHLPRGVEPLGAQKSRIEVWELPPRFQKMYGKAWRPKQKFTAGAGPTWRTSASAVWKGNVGSKPPHRVPTGAPPSGVVRRRPPSSRSQNGRSTDSLHCAPGKARDTQQQPMKAARSRTIPCKATGEELPKAVGTHLLHQYDLDVRHGVKDIILEL

SEQ ID NO: 924988 - protein, 136 aa, Homo sapiens
MWVFMGSSITPHPSDMHSSLYHCELLISSTLHGYHIWRLLLGSDLASGNGKDDAAEGGSSGGWKSKIKVSEGLVSSEASLVGLRMANVHVCISPWCLFLIYEDTSHAGVDPLHLMTAFSFNYLLERPISKYSHILR

SEQ ID NO: 924989 - protein, 205 aa, Homo sapiens
MPMICLVFLVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRDFEEKTIALKTLHATFESEQSVDITLITSIDHQDCKFTPTYWPCWQ

SEQ ID NO: 924990 - protein, 167 aa, Homo sapiens
MEMEMEIWRWRYGNGGADGDGYRDGDGNGDGDADGDGDADADGDGDGDADRDGDGDADGDADADANAEGDGDGDDADGDGDGDGDADGDADGVTDGDGDADRDADADGDADGDGDADADADGDGDGEQIEMEMEMEMDVQMEMDTGTGMEMKMEMEMRRHPAILNLL

SEQ ID NO: 924991 - protein, 153 aa, Homo sapiens
MRWWGKVSCIPFLPDRLTPSHLSRAQNWRKERGWIGYQFAENRTLFDVEQKTKKESSFLLGNAQIVDWPVVYSNDGFCKLSGYHRADVMQKSSTCSFMYGELTDKKTIEKVRQTFDNYESNCFEVLLYKKNSSFWLTSNSERIIFTVCKPFKV

SEQ ID NO: 924992 - protein, 147 aa, Homo sapiens
MEHAGDLGLFLCFRIFTKVPHGPGILSPESMVLTTTFLCLLIGGGTDGINKKPGMRSHADVNLEINILIVGVTGVEDATGEKENTQREWASQAEGGVSQTRTVDSVKASRSLKVSAKQKPMIDITRIKSNGFKHTMGEKSCNHKGRQ

SEQ ID NO: 924993 - protein, 153 aa, Homo sapiens
MLICRSQGITSRHHKLHWELSRHPLATSQGYCSYSSPHYLQVKNHPAQNVKLLLLFFSSNAHGNSRKPPTLILCSESHILTTFDWTRNFELTLTDPRLCSGCSIKWRQCKNESLTCHFAQPSLPLRKSERRMTEAQSQQGQRQKGLSAFPSYG

SEQ ID NO: 924994 - protein, 141 aa, Homo sapiens
MLSIGAIGEVTNLVTSGHVTPEQQGVGNYAYILAEFKHSRVQAPPMILFLWPFISLTKKGPPGRGAPPPPGRGGGRAEAGPPPPSRTGRLAGRGLTPTSLPDGAAGRAGADPPPPSRTERLAGRGLTPHLPPGRGGWPGGG

SEQ ID NO: 924995 - protein, 347 aa, Homo sapiens [sequence omitted]

SEQ ID NO: 924996 - protein, 140 aa, Homo sapiens
MGSGESEVLVLVPVLPYISSVTLGKSFIWQTFIEGFIHENHGNESKVPLKLTYEKEEVPGVPPQMIDGASSCTPKSPTVYRIQGEKRTWIPAPFLSFTCQHQLAFVINLRFPNHVDFNKPPDPTCDGSKNSSQFLPRHPG

SEQ ID NO: 924997 - protein, 141 aa, Homo sapiens
MGPTEEEEKSNMVVEMMAPAAHLEPLLQRLWLQGARCVCAWDSTVTPAFCHLSPLWTLGADEHGREAEVEPKIAQCRPAGTPQHKHPRYCGRHVDGGRRKSCSWTEKGRSLVKPLPSSQGWPEAWGPGCQFWGESVAQSEN

SEQ ID NO: 924998 - protein, 158 aa, Homo sapiens
MPGNSPHYGRWPQHDFTSLKKLRPQSVTSRIQPGSDVIVCAEMDEQWGYVGAKSRQRWLFYAYDSLRKTVVAHVFGERTMATLGRLMSLLSPFDVVIWMTDGWPLYESRLKGKLHVISKRYTQRIERHNLNLRQHLARLGRKISAMSTEKNVHSVDLG

SEQ ID NO: 924999 - protein, 153 aa, Homo sapiens
MAPKHLSPLPPQVKKPRPPPALRPEKTLTSAGLLKKGEEEQEAIEHIDKVRNEIDRLNEQAREVIKDDIWPNLLQYYLVSDMDDEEGEGEDDDEDEEGEGEDDDEDEEGEGEDDDEEEEKGLEGIDEEGDEDEGEEEEDDDEGEGEEDEGEDD

SEQ ID NO: 925000 - protein, 170 aa, Homo sapiens
MPRKRFWEDPKDPSVAAMLRLMQEDPNCHKQHLSNTATYLGTDQEAVTDGRRKPEESGTTSHNDIYHNESAPTIKANCPQKPICKQDWTWPEKMNVLVKEDCIAEQAEVLRNDSYGIIIDWPPKGMFSLNCTSQSACHSHTVFSWSEQNGQMVEMARPSPDTENAVLKAT

SEQ ID NO: 925001 - protein, 154 aa, Homo sapiens
MPMDSQYWILPVTFPFYSALPRAGLAAAAVGDGGVVPSPIRVIFPGEYGASAESYKSPGKWRKASSHRPHPTHTQPTVRKSALTTTVLPINSTESISRELHFREPAAVTQFLQRVFGFSRLFWYVPVVVLGAKVHNGDADWCCEKWILRSSNFE

SEQ ID NO: 925002 - protein, 178 aa, Homo sapiens
MFLCCIPTSPGSGFRNGRSSYLTPDASGHLAEAPPPQVPQDRSHQGAIRPQIDTKVPDVQQAPTEPQTHVDIRPQVDTQSPGGQSGPRHTSGLKWTPRPQVDIWLPGDHQAPGRHQAIGEQQDAVDQKATAGYQSLVITRPQWDIDLRQASGPRWTYRPEVEFTLRGTFGPRCASGLR

SEQ ID NO: 925003 - protein, 164 aa, Homo sapiens
MGMPGQGTTALYHPQEGVPCILALLAPALVQRAPDELRPWPQRVQTISLGGFHVVLSLQDSAKWKCGVGGPTRGPDWGGGGCLVELWEGGCCPPDPRMIEPPAAHVFSVEKLWEQSCPRPWEPTLCILGMLYVPRMWDMVSKEIILELRDLMTALLGFELVWGL

SEQ ID NO: 925004 - protein, 149 aa, Homo sapiens
MFPAQASFRGKLPEEWIHPEEQGGRGNEPIARILRLLKTFARILLLKAAPFDSQLLKKLWDIFKAFYIKKRHNILLWVCVQGPGRAQLPRFCAEVTKCQKHPVPMCTSLQQGQSCWRNLRSSLFQPTFLGPQQDDHCWALVCPFQQLMS

SEQ ID NO: 925005 - protein, 176 aa, Homo sapiens
MELAGQASPVIPPGPHLHIVLFQPEPLELIETQAHAAASGAEIQLFPVPAVEPVPAPGADSPPGTALELEEAPEPSFCCPGTAQDQPSEELPDFMAPPVEPRASALELKVWLELEVVERGDQHSSSQKLPHCSQSWAQAAALLLKSLLLLLLGVFACLQEVLESKKRSLFAERGIM

SEQ ID NO: 925006 - protein, 149 aa, Homo sapiens
MEPWNGERRRSSFALVQGIVRPRSCTEAVCSSTAVGKNCTISGKPNPAAVLKRFPVESPQGGLPLILTISAQALFITAFLAPGLAHEKWVRLRAKCVFMVTCFLQASFLCANIFGFLVKVFSSCMRFHFSYQMFVIFYLWFKELPALPR

SEQ ID NO: 925007 - protein, 253 aa, Homo sapiens
MAWGPKEHLKRAAVPKHWMLDKLKGIFAPRPSTGPHKLRECLPLIVFLRNRLKYALTGDDVKEICMQCFIKIDGKVRVAITYPAGFTDVIGIKTVEEAKYNLCKVRKVTMGMKGIQRLVTHDTGTIHYPDPVIKVNNTVQIDLGTGKIINFIKFHTGNACMVIGGASLRHVGVTNREGHPGSLNVGHVRDANGNSFALRLSNIFVTGNGSKPWISLPREKGTRLTIAEKREKRLATKQQNWFQDLLQIPKSKS

SEQ ID NO: 925008 - protein, 394 aa, Homo sapiens
MWLPRVSSTAVTALLLAQTFLLLFLVSRPGPSSPAGGEARVHVLVLSSWRSGSSFVGQLFNQHPDVFYLMEPAWHVWTTLSQGSAATLHMAVRDLVRSVFLCDMDVFDAYLPWRRNLSDLFQWAVSRALCSPPACSAFPRGAISKQDVCKTLCARQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGRGSASQSKPSILRLGMRATSPRPGATRCPSLRSCACRRCAPARCSCWATGLCTLRTSSVTSPWIWCCHEAQTTSAGHRLTENSGP

SEQ ID NO: 925009 - protein, 151 aa, Homo sapiens
MSSKFTSLCALDQSIYPIGSVVPSRGWTWESPRSPDPTPRHSDIIGLRYALGITFILLIIECQFPAQHQSQTDTQLVVEWKDAEQQGVQSQGRCKVVVILKQVSYTKWLFIENDIYAICADLTDCQISEKGLAGTVEDADVEPLNEGVPQP

SEQ ID NO: 925010 - protein, 153 aa, Homo sapiens
MHREGGHVKRKSEIGMATDGTSGIAGHQKLRHEELESGEGTWKGVRVAWLCRTGPVTGQVLKPMWIRLCDPGREHVTQASQSQGPYPLATAMGLVDYGVSRQWGPLELNPTGDSGSHCGAHLRVPQRGEKAGTLPQVPVHSESAHAEEHMYWR

SEQ ID NO: 925011 - protein, 187 aa, Homo sapiens
MEQRFTATHTLTCSLELLKSENETSVHTRSSRSPPEDSVAIKRAGLPQLKSAVLTDTVLLSLCGQICQMPQPSHQSQQLQEQDKQMRLLIRATEKDTVSPLRYLPKVATWVTRFAALRTWCAPSSLENVASPLIGPRLRAPDPHDWTSIHMQTCQWDGPFGSSGCGRLHPRHLLPKLGAPAVTALGT

SEQ ID NO: 925012 - protein, 323 aa, Homo sapiens
MHGAYKQTITEDSCFVSGCSGNSRAREATGADIPGPAGGVGRGAIWKFPDLREHLCNWFRGEVWTMDSLKDQEQTEPFPGQAGPLPPTGILSTPQGPSQPQRVPAVKARRADDGTEALQGQGLHYYYYYLHYYGCCHDCHCYQYSYYYYYDTSTDLEGQHRDDDEQNGHEDAHSQGPDVHMLGGGGIGLGPVQVVNHLPVPRLHGVGKCYEAQAAGVHEEGVKQGPDDMVGHRGLAVDVDHVDFMVSSEDQLWLGCWDGSPLMTIMITTAVPTIIISSIITIINITIITRIITTDIGITTTTTTYHYYCYCRYRYYYRYYYYY

SEQ ID NO: 925013 - protein, 156 aa, Homo sapiens
MSPVITYRPYRDSFLYCLSPAARTRGPPGWGLCLFHSRFPGPRTMPGTAVAQGVIVRGSSPRKRCPDSPLRDKKAIKGKGEGWGEEKGCHGENHGNVRFRLRIAAGYSRVKSRARKESCQETYNHGQRGNKYLLQMAAGETEKARGKLPPLNHQIS

SEQ ID NO: 925014 - protein, 139 aa, Homo sapiens
MKGCVCAQEHLTILSQEPAALFILRLTSRFYFMKAPLKMVSPSQILLGRWESREANGSARLWQGRGPAKGVAPQSQEGNPSSRSPGSTAGNGLVAFVWQVLAPLLCRQERAPYEMSVIIIRTLYSRGNCGPERKNRNGC

SEQ ID NO: 925015 - protein, 274 aa, Homo sapiens
MVRQWTHLLQGKKGKGSFLEEEESGRPHGYNYTEQQRKSIESPTSQTTPQCQAIWDSWSPYEELMSPEQPSSKEGQEQKQWTLEHNSPHTKQTGPRGVCESRLTAAATSPHSRQNSSLPPASPDPGPCCWELQENLSSFSSNSNERKAIKTPGRMGQLRPVSPTLPSGLSAGRSCRCRPWCCPCAACGVPEPTHPCTFEHSPFPERSLNYPNSSVTSGPALPNPLPHPGSKPELQQLLSAAPSRLPAVSVPHRRGFLLLLPNRDPDLSGSASSP

SEQ ID NO: 925016 - protein, 301 aa, Homo sapiens
MVIGELSVLYCPMDHSKLSLTSRKEERRVPCGVSMQVVTVGPVVEWHPVEFLISLGWAPGSGWLRIIRQGSSVTVLRKAGWPGPLAYQDPYPSSPGPAMGHPQKHRWSCNPTWQNEAWEATLTRAQGSVSGWSGPGWVALWGREKEKSRLFGVRESGRESPDWENSPLCGKGERTISEEAFGGQQRSNPRAEEMRGPASSEAFPEETSPTDLQEVELMSWILSPSQDLCFNPFCKVPFVRESFGDGQRSALSSKIYGQVRTEEHVQPSSTYYSFNTHDNPVRQSRCLCPSKLAAESVFFFY

SEQ ID NO: 925017 - protein, 155 aa, Homo sapiens
MPLHSSLDLVTGHTSPQRWLGNESNCSSVCFITNRTVRGVGEWCWQGPGTVSGTVKTRSERMQNMFGSNASRQFRECCSPVATAWHPSHFLQPHPCPVSSSQSGVLLPASPDTLPGTLELAHSFSKDPRVSNTNTGIQHARVCVRLPRQDGASDH

SEQ ID NO: 925018 - protein, 281 aa, Homo sapiens
MTDDESESVLSDSHEGSELELPVIQLCGLVEELSYVNSALKTETEMFEKYYAKLEPRDQRPPRLSEIKISAADYAQFRGRRRSKSRTGMDRGVGLTADQKLELVQKEVADMKDDLRHTRANAERDLQHHEVHLPASAACPAQAPHLYPTERYLEWVHVIVGALEETQAVKREKPVVAQSKSESFKTREANGAAFGPWPKALEPPGSCWYKSEGLKAKNLESDAIIEEAEIRWSEVSREVHEFEKDILKAISKKKGSILATQKVMKYIEDMNRRREMDLGLL

SEQ ID NO: 925019 - protein, 318 aa, Homo sapiens
MCLLPLCGHKYVSGPGWHSGPSPVGLRDMDGPCWLEAAGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEV

SEQ ID NO: 925020 - protein, 162 aa, Homo sapiens
MGNPTEGRELVMCVARAYSNAFPASYWVIWLYSRHIWGQHHSDFSLHVMEPPTARKPVFPHSTQGLIQPCGKAWNGGEMPQPPDLHGNNPGTLRGLGGPKGTQSSVPTAVTLTMPMNWVSTSLPHQLCCWHDLLDILPVPKSLSQAHSSFLPCRFVGAIYVF

SEQ ID NO: 925021 - protein, 395 aa, Homo sapiens
MVVKEVEKMKAVMEVEEVMMVLMEVEEMEVMMVIVQVEEMMVMTEVEKMEEVTVMIDVEEVMMMIEVEEMEEVMVMMEVEEVTMVMTEVEEMEDVMTMVIEVEEVMMVVTEVEEMEEVMMVMMKVEEVMMAMIEVEEMEEAMVMMEVEEGDNGDDRGGGDGGSDGDDGGGRGDDGGDRGGGDGAGDDSDDGSGAGDHGGDRGGGGGDGVDGGGGGGDGGDGGGGGGDGDDGGGGDDDGGGGGDDGGDGGGGGGGGGEGDDGGGEESGGGGGGGGGDDDGDEGGGGGDGGGGGDHGGEEGGDVRGGGDDGGDEGGGGDGDNGGGGDGDGGDGGGGGDGDDEGGGGDDGGDRGGGDGAGDDGDDGGGGGDHGGDRGGGGGDGGDDGGGGGDGGDPVV

SEQ ID NO: 925022 - protein, 129 aa, Homo sapiens
MLAQSRAIPQGSWSVWGIQEVEGMVGNKRADPSLLYLKWQLLPGPAHCHPGGMLGGHPQHGPLSMVSVDLSGILTEWSWKEERLYSFSEIRWYVCEGVAKGEQQLTQWTGRGRPTLNLGGHNLISCQHG

SEQ ID NO: 925023 - protein, 200 aa, Homo sapiens
MPTWNSSWPRSAGCSPGSRSRLSLHTSLQAEGAGSGLGQPRKGLPQCSGGLKGSSSAAKMGAQAEEAPRASEGCEDCQHAVLLSGEPTSRRWLITLPVTSRSNSIGHLKGTPGKSKEEIKATVCAPTLKNGFWIAERVMTVSGHEGAASSRALREELRLLFSSCAHTVKELLCVREKSTELLLERSGVDCSFANIPPLAR

SEQ ID NO: 925024 - protein, 480 aa, Homo sapiens
MSSTVSYWILNSTRNSIATLQGGRRLYSSPEQINEVLRAGETTHKILDLESRVPNSVLRFESNQLAANSPVEDRRGVASCLQTNGLMFGIFDGHGGHACAQAVSERLFYYVAVSLMSHQTLEHMEGAMESMKPLLPILHWLKHPGDSIYKDVTSVHLDHLRVYWQELLDLHMEMGLSIEEALMYSFQRLDSDISLEIQAPLEDEVTRNLSLQVAFSGATACMAHVDGIHLHVANAGDCRAILGVQEDNGMWSCLPLTRDHNAWNQAELSRLKREHPESEDRTIIMEDRLLGVLIPCRAFGDVQLKWSKELQRSILERGFNTEALNIYQFTPPHYYTPPYLTAEPEVTYHRLRPQDKFLVLASDGLWDMLSNEDVVRLVVGHLAEADWHKTDLAQRPANLGLMQSLLLQRKASGLHEADQNAATRLIRHAIGNNEYGEMEAERLAAMLTLPEDLARMYRDDITVTVVYFNSESIGAYYKGG

SEQ ID NO: 925025 - protein, 165 aa, Homo sapiens
MLDIISHQGNANQTNIRHYYFTPTRMARIKDQPTRPQLQHLEGHPRHKGTFWRGRTCSLKASKLGCESCLCSHCVASGTVLPLSDSNFLICKVGSSRNPRGRPRGLRERPGGLLVLAIPNLVTPPRYTPMAALWGPPSGPEEEASLYIQCGPHQTPDFRVHSCLP

SEQ ID NO: 925026 - protein, 421 aa, Homo sapiens
MLSASSPCPCRPGPARPIITVSSLQFRRFQEVTWTHLQNIASNYNVSYNVDVRFRSLAEESQAVAQAVNRSQASVQGELAQLKAWVRKLQRRGRKVDTRLRALDLTLGERSQQRARERKAHKAQRDALQDSLARLEGLVHSQGARLAALEGRLPVAHPGTAALGPALDPATPEYGPHVQSSRLWNWGDPIKRVKETLQGSHRQGQRRVICGVGPTLVFPNASTRNVVFLSPGFVTALRALSFCSWVRTASGRLGTLLSYATEDNDNKLVLHGRDSLLPGSIHFVIGDPAFRELPLQLLLDGQWHHICVIWTSTQGRYWLHVDRRLVATGSRFREGYEIPPGGSLVLGQEQDSVGGGFDSSEAFVGSMSGLAIWDRALVPGEVANLAIGKEFPTGAILTLANAALAGGFVQGANCTCLERCP

SEQ ID NO: 925027 - protein, 137 aa, Homo sapiens
MICLIPPPAFLEMQCWQGGHRRIKIPDSSFTCLEAMGREEPEKLHVDQAGYDRLDPTWCWIPPRFLPGPRYMLINILNHTAVSVSTVPRIPYLVEVVNYQRWDDWLRVSQMKEGNHLPGWYNSRCEDLEAGQNRRLV

SEQ ID NO: 925028 - protein, 155 aa, Homo sapiens
MIKSQSFSEPVSLGFELHKRFSVLSFSLSAPGFREGPLNSHVFWIVAQLLQRGMALNLKNKEKRGEVLVSLKIIRPREISLKSTFKKKQTKLNAFPVIKSVLHNLSIGAEERAGEKGARIFTLHQESCKLRNFCMVERISHFSLLSWVWMACQNC

SEQ ID NO: 925029 - protein, 623 aa, Homo sapiens
MVASQAYNLTSALMRILTRSRVLNEEPLTLAGEEIVAQGKRSDPRSLLAPANLSDVVQLIFLVDSNPFPFGYISNYTVSTKVASMAFQTQAGAQIPIERLASERAITVKVPNNSDWAARGHRSSANSVVVQPQASVGAVVTLDSSNPAAVLHLQLNYTLLDGRYLSEEPEPYLAVYLHSEPRPNEHNCSASRRFRPESLQGADHRPYTFFISPGTRDPVGSYRLNLSSHFRLSALEVSVGLYTSLCQYFSEEDVVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDKGLSPAWFLQHVIIRDLQTAHSTFFLVNDWLSVETEANGGLVEKEVLAASHAALLRFRRLLVAELQCGFFDKHIWLSIWDRPPRSCFTRIQRATCCVLLICLFLGANAVWYGAVGDSAYSTGHVSRLSPLSVDTVAVGLVSSVVVYPVYLAILFLFWMSRSKVAGSPSPTPAGQQVLDIDSCLDSSVLDSSFLTFSGLHAEGVRA

SEQ ID NO: 925030 - protein, 141 aa, Homo sapiens
MVMNLKKPGFVLPGMVAHALSHTLNVLTDFQKDISLEKDSIINPRITCSKQESENSEGKSTIFSWPAEFWCYQQSNQYCSALLEATVKGIQDLTSRQRDIMKLNAKETREKPSHESWDSIKKAEVPLKRFMAAFSVFLKES

SEQ ID NO: 925031 - protein, 151 aa, Homo sapiens
MGNITKSTDLNPEFKKVLFWGSEVVVVQASKGKGVILEEAKDCVILWMWKLLDVFEELKESRCRLNLMMINQGFQRGDLLIEHIIELFRFIRTIISEGGMKESAFEQVAFENHYHGLYCYGRKNVLCETLNFHLKSKLGEVRNGKTGHDTC

SEQ ID NO: 925032 - protein, 156 aa, Homo sapiens
MCLNLGTGTQSYRKEPGIGALFLSLRGCTEARQQRVCKPESMCMALHTQSATLIIPKIVLVILVPRISKKCNGCFGLVLLLDALLQKPEKVITGSMGSIRPQFVDTKGGMQFGGNLRWWMMDGLLMIGAVGYQDHETYKSEVKQTGLVAPLTLWGP

SEQ ID NO: 925033 - protein, 200 aa, Homo sapiens
MTLRTSFVEDNFSTGRGEEQKDGFGMKLLHLRSSGISEILIRSVQTGSFACAVHNRKVTVMVNIECQLDWIEGYEVLFLGVSTPSFSAFGLLDLHQWFARGSRAFGHRLKAALLLRFGDSDWLPRFSACRQSIAGLHFVIVQAMVSLNQIDDRWSNDKWSKSGYTLKENVARFVIDWMVKVRGKHQRRVTPRFLEDQVLK

SEQ ID NO: 925034 - protein, 149 aa, Homo sapiens
MSSCAIWLFKNVWQFSLHSLGPRSGHVTDYKFLEGSPKAEWMPPCFLHCLRKHKPIKPLFSINYPVKRKLRDLREINALCSVAKGPRAPGKLLVEAEVGLDCCGTALQCGVLAIVLCWDSGSTIWFLCMGALVVAGWPYGAILTHVFWE

SEQ ID NO: 925035 - protein, 206 aa, Homo sapiens
MSQRISSSDRQQHISCIITSVSSQSQHTRHHHRDRQRYISVSASSQQHRRSVQHLIMIIICISSDLNQRQLSSASVIVVISNSMCIIIISISVIQHRHHRVISTIIIISIVCISALIDIASHYHINDQSASSSISSSIISIIIVVSMSIVIMNSVIIVCIYGVVIVVMIDIMVSSSADRRQQHVVSSTRHSSSSAQQHVTTSHRTS

SEQ ID NO: 925036 - protein, 172 aa, Homo sapiens
MNSMIKRSIRHVKGPTVPSVVRLEEGHRDQQNCSQNKTNHDTGPSSMSTTLQEIFQAENTIMLLERSIMAKEGPLKVAQTRLECRTRRPNMELCRDIPQLKLVNEVFTIDDTLQTLKLRLRETQDTLQLLVMTKCRLEHELAIKANTLCIDKEKCMGMRKTFPCTPRLQFHS

SEQ ID NO: 925037 - protein, 181 aa, Homo sapiens
MLVEKMNEYYSGCIQFNGSEMRNCVIPRLDILQWPLLDTPSHLMEEPVAYQTEIYVNYALGIPLFYQLSNTIENYNAHTPFYTFCGTQGTFTVIKGTAELAKVIPGTWQSLGRCPGVLAWTPSSIASEMKPKVKIKPYQTPRKAAPLTEEMLPWPCTLSDKGKRMESRNSCPGVHPLRQCH

SEQ ID NO: 925038 - protein, 150 aa, Homo sapiens
MTSILGKADSSAHAAGIPGCQDSKVVESSLIWNSLREQWQAFSPVGSGNGSLAGSGAQWTPCWIQRGGSQPRVCDGSKQQWWMERAHNACPVRRCSVDRLVSHRNCYWDLRHEGSQNLNTGPRNSWSKKKLFRPVDFTLCKNSSTALFMK

SEQ ID NO: 925039 - protein, 149 aa, Homo sapiens
MWKVMGALHENKRTGMRVTVRIGNEIRQGKQPTKRLLSNQLSMWITRTESCWITDVAGNQHSQQTNTRTENQIPHVLIPEWEVNDKNTRKQGGKHHTVDGKTFPGEKSLLAILFLAVAVHSFTWKALEELKKNLKIYCARTSLILLNQG

SEQ ID NO: 925040 - protein, 144 aa, Homo sapiens
MRFRRGVSKCRVVQQGVGGPEHWVRLRLQEASRSRCPQLKTATHGAFGEFGGKSQDSRTGAWGIGDRLYYHPHFTDGDTELEKRKDLTRTVQQAGGNIKIPYVAPAEFPLGHFFLNRERQRGFGCHREPLQFCDEGRGMMKRKC

SEQ ID NO: 925041 - protein, 124 aa, Homo sapiens
MTVVGVFSNLGLLECSKLCHSPAEYLGQNREKQGVTMSERGCEPLALEPDLYLPGLQQVPEFLCISKDKPFRCLVYGSALAFNAQEIILPYQAYRKWTQVQYILSTATLIKSTEKIVGLLGLTH

SEQ ID NO: 925042 - protein, 156 aa, Homo sapiens
MRSACSHLCTSEISGSLSAGKQRSEARPGVLAAAGGTPCAAQGPVVSESTPIQSPIASLAGVGTWSELAACKWVDKSQGRAGPGRVRRERDRECLRVLGMSVEFLAGVEAQHDQGDCSPSLSTLLAVLLDRHPERHSTQIIASGVRVMQRSDTLQL

SEQ ID NO: 925043 - protein, 280 aa, Homo sapiens
MSGSEDDRKMWEIWELPRVLEGSEDRNMWESLELPRDLLNGFGQNAYSDTDNEVQAEVVSDKDKELVGNWSKGHSCYAKRLAAFCPCLRDLWNFELERDDLGYLVEEISKQQTIQEEADHKNLESLQTEDAIEKKTPFSGEKFKLAAEICISNKDPNINSQDDGENVPRKMYGNAWMYRQKSPAEAEPSWRTSARAVWKGDVGLGPPHRVPTGALPSGAVRKKPLSSRPQNGRSTNNLHCTLGKAADNASCDSSQEGGYTLQSLRGRTAQGHGSPPLASA

SEQ ID NO: 925044 - protein, 161 aa, Homo sapiens [sequence omitted]

SEQ ID NO: 925045 - protein, 156 aa, Homo sapiens
MRNKCDNLCRACQTVAYICFSLPPSYRSCSQLSSLVLPHQEQTPTSKPQPITWNPAGFLLLILFSAGHMAQLWASGFSHGKTEAGKWLREEQERRLPSAVEMRSTQLPGPSAGRGAGKPVVDPFESPNLKRRETHSAAFGLWPKAREPLANHWCGN

SEQ ID NO: 925046 - protein, 148 aa, Homo sapiens
MSHIPIGIFQETQADLYGLQSKGTLCHTVNVLASIEFGHWDSGRRSGEEEGEEGGFLQAPRCWVTLPKLGHWTEGHSSSPGGSLYTFPTSPQSLTKSFTCPFKPRITSRFLVSTGGPGTKPPTDTEEQLYTHNLSQSPSIACTSSSDM

SEQ ID NO: 925047 - protein, 175 aa, Homo sapiens
MGSKPCCKSLLALAHKGTCKEVHHSPLLPGPCQCLSKGRIPVEARGVQGLSFLGHGGHSRRGQKIDLGTQRTSPHTTRGLSMQKKRRRHWRRDQKGIGGQALSCMGKNIAAGGNSKGKGRWQVEWQGDWWVWSKEREGEHCGALMQGHKNAYQGLTCERDLNEVVTAATGNNRAG

SEQ ID NO: 925048 - protein, 136 aa, Homo sapiens
MSTHGHKDGNNRHWGLQKWEGGTGMLVEKLPIGYNVHYLSNLPDLSADQTCLHSWACMTVAVIRQNDKHKEKEERHPIHILWPFRKHTVVPLATYMRIYKKGDIVDMKGMGTLQKGMPHNVPVLRGKATPSRLWFM

SEQ ID NO: 925049 - protein, 554 aa, Homo sapiens
MKSNPPRSSLEACKAAGQGLAQGLSQGLHQSLVPFQGLDWGPKLFQDLRRVLVLFRGLVLFQGLDQELGPYLGQELGPYLGQELGPYLGQELGLYLDQELGRDLELGQELGLYLGRELDRYLGRELDRYLGRELDQYLGQELAPQQKTQAKPTKAARQKVLVTGGGGYLGFSLGSHLAKSGTSVILLDRRRPQWELSPETKFIQADVRDEEALYRAFEGVDCVFHVASYGMSGAEKAWLPGCRVKGRACGQRILRALQTSPGPCMVCVRRRVPRLIYTSTVNVAFGGKPIEQGDEDSVPYFPLDEGRCSPGAGQALPAALLTLSGGSVFPGLWQHVDHYSRTKAIADQLTLMANGMPLPGGGTLRTCVLRPPGIYGPEEQRHLPRVAVRHPRLQDPSQRRILAEVYTGRALPAPGRCISLEAKCPEPGTLSSTRCSCPHWSTGPLELLAGTELSECTSQAKARGHIKKRLFMFRFGDHKARMNWVHVHNLVQAHVLAAEALTTAKGYVASGQAYYINDGESVNLFEWMAPLFEKLGYSQPWIQVPTSWVYLTVR

SEQ ID NO: 925050 - protein, 150 aa, Homo sapiens
MSLRRRLLLCLGFLCRHISVMTEAPRPQSLRMLNIEPLSPALLTETWSHSALAISSTPYLAHNRSLIKFAIRINAQKLYYYILSAQLPGKETFSFYGYYKRPRLVFHWPNLDHMLIPEPINEAEGMKYANWPGLVMCPFLEPGEWGGLFS

SEQ ID NO: 925051 - protein, 143 aa, Homo sapiens
MGALKASERRNGSRRSLMTVEMMPDSNRAELTTTQGAKLELRVCPSQRCDSFYGKFLPSLSFRCLLFEVGFKLCPPLCLAHQLLGRGFESHQDPVTLGGMLPFPRGPLDVGEEPGELPGVPFNHCSAICAWSGGHRPGHGQGQ

SEQ ID NO: 925052 - protein, 146 aa, Homo sapiens
MSCNTHCEGLQLHSRSQRGHEPTERNEELRTRRLETCDTTKVFSFTSEPARPRTHQKEETPNTSDHQKEQIPDTPPLRTVTLTARVCGFILEVSETKNPPIPDTKGPRRVYTSNWASPSGHLKKGLGLWRPLPLVGCCLLLLMPGG

SEQ ID NO: 925053 - protein, 123 aa, Homo sapiens
MTDRILYIVSNMSSVPWEGSAAAAVPATSPPTPGHYHVLYRGCGETQVGWHGETYCLVGGYRVHGDAPLATPTKAEAEKPAPRRAPKRRQATIESDKDLGCSSPKIRRLEHRGRRLTPQKLAG

SEQ ID NO: 925054 - protein, 181 aa, Homo sapiens
MGGQPEESGVEAQRGGVWPQARGSGWGSLNLEYRVLPATQVEPVLPGPCMEGCMPLQSHGKWPDRWTLSPQASAGPQRREGVLGFQCVRERSRLNEPLPLAFLMATKHFQHQTWVKLGPHWGTAQGCGQCQTQDSGGRKKAHSWYYKWICAPRGATMDGQRNSQHLVLPEPGVTQQLAHHR

SEQ ID NO: 925055 - protein, 178 aa, Homo sapiens
MVLAKASLRKVHLNQDQKMERDQLFHKSTVAPRDVHVPITRTCEHVTSHGSKDFLDVIKLRIMRPLWLLCDDGGGGEAVVRTRKSRSVEFSLEAVKIIQEGNTMASIKAVGIQGSGRENECKQRKCQMLIKPSDLVRLTHYDKNSMGETAPMIQFLPPGPALDTWGLWKLQFKVGIEQ

SEQ ID NO: 925056 - protein, 142 aa, Homo sapiens
MIQDGSSHEAITSAFQPAVGRKDQRSSPCHLGFYSLVAPWPWALHGAQTNWIISEVFPTVRKDEDKTQRMEDVEAEKFAGGAVEALSSSYYVSDECFLSALNPDGLSNAEYSCTPFMIHPLPPSPPNTHSKKMQLFKTSYIY

SEQ ID NO: 925057 - protein, 134 aa, Homo sapiens
MATICGYCALEIWQVCVSTLDDVCTMTKSPDIAFIRVTRANPVVNCGCEGSRLHTPYEDPMPDNLRCSFTQESSPNPAPVHGKIVFHETGPWCQKDENVYRGCRERVEEEIELANNEERSPVGKEGGNGIFSYL

SEQ ID NO: 925058 - protein, 150 aa, Homo sapiens
MLKAVALKARKGEDVSAHCHWSISTHCPLEQDPREGLSPELLTLCQPCPNHLQLPHKPPSPNRDQGAPATEIPQLPPLCNQILEHLPALLPDLSERGKQISVLIPGAMYPVLMLVSVSLCVPRTLPGGKVVSSAPSLALHNVEDLRLGAT

SEQ ID NO: 925059 - protein, 173 aa, Homo sapiens
MGSIAASASGEPQEASNYGRRQRGSRHVTCQRQEQEKKNWGRSATHFCSARSCENTLTIIRTSPADGAKPFMRNPPHDPLTSHQAPTPILGVTFQHEIWNSVTCDCRAEVPVTLLAVSWSHPYLTDGIPWSLHMPPLYTKPAMVPPIFLILQISLIYPSAASLRKLSALNGLM

SEQ ID NO: 925060 - protein, 141 aa, Homo sapiens
MVRAEITYADKKQMQGGPVVKNKDESEAILILEHKLIQTSQALNLRSPMGLNSSRDGGYLPINTTYVGFLPSSMSLLHAFTKVSTLRGSDLSFAELVQPFTNLPSALIILGSSFPSVPLLTELLSDNTNPVCICQALPEKL

SEQ ID NO: 925061 - protein, 142 aa, Homo sapiens
MAVLVVVSASEFQLVTVAVAVLERIGFNGLGMALISQEDQVATDGCLSQGGNVVVFINKQLFNPNAHNDGLDKENVAHIHHGILCSHKKKEFVSSAGTWMKLETIILSELTQEQKTKHQYCESKKVFIFSMKVASENGIKIH

SEQ ID NO: 925062 - protein, 151 aa, Homo sapiens
MSWRSSSSGSIRQVINFLGTVGIEQVRGVTFLENQEVLIASRSSTEVRINQDNMITYLAKRFTPHILYRPHILPYSQKENEDAVGPEGRKEPVHADAATFTSQKRKAKETKICVPGKLQRFMNSPAINLSSLTIGFIYSIPFSCILPASNI

SEQ ID NO: 925063 - protein, 142 aa, Homo sapiens
MVLGDYLVSLLHVTLGGIEAQGREGNFPKPHRELMLDLALNPGPLTLGIVLSGYNKTGRRPGESDFWNQPKGLEWFLEAAGGRMSKDSSLRSNCRLPSTLCMWLLLPPGTELRVESDEIAKRLGGSGLREAPSSVESGSISS

SEQ ID NO: 925064 - protein, 157 aa, Homo sapiens
MHMGLPNLYWAASHRGSSRIISSLSQMKPLPILMGFSETASCVHHLSQTFVFTKIESTITLSVPFSIALLPVLLRTATSLLHDFILFVGKEQMFAVQSPVKKSPGNRSLQISQRAPVLQNGIYQLSLHYYQQPHGVPGRVDLDDSLNLMQSTTTKNY

SEQ ID NO: 925065 - protein, 134 aa, Homo sapiens
MTSAVMNIHPCHKFPRSIGSVAQSANDWVHCELGPWLFDPGDLSLTIKSKFLTDDKVLYSVPLVYVHISIPVPCCLGDYGLMVYFEISVKRIDTHSSLNVWQDSAVNPSGPGVFLLVIFKLPFQSHCLLLVCSG

SEQ ID NO: 925066 - protein, 140 aa, Homo sapiens
MARLLNLLKLPNSDTSTPSLVTNHAPLTISLKSNHPYPTQRQYPIPQHTLKRLKPVITCLLQHGLLKPINSPYNSPILPVLKPDKPYKLVQYLCLINQIVLPIHPVVPNPYTLLSSIPASTTHYSVLDLKHAFFTIPLHP

SEQ ID NO: 925067 - protein, 158 aa, Homo sapiens
MKNFERFLSSLPSGLPGAGFTTPFLAFKQANEHNLAWLLWPLGRGCSDTDMPDLNQGWQSLYNCLLSLCLTSCCKTKHLVNSTTLRVLALIAAFLKCMVQEPPALESPGFLLNNINSWAFQTSQNKMRLGSLHLEQELQVILVYANVRQSLLQGKDLW

SEQ ID NO: 925068 - protein, 144 aa, Homo sapiens
MGVGQAIGYMIIPEPMTVDRQIFIASNTQNSSSPPYSQTGASKDIQVGKDWRQKESIITWKMYIGSVRKDGTTGSGELPGLIKKQEMFCVRRSEEYRGKSFCFVHKTYLTLNPSPSVSQLCNFGKVMQPLYASKFDGAYLKALL

SEQ ID NO: 925069 - protein, 193 aa, Homo sapiens
MKDVRAQPVGGCQGTALPILQVCHRKQLPKVILSPQCCAWSQGIFSPDPGHALGFQGNANKLRLCLGANYKSFPLINGSTTCHVPVEQGDIHWIPHRGRRWSCLPVPRRAPALLSPWVVNGTGHCGAGGGARRGGSSRTGAHGGGEAQAWRAAGPEPCPEERQLRPGEKSSAAPVGRHCWGTQYTLRSHWPRC

SEQ ID NO: 925070 - protein, 477 aa, Homo sapiens
MPPRPGESPQAASQELSRWRQFSREHEAPFSAFLTDSFGGQHSYLRISLPEKCNLRCQYCMPEEGVPLTPKANLLTTEEMLTTKEILTLAWLFVKEGVEKIWLMGGEPLIQPDEVDIVAQLQRLEGLRTIGVTTNGINLARLLPQLQRAGLSAINISLDTLVPAKFEFIVRRKGFHKVMEGIHKANEPGYNPVKVNCVEMLETVWQLWPELEKLSEQESRTAKAFKIPGFQGQISFIMSMSEHFCGTCNHLQITADGNLKVCLFGNSEELLRIIGAAVGRKKQQHAGMFSISQMKNWPMILIGHQLNSEQLTHVDLEGREAMVDVGRKPDTEWLAVASAMVILGPVAFKLVQQNQLKKGDALVVAQLAGVRAAKVTSQLIPLCHHVALSHVQVQLELDSTCHAVEIWASCQARGPHQGGNGGPDLCCSPPPLKRDVNTWATALRTPDRPHSPQLALLMAVPPTPLYSGAYQGKKSAL

SEQ ID NO: 925071 - protein, 177 aa, Homo sapiens
MVCELGVRGRRRAAARCPSLLLALALSPSPVSSAAQAPAVAREQRGPSSRSGPQGHCLPWGANPLSKSQQARKQTLLIFCPGNPMDLTETLSEAGGGRKRTQIPWAKDSPLLSTLFSQRPTSKAQPNILQSGLPVPTSTKLSTLHTGFQEALNEERSLWQPWDAPAGPVTRAGCWGI

SEQ ID NO: 925072 - protein, 137 aa, Homo sapiens
MGKKQSRKTENSKNQSASPPPEECSSSPAMEQSWMENDFHELREEGFRSNFSELKEDVRTHSKEAKNLEKRLDEWLTGITSVEKSLNDLMELKTMARELCDKCTSFSSKFHQLEERVSVTEDQMNEMKMLSRRTSPI

SEQ ID NO: 925073 - protein, 146 aa, Homo sapiens
MRASWEQALHWVTSEDWMMPTHTGEGHLLCPVHQLKYQSFPELPAQTCPDIISNQLLGHPMAQSRWRVKLTITTSQNNLSLEAESWRGPFGSGVTHLVTGLQMDPGGQWGPDQWLKRSEGMRALSDFTKPGPLTNIKQWDELRMFP

SEQ ID NO: 925074 - protein, 168 aa, Homo sapiens
MTSQSSGATSVDTKGCHTGPLPSLAESSRGPTKLLTLKLSVDGKAKKSTIESQLPPTNRRGQAPAPYKWYELPWLHPSAHYSQCTGQSEVLLGPLYTWLSQYHHLGAYVPTDEFWRDTHIQTTAIGMREMDLGDVCMGKQCGSGNSMPGIDQCKAGPIPHFTDEEPEY

SEQ ID NO: 925075 - protein, 159 aa, Homo sapiens
MLALALDLADSCCHSWPLAHIANPAPRLELAQGKERGQTTGADTSEPTGIGKPFLGPEDTGCRDAQALLLGGLLQQHSGSFCSANSEGAGLPLVPSSCILCGMGGPGLQPWVGHPGGQIPPTTGSPQEHREARIHSHSLGGYSCSLGLQPVVWAAAAVP

SEQ ID NO: 925076 - protein, 203 aa, Homo sapiens
MRKNQCKKAENSKNQNVSSPPKGHNSLPAREENQIENELDELTEVGFRRWVITNSSELKERVLTQCKEAKDFEKRLEELLTRITSLEKNINDLKELKNTAQELCEAYTSINSQTNQVEERISEIEDQFNEINHEDKIRAKRMKRNEQGLQETWDYVKRPNLHLIGVPESDGENGTKLEDTLQDIIQENFPNLARQANVQIQEI

SEQ ID NO: 925077 - protein, 135 aa, Homo sapiens
MGHILFNGGRRYFLAESSAWKDNYASGSYLSGTTGVGLPESFPFSAQGQRALLMTPTPERCKKKDFYTKENQTYGKKNGPQDRACDNCIWTILSLRQASIFTESCILAKGPRKIYFKLNIISPQAIANNIFHHML

SEQ ID NO: 925078 - protein, 166 aa, Homo sapiens
MNSELKCALQLPCGQNLAFLDGAFETYSEVLSGPAHSHSTLLTPSKSQPWKALVSNHKIPLLFFFLFVCLFFAAGMQEEHRLGVLSAPRRMDEAPVELINRSNLALGMHREKWKVMLQSWVRVRSQRRLGWNPHYHLVFGDMGKFPNLWSSNLLTCLMCGITVPTS

SEQ ID NO: 925079 - protein, 202 aa, Homo sapiens
MVFQQGGMLAWRLRRAEWFGPAPDPWQPRDTAPCILATPASAMAQRGPSTALVAASEGVSHKIWQLPCGVKLVGAQSARVESWEPLARFQRIYGKVWMSRKEPAAGAAPSWRTSTRAVERRGNVGLEPQHRVPTGTLPIGAMRKGPPSSRPTNSLHPVPGKASASQCQPMRVALPKLPKALGAHPLHAWMWDMESKEIILEL

SEQ ID NO: 925080 - protein, 241 aa, Homo sapiens
MPYSSCTLFMPRSIVPLLGAQVLSLAAAGAVNPSCSPLSKSLMAAAAPLGFKHTQLRSVLTAGGCQKYPTGSSGCCWQQREGTYPSDKRALGTHSGDTVSLDAEIVKEAEVPQAALGVPAQGTGDNGHTPVEEEVGGIPVPAPGLLQVTERRRKYCSLPSARYGDPVSSPKRQGSRVHLLSKHSLGGLEPLSSVSSLEVHFDLLDLTELTDMSDQELAEVFADSDDENLNTESPAVTSEGH

SEQ ID NO: 925081 - protein, 189 aa, Homo sapiens
MGAQDDLRKVTQSAYAQVVQFGVSEKLGQVSFDFSRHGKTLVEKLYGEASAQLLDDEVRHLVSATYRCTLDLLTRCREHVEKVGQRLLEKEVLEKADMVELLGPRPFSEKSTYEEFVEGVGSLEEDTSLPEGLKGWNRGQEEEDVESSLCRGLCVACGGRLHLLLGGVGVTATYLGPWQSSCGISPKTN

SEQ ID NO: 925082 - protein, 135 aa, Homo sapiens
MDLTSFQTNSYNPEVLLGGLTLGGCLSTRSVHSDEQLKPKLSRASETHGPEIPQTAGQCPEAHSEDSEGTCLAWTQRSPGTHDVTFLPTDLWFGLTAINKVWGRQGLGSAHRKEPGQCGSFCRGRGSASHSPSGF

SEQ ID NO: 925083 - protein, 134 aa, Homo sapiens
MKYSTDDGRSQPELLDPGQPAGSPLAGPEIVIERAAGGELLLGKLLLETGFLSSATHNCGNTEASPRSRNYQGKGRPGLTFETPYGLVQSFSKCGSQTSSIGITRKLIKHAELRYIQSTPSESGTLGVGPSALF

SEQ ID NO: 925084 - protein, 190 aa, Homo sapiens
MNTSERLLRRNDAATEMCSFMGVNWAQRRTTSSCSLPLSGPGLQNPAAESGVADTQAAGPFLLHLFTSWPLSGSSDEPGCLVRFPLGKNGGKLTYSADKEGDLLPRPQPLAGPLQDFPGPSEHRGEMRVDVQLWLESLKARGDFIVIGKEITQECMSESSAFGNKFPWGPSRECTESDSDSRAWVMIFHS

SEQ ID NO: 925085 - protein, 149 aa, Homo sapiens
MLLLLPGSQYLTLRTAAPELCLSKRILRINSIGMSWELGRHAESQVPTRPAELEPEFYHDSQGPDDRALKTTCEDSEGAEGGSRDEMGGTIVNGHTCSGFHRVLQRSLLLPLRNTEEEVGSSQSNRRRQAAALDNKCVQAWLCGVGSIG

SEQ ID NO: 925086 - protein, 149 aa, Homo sapiens
MPAPPLQNSLITHCLSVDFVVVKILFYQGQTTISAGPSPVYWTGSRTATSVDFVRGVRTLVLPSSYRGPSSVDTLQGKYKVETFNRTQTWNEKERIVLVFFPWLPGNSKINVNALNILAPYPWLLVKLLPLTPPPRPPQLPLIQFTFPT

SEQ ID NO: 925087 - protein, 141 aa, Homo sapiens
MGCLPASERCYLYRKITGSEVEMPGLTPGSTLYCQCQAFLGAPNDKVSQFAFSYHECTTEKCAYSLTRNQTQSGGLGDILRLRFCSGRDRTHHSWKVTSEASGSETGPFSKLYVPLFPINDKLSKLTGFLCECNISPQFSP

SEQ ID NO: 925088 - protein, 163 aa, Homo sapiens
MSKNTVIVTITITICTGQTGFWAVYRITSKASYCYCWPGPASGSSPAVGPPVSVRHRCGSCFPKTHHQCLGASSLNLQQQQQQQQGPEKGLGEGYLQVPHPQTLLYSELLLTSDGNCIPEPDGFSGTTEGPLITFPSLTGEHPQPETVVYKFLRSVSSIMRSF

SEQ ID NO: 925089 - protein, 122 aa, Homo sapiens
MLYNIQPLLSAHVYVRQFCFYANCCVILSSSKTSLLLNPPGPPIPLTVYTSHPTAKRSMGISPHLELPNEIYHEPSGLRILHTVPGSNSDGSKGSQSESLLGRKAVLFRFGFMPITFYKACK

SEQ ID NO: 925090 - protein, 144 aa, Homo sapiens
MAEAQSMNHPIAVGVKDAQLHHCDSGTSIIQVLETVVSANITSNPGKGLGSPGGPGWGPEHGPPAHCWLYHCDSGTSIIQLLMKASWRWGKVSQETGRAEVDNDEGKVSLDSGSRWSWVAAGMEWRPLATFINLTSWGNAKAIV

SEQ ID NO: 925091 - protein, 168 aa, Homo sapiens
MVGRVPRTLHGPDSGLPVTFSVRARSGPCLPWGSCAASAPTQCWDVCLSLSSDFGVPLLRPGSRRCDRGKESLRLPRSTPPATFLKRLKPHTFPQHHHRRLQSSSPFGCTAPGLLQTCSLIPEHSRLPDFTSPSPIGTQLRAWPVAHDHMPNPPTFAELRVSRATTDA

SEQ ID NO: 925092 - protein, 145 aa, Homo sapiens
MCPPAVSQLHEFVVHSQVEAVSTLHSGLRPPGSFFSEFKQDGQLEQAGERAALRGLSEDHMGNTAHSAATPAPLVIPNHTCSNPCFNLLCWCNARAARAVLGAPSFLLLMTRHSPCMLSCRRSKNPLLGSGLGPLSCNTDTILPL

SEQ ID NO: 925093 - protein, 138 aa, Homo sapiens
MNKRCDNLNYLVVLRARRQLLLKRAVGKPGGVSLAGKMAAPSHSRIEMSIFSITGLQTRPVSCPQSISEMELSICTRKKSACRLNAVAPNELLSAEVGKHDSISIDSGIGKSKTWETTSKKRIGWYVAERYAAIKKIN

SEQ ID NO: 925094 - protein, 131 aa, Homo sapiens
MDKTCTGDLREGLEFGLGGNERSSQGSGPAPIILKLSVGSVSHIIGLEDGEKSSYYQGLPVQQNPGCKGAQQATGKVTLTHAHRESPTLQLHGGHLMALMNAKACKQANWSSLHSCLQNPMHTSSLHSKLP

SEQ ID NO: 925095 - protein, 158 aa, Homo sapiens
MEEEEEGGGGRRRREEEKKKKEEEEGGGGGGGEGGGEGEGEEEKKKKEEEEEEEEEEEEEEEEEEEEEEEEEEEEEEEEEEEEEEEEEEEEEEEEEEEEEEEEEEEEEIGTRSHFRSLAAFSLTCLSPHVRTLRVTIINANRCQAGNVNEPHGLDVRY

SEQ ID NO: 925096 - protein, 118 aa, Homo sapiens
MNGWAEQRGHCSPCGRVLRTGLKLESNKRRSKCHHVQMSSRVSKGSIEHRGRPGQGFCQAPGHGKFGFQRTDGKCHLICSGRTAVRTVWDDDVHIDTLHHGSSQCIPEYIFSPSVKLA

SEQ ID NO: 925097 - protein, 162 aa, Homo sapiens
MTFWKPYYTTYLCSNLTWRAHLFIQEQYGEQEIQFGRGTVCFSILSLNLITHARAFQTFEWLGMQMEGFLQHKVVEKTHVLEPGPTGWNSSSAAHCCVALSKSPDHPDPQFLIWKILFSHSIAHGFFHSINTLVIKESYAGDNCCEPATGTRGGIDGQPCLT

SEQ ID NO: 925098 - protein, 146 aa, Homo sapiens
MAIALFVNLWLWRPTVTCLGSSLSFSTLLITHSASTTRASLRQLATPRLTPPQGLCTSLHYACCFLSRHCLMETTAPPSTSCVSFQIFNNELIFPSRLLQVVVSSCTAAAKPGLNTKESGWEKGGGGSPGLPLNCRGPAHLLAPRG

SEQ ID NO: 925099 - protein, 136 aa, Homo sapiens
MTLPEDIRAPSNSPEKGRYFLKVKGKQQPNKRRCREGPGVKGLLLDERPKSRCHQSGDASESRRDQRMQHPKTHGNVNTKSLCSPAPQEGLPLKLERGCLRTNKSKHDLCKIVLGSLATTSPNKGIVICPSCVEMA

SEQ ID NO: 925100 - protein, 149 aa, Homo sapiens
MALAHSTQEERGGGAAYPGSCQPFQKSPPLSPLLRPWLYQSYLLVNEVLSEEQGLFKGAFGKEHKTQEEEKTNVGEDGEIGTHVPGCCGKQYDGPLEIKHRITIGPSTSISGYIHKRIGSKDSNKSLYTHFHSSIIHSSQKMETTLNVH

SEQ ID NO: 925101 - protein, 137 aa, Homo sapiens
MRSMIGMKVQQHVHIKSDELVLTEKEMTLDTVCVITLQREEEEEEGNVLPSENHELSEIPAFPPTSLMFPVSTTLTGLRSKYIEFGKGVENKEDSLLLIPMRAIAVTLLGDVLIRQPLRFLYPPDNRMLKKDLRGRS

SEQ ID NO: 925102 - protein, 152 aa, Homo sapiens [sequence omitted]

SEQ ID NO: 925103 - protein, 134 aa, Homo sapiens
MASDISVQRLTGRLRTLNPARYEPNNLVGVIILEVGSRKSRCRQGGFLLRTLRKDVLVDSDAANKDIPETGKFTKKKRFSGLTVPHCWGDLTIMVEGKGGAKTRFTWRQARETISLTSLDLKSLLNSSLHIPSA

SEQ ID NO: 925104 - protein, 155 aa, Homo sapiens
MCKQIVLLYILGCLSFCLGILLLLSLHYFHTNPDGSILRVELSKWKYSTDFLDAANSIYPLYANSLKPPCKVWFLGDSGIQHCDSACDIFYISPVVMKQPFKSFLAEQLRGNLFEVDVDGIGSHRVSEALSWRKTLARGSSDKFLADSVILITTP

SEQ ID NO: 925105 - protein, 136 aa, Homo sapiens
MGLFIWELGCLSSLCSHIELQRAANLAEATHVKVIVTMEQIAWHKEGRKQQLCLSKEDSNSQSPQGLPTTEEREKENRVTELQIDRSSTLTKEDFWKVSGNEPRPLLPWGSRKCLDSKFQADKEKNLFSSASDQVP

SEQ ID NO: 925106 - protein, 137 aa, Homo sapiens
MPLCISPHGHEMAAVSQTLIPGRNKKEEDTERMILVSGHKKFSPDFLAYVSLAITDSCAYLKWPEVSTPRLERVSDLSSHSWYVAEPGLEFKSATIIPRPVQRCIHERCQCDFKELNEEFGMKCSIYYLFILTFAYQ

SEQ ID NO: 925107 - protein, 151 aa, Homo sapiens
MALTQGLVVTTAWLLLMFTQGPRAFQSAGAEGLPLATTAPGSCGLLPGLGPGPEMPSKTKPGNGDSNSLLGVLPHRGHAGAQVTRPSPLYSLFSFAQAEGVSTHGHQSWECGESHLKPAWPWIASKSRGKYLACLATVADYAGAMGPLVSR

SEQ ID NO: 925108 - protein, 149 aa, Homo sapiens
MVLSAPPSISCCDNCELRTKGTSEVSLWSYQGTDKTIPAPGGLFNGAPKVGRLVMISEEWKVLSVQVWNKEKPLISEVLTMDLGPEKAAKSAKKESSVAFEGEIQKEAEKNETRPLSLTIHKNQPKWIKDLNIRPETVKPQEENAGKCF

SEQ ID NO: 925109 - protein, 169 aa, Homo sapiens
MLPGQNKSSFNRGKKKLPSSRLLFLLLCLENSWSSFKTQLKYHVLVKHSPCLARIMQPSPPQGLLSNLHGPFLHHVSVVGEEHGPFLSTVSWCQTCDMYSVYLFIYSLKYLLSTCKELTFDDPVFKNVTCYLCVEGIEQSDMPLTVLPNHNLMASLFREGGRKRKGEIL

SEQ ID NO: 925110 - protein, 135 aa, Homo sapiens
MATQPVGVQRKEGEQSVGGKKLKGCGESPVNDPLSYNVLWLECIISQLNCSETWSCPGATKLQESIQIYVPCTHQSPDRQNHNSACLINITSRVCRRHLKSTVLRNNPNSVLSSPGQNGTSIHSVAFIKFSQIHS

SEQ ID NO: 925111 - protein, 170 aa, Homo sapiens
MLVNVGMGMLINDSMGMLIKANISMLINASMGMLINASMGVLINASISLPINASTDVLTNTSMGVLINASINLLMNASMSMLNNANMGMPVNASIGVLINKQREHMLKSRALTITFGLNTSMDVNHLAHTKCSMNDLQGLFYLPQIIKAHLKPVGPESREEFTAWPTMER

SEQ ID NO: 925112 - protein, 137 aa, Homo sapiens
MCLQADLRKPELKKVSPQPVRQEITNPLYRGEEEAKAQRTRVQAPFLCCLTRLCPPLSTRSAHIHCPLGLFQRPKHAKGRSRQRSPFQWADSPPRCPWSHPSENLAFTSTILPVWRWCMLICNIPISYVAINKNKQH

SEQ ID NO: 925113 - protein, 171 aa, Homo sapiens
MVQGASEAIGQRQSSAAKLRRSGKESVTEPWARVPGTLEVAASAPYYLLEMQNVNTEVTRLHVVIDNDHNCNKNKGCPELLDPQVTRRLSWPVNISELSGARAHRRTVTIGYDVSIMQMSAPESGQSRRGRIKSAWRRGQQGHPGPVTCVPSLAAAMIANSLGILPEIFYA

SEQ ID NO: 925114 - protein, 648 aa, Homo sapiens
MLLVAFQSMETIDRAGQTWPQRTLLGLLLGVGDVKFPQCLAAPAGPTREAPESHAPQRQPLGEVLGSFSSPAQGSLSPLYSSGVHFASFRNASLMSLGSARVLSRPLSPLAGRVPGSTLFLGPLGLAMRLPLLQAKAWPMHLPRTSRSGVGGEGDRSSNRGSRGPRAALSLPCVPNGHRRRILPAQRQWPRRRSGRGRGRGEGVQTPPPVPPRARSQAAGPPGAEHKPGTHGLSGARAEMRARLLPPLPGLERRDPMAGSGGLGGGAGGGQGAGAGQGAALRASRAPMLLVALVLGAYCLCALPGRCPPAARAPAPAPAPSEPSSSVHRPGAPGLPLASGPGRRRFPQALIVGVKKGGTRALLEFLRLHPDVRALGSEPHFFDRCYERGLAWYRMDVGVRQPQLKQPALVAAHPQAWTQRLQRGPCPRPVGESVGVAGPRRFSRSLMPRTLDGQITMEKTPSYFVTREAPRRIHAMSPDTKLIVVVRNPVTRAISDYAQTLSKTPGLPSFRALAFRHGLGPVDTAWSAVRIGLYAQHLDHWLRYFPLSHFLFVSGERLVSDPAGEVGRVQDFLGLKRVVTDKHFYFNATKGFPCLKKAQGGSRPRCLGKSKGRPHPRVPQALVRRLQEFYRPFNRRTIHLTVKILGPK

SEQ ID NO: 925115 - protein, 146 aa, Homo sapiens
MLSAGPLGPLLFLYTLSLCLISFLSLSSHPTGNTHSPHQDHHPCTAVAEIPRRQQASSHPATGLSLVDSPGDKTLHTGAQFAGEGQSALGPESTLGETLAPAAPSLPQQSRLPQDLPTEPFPEPLLLLQGEAERDRCGHRGPELAA

SEQ ID NO: 925116 - protein, 145 aa, Homo sapiens
MAPVKALRLEEQRKNLCQSQPESAGPGTSSTDVQGQEKMDVPAQAEREVEREREKERGECRRRPRKSPFKRELLSSPVLTPSLCCIPSCASASTLLCEVLHGSRPHHPCIWNSLEQGSSMLPIKTVFILNEESAFHQRDYRRDWK

SEQ ID NO: 925117 - protein, 131 aa, Homo sapiens
MGGPPWELLALALIHKGTTRSNVRVGNTTWVLTCGAPKILPKRAKAQRKKVQTVQPPSPSNSDHPRNMGYAPGNAACSNLLALAARFAQHCRTRHALLWLSAAMLMLPCRCPRLNGTLICVYRGKGVEKCS

SEQ ID NO: 925118 - protein, 147 aa, Homo sapiens
MKVWRSPDFDPTAISLASLCLQVTGMAQRPWPMAAQEKYNDFSIASLKCNCVIHQHYWRKLLDKIKGEKLVFAKTRLLGMFYRPQIPATSLKTPIEEQDEYEITASSSPFHDFTLHPALFNQSIIATLWPTPKPLKTLAPNSLGRYI

SEQ ID NO: 925119 - protein, 178 aa, Homo sapiens
MSLLSISFGIMLLLSAGLLKSPFLVSVDKSQPQPNLLKPVKRMKRQNLMNAFTLVDIKVGGLDNSESDLFANSNTTLSWGNIIPLNARDCITYKGLKDVFHTEGYKQVNIASLEENVSPYGGFPWLGFQGHPESSEKCTNLDDAMKIPFSWLELEDDLGGKDYRTPRSDDNRGYSTCQ

SEQ ID NO: 925120 - protein, 286 aa, Homo sapiens
MPEKKNPEEHIDGENEPRVEPASTVSLRGSVEGMELVVIVCLWLRTHTGALIIIITINIATIITISITATIVTNVNTITTNINTAIVTTIIIIIVIITIIIVITTIIIATVITINISTAIVTGVTIITISITTVIIVTVTTIITITTAIITNVTVITMNITTAIVTNVSTITITINIIVLINITIITVINSTTTIIITIIFIITTAFVTSVTVIIKIINNTIIVITINVSTSTIMVVIIVITITTTTIIITIITPFLCLNCLWSQRYYPWLGNMMEPPFNSILISV

SEQ ID NO: 925121 - protein, 134 aa, Homo sapiens
MRRAFHFCSVVPHNSKPQANHEKHISQTQTGCTGRRTVSSSLAVVPRSWRLFQGPKVSLQSPGFHGNRSIAMLSPERLGKAPSFIKLFMKLYLSLQFQMQQEQLKQLRAKPNWIWHCLLCIRDTMIISILQMRK

SEQ ID NO: 925122 - protein, 243 aa, Homo sapiens
MELIQDISRPPLEYVKGVPLIKYFAEALGPLQSFQARPDDLLISTYPKSGTTWVSQILDMIYQGGDLEKCHRAPIFMRVPFLEFKVPGIPSGMETLKNTPAPRLLKTHLPLALLPQTLLDQKVKVVYVARNAKDVAVSYYHFYHMAKVYPHPGTWESFLEKFMAGEVSYGSWYQHVQEWWELSRTHPVLYLFYEDMKEARKKTIPVLTHRSQAQLMMGSQGRQQFILPQGLGSQGSRSWLYGF

SEQ ID NO: 925123 - protein, 1029 aa, Homo sapiens
MRPRTPNRCPFWLLLQILFFSFQIPDSLGTFVSYLLGDAVPTVEREAQAAEELGVVAVGKTGKIVEEEAQEDLEGLRGSQNEGAGRLRGPGDDRRHEVGSSAVEQTWGWGDGSSHGSQAERQDSGAGETAKAARCQEPSAHLEARKKSKAGSGACQDRSGQAQERQESHEQEVNREERLRSWEQEEEEEEVRAREPGMARGAESEWTWHGETEGKAGAVGPKAAGDNREMEQGVREADAGETEEPGAEGAGKGEEVVVVEKACESTRAWGTWGPGAEPEDWGILGREEARTTPGGDEAWTTSGKEEADLLGVRQTEYGAVPGERLLEATGKVWVLEEEGDEEREAEVSPFPKQPQVLGTERTEEAAESQTAGREAVGGQEAGESFEGQVDLRGKEAEMRQDLGIRADRARMEELVQAEEAQEERGSSRDPVAELPSDGEAEGTADLEATPEARPEEELTGEESEAAQTSCGLLGVEWGGLTHSVTKGQGPELMGGAQTPTKQPEEREAGEVELMGVLALSKEEQERSLEAGPRHAGSVKPEASEAFPGAWENRTRKDMERGNTQEDAADGEQREEEETAGGQTLAAEAEGDRESELSEVPEAGGEGLTTQDAGCGTEEGEASVSENQELDGSTGADAGPCPSLGEAYARETEDEEAEADRTSRRGWRLQAVAVGLPDREDAQTGSVAAGIMGGDVVPHISAAGAGEALEGALGQGWDSKEKEEAAAGEHAGGQEFGLEGSAEEEVTGRGSQVEAFESREGGPWGGRVEAEESAGAEDSCGLDPAGSQTARAEGMGAMVEAGGLLEKWTLLEEEAVGWQEREQREDSEGRCGDYHPEGEAPRLLDAEGLMVTGGRRAEAKETEPESLEHVRGQEEQPTHQAPAEAAPESVGEAETAEAMGSARGGAANSWSEVRALGGVSGGTSGIPKPAPWSSVPPFLQAPLPGSLLDVSVPRSRVHLSRSSSQRRSRPSFRRTPAWEQQEEPPAPNPPEEELSAPEQRPLQLEEPLEPSPLRHDGTPVPARRRPLGHG

SEQ ID NO: 925124 - protein, 139 aa, Homo sapiens
MGKKRPLHPPPQTAFPATPPLRCPEQTGSNHGENGCVCVFGLDTHIYRRDPQPKALTRPRSALGTCVPCLCIHTPWAPVLATHSSPSGNGNVSLIHGDSSAAARPEDEARCGRIIPCEELLQQGCQAPAWEDVRMEESP

SEQ ID NO: 925125 - protein, 171 aa, Homo sapiens
MGLGITAFLSITYHLLTYFVIYLLIGLLIMAFSFSWNVSSIKAGIIASDLSKYLEQHWQGVDTEDARPVVVWKGEEDQEDTIQALHNGQFHSGFQRANKSPAVHVTHPHVGTELPEAVTMCLGTGDWPLHRIQVTTISGAMQQDSALTRAALCQERGVSPTVKVMSNRAAR

SEQ ID NO: 925126 - protein, 118 aa, Homo sapiens
MATVHRRRALRCLKRGTECPSGSRFADEFAAWQPLGGVSIPDAEQYSCSQSSLRREIAVTDPELNIQGIPELAVQSNGHNRPGAQHSEDLRGDTREPTTHWPLIPPFAGGYPVSLPVS

SEQ ID NO: 925127 - protein, 139 aa, Homo sapiens
MYPKPPPTCNPCPGPDHCALTSLSCFHACSQIYICFSSAWKTLLPDLHRTSPFPSSKSQFRLSPPQKGLPQPSCLRLYTGFLPRPQCNQNHFKRVIIYCEKLPLLKNTGALGSNPSFAIHQLFGLWQIAELSDLQFSHP

SEQ ID NO: 925128 - protein, 319 aa, Homo sapiens
MEQVADTGFPSCSHNCPVTWCLSCEPITSQASQCFLGQILGSFTGDCPARVSAVRSPSNPPTELCPRALTVGSRPSLSPGPRAGTSTCLTNNILRIDCHWSAPELGQGSSPGLLFTRDHIVGVTWLILGAFELDPGFIHEAGLRVQMAMLEDDGAQEERYTGQWSECSQPVCFQAPQRQDGKSEAQECGSHKVLQQVTQTSKAHHKVLQQMTQTSKAHHKVLQQMTQTSKAHHKVLQQVTQTSKAHHKPSTLAQGTKGRTFASKAWSWMSWVPDLPDESCPFWENGLKSPEPLSGTEPPENGPLAVVGGPVWMEAQGQL

SEQ ID NO: 925129 - protein, 171 aa, Homo sapiens
MLSAQERAQIAQVWDLIAGHEAQFGAELLLRSVEAGSPGAQGGGDEGFGRVGRQRHPRSFGLFTVYPSTKVYFPHLSACQDATQLLSHGQRMLAAVGAAVQHVDNLRAALSPLADLHALVLRVDPANFPLLIQCFHVVLASHLQDEFTVQMQAAWDKFLTGVAVVLTEKYR

SEQ ID NO: 925130 - protein, 257 aa, Homo sapiens
MALSAEDRALVRALWKKLGSNVGVYTTEALERTFLAFPATKTYFSHLDLSPGSSQVRAHGQKVADALSLAVERLDDLPHALSALSHLHACQLRVDPASFQRSPQLLGHCLLVTLARHYPGDFSPALQASLDKFLSHVISALVSESSLLAVLSRGQDARGRRRPSPRKGEGLGHTPSAQIQARLFPPPAGLGPRPWGHRTACSLTLPNGVVGEGRGTPRAAGCEDGRLCPSRGRLASPSPLCAEHAARTHRENSAPAA

SEQ ID NO: 925131 - protein, 151 aa, Homo sapiens
MFLSFPTTKTYFPHFDLSHGSAQVKGHGKKVADALTNAVAHVDDMPNALSALSDLHAHKLRVDPVNFKRRRRLRAWAALTLFSAQLLSHCLLVTLAAHLPAEFTPAVHASLDKFLASVSTVLTSKYRPLGPPGASASCAASNFWKRPCPRC

SEQ ID NO: 925132 - protein, 146 aa, Homo sapiens
MGIEVLTLVMGSIQIWQLSFQALYYLWFAATPLTLYVYKEEIGAMTAAKERMKENVKGKTGGSSADTIMGCQGLESVLVSLVILDEPNCYRIPSVPLHLLEISLATMTSIWDLAQACQAHSTRSAQQAVLGLHPGPDPIPDQGLCT

SEQ ID NO: 925133 - protein, 139 aa, Homo sapiens
MTPFKTLVTSDVVAEKNEQKGSSQPELFFPNSLKIKGSPFALLQLEYKWASSRVQGLPPQSQEGTFSRSSPWKTNLFNDVMEGTLDLRAGAWAMWSSLLLLGYKPVPHVTVLSAVDDCNTKIILVYLNVAKHRKGYIPT

SEQ ID NO: 925134 - protein, 162 aa, Homo sapiens
MSSVYSLLIPSVFGWLLVRSVWILQLYEIQNSCPVFSTVTLISKHGICSFFSENILSLYQVPGATKPAVTQPESPNLRSGEADNCSLQSMAKGPRAPGKPLVRAGSQLDGAHPHCGWVFGRQDSSNHAEDDLQLSSFHELWLSPALFQKSSKISVIYTSVFE

SEQ ID NO: 925135 - protein, 188 aa, Homo sapiens
MGEETEKKDLDSTPENLTLNPRPSDRIKERRIKVRFLKRGISNNLWTYFQTTRILEEDFRQSSDIDLQQEKVNLKTGFMGWLLAGPLVFQYLAGLIHIKSSGFPQQPKEENSQCTIYFQASNCITFAKVEDDMANSLTRKLYYEFFVFVFVLHKRKEEVDVLDPRYLIPVGDSWSSGVVILVSRTASA

SEQ ID NO: 925136 - protein, 169 aa, Homo sapiens
MKTLSWKQKHISKYFMAQRETIMDIRKYLELHDKISHANVRLVGGQWFQHHLLKRAVIHYSRIHSPRKTHRIALAFHRQLTHGCLSEPDSGAWRVAQNGDDNLPSSSILWLEGGQLHAAASRNGNDGGEWDSPGLTRWEEGFSPFSLSFPFLVQLWEEERTSKIKFHTG

SEQ ID NO: 925137 - protein, 184 aa, Homo sapiens
MKAQDIDWSIFSLVTFLPAAVLGAIREHFSVQLKRKFQDRIKERRIKVRFLKRGISNNLWTYFQTTRILEEDFRQSSDIDLQQEKVNLKTGFMDSHSSQKRKTHNAQFIFKLRIASRLLKIGCIGGPRCTSDIGKAEMGYGCQRDAAVPYSWMEKFDDTQKDPNVMVQVEEGSPTLAHVMGVTC

SEQ ID NO: 925138 - protein, 386 aa, Homo sapiens
MCQQIPYTGELQLASGGCPSGTKLPEEGAGSNLCCSAASTGDTQANRKRKYQCKNAENSKNQNASSPQKDHNYLPAREQNWMENVFEKLTEVDFRKWVITNSSELNEHVLTQCKEAKNLDNRLQELPTRITSLEKNINDLMELKNTARELREAYTSIDSRIDQAEEKISEIEDQLNEIKREEKIREERMKRNEQSLQEIRDYVKRPNLHLTGVPESDWENGTNLENTIQDIIQENFPNIARQANIQIQKIRRTSQRHFLRRARHIIIRFTKVEMKEKMLRAARKKGQVTHKGKSIRLSADFSAETLQARREWGPIFNILKEKNFQPKISYPAKLSFISEEEITSFTDKQTLRDFVTTRPALQELLKEAVNMERKNQYQPLQKHTKM

SEQ ID NO: 925139 - protein, 141 aa, Homo sapiens
MEAVRDYALRNRAFQPRCYAFPTVFTTQRLGGDSLGCLHNQGPGFQTQSWVAIWADTELAAGVSFHIPVAPGMPVRENRSLPWKWGRSQGAECSCSADPTSTWPSKLRSPGLKFLLPAHQFEVDLGGLSLVWEGVPAITEA

SEQ ID NO: 925140 - protein, 181 aa, Homo sapiens
MQNSGISSDHVFHYVGEALADEKWRNIIIPDTVLPPHFPASSKTLMQPLLRDSLQRAEFSSKLHFPGSRVSWFSEWIKLMKGNGRRLEHRGRQKLGYFSPFLSALSDVSSIFSMLSAPARQALLQLLFPPGRPSPWIPETLSPSSLYPTSKWRLKVVSVLLVEPDRYDPFLHSQPIRYKGS

SEQ ID NO: 925141 - protein, 158 aa, Homo sapiens
MRNLNRYREEEMEDMGVFAEDKQYFHGAQRFWVDGAQQDHLGTETTCLLGCTGCHTPAGASFIFKSSSESRLPLSGPGLRFIVADLEPASQAVHICPLNTCWLPADISWGLGATAQQAVTGCILSDTHSQSLKPLSVKSTWDPEEWLPEMERLKAYSL

SEQ ID NO: 925142 - protein, 209 aa, Homo sapiens
MHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQMQVQADKGSLVPESENKSLNAFVQHNFCNILPPDGGSEQAKIKVILVDVEDISRQGESRENPFRLKTQAPQNSRRESNKIGQTAFVEGVSRGHRKLKEKWNKMTT

SEQ ID NO: 925143 - protein, 132 aa, Homo sapiens [sequence omitted]

SEQ ID NO: 925144 - protein, 1166 aa, Homo sapiens
MVDLKKEGAGPAGIWALDWLQGLVKQCSLVVNGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRVSAVHLILLPAPLLGAPLVPTGATYPECRVSKKRRYRAVAKQNCCAVDSLSLNLSTAIAFPAM

SEQ ID NO: 925145 - protein, 288 aa, Homo sapiens
MLVTDWSRVFLAEEGINHECKLCNQMFDSPAKLLCHLIEHSFEGMGGTFKCPVCFTAPIHAPGCRGQGQLCRPSSQPPDWLPAQANGCPSPRQVSGALPAPSCCPDGSRCAWESLAFPASPDICCLPRQEAHPGEDAWQEGISEVLTSQTHSCSGPPPGCAQGWGHLRTPATGKPGLDLLHARPRGVHSGANPPNTHPWGSPEPLSTLMPSSPSSQEPPPIFFVQANKLQQHIFAVHGQEDKIYDCSQCPQKFFFQTELQPPGLCQPSVLKRTNCHWLSPEQESEAYI

SEQ ID NO: 925146 - protein, 236 aa, Homo sapiens
MPQNQSLPGTAPWVRGLGAVPYEQMAVIAGNPETLQESRVWVFTASWSRREHQNGRPSGAQPIQGGVGAARFPEKGEGGPLLLLRRVLPSAHGQPEGAMKSSVDEAHSFIQQMCTEHLIFVRPCSRCWDGSMNQAIESPVFLALPFMWSWIVRGSYKEHGAWGLHGQFLGPAGSQEPDYKLSPCLVSFPHQLNLRPKFMGPVGVKGGNSQQLPPRAAARSIRHPGVSRVHHQLLEG

SEQ ID NO: 925147 - protein, 153 aa, Homo sapiens
MCMQFCSFTPNPRKTFSLALQVHLVSERFAMSRCGFGISSFSKGIDVPSFGDPSQKSSGWKISSSSTPVNYETAHICMEFLAVTDCAPCFTCKLSCALHSTPAQHILSLNPFYRRGNRGTERRKTSFSYAGSDSDVKDQSYGSTMITQPRLVF

SEQ ID NO: 925148 - protein, 131 aa, Homo sapiens
MCAHVCMYVSHSHLNQIGTFTLMIVSQHTASLSCVMAMIQNCHISIDSVPIVTLEQGSANHDPWVKSNKSSPLPIFVWPKSNLTVTIREAACSVKHGDFRDIQPGSQNGFLPALWAFCSASKEASRWHGSV

SEQ ID NO: 925149 - protein, 120 aa, Homo sapiens
MGVAVIVERAEHEKVTAPVNAAKCQSLSKLELLTAMAGSSGLRGRPVGSDGWTPRMAFQRAGHGHLITSRVNILVIYFTTTHSLVPSQRVLYAALKRARVISLSLSFYIKFKECITMKVV

SEQ ID NO: 925150 - protein, 156 aa, Homo sapiens
MLTPPKTSITPSQSFSFSVSYLGFISVNLYDKCMTELLLFTDTGNVQIHRILLFCHSLQEEATLTDIEHLGSGGNLRDRKLYVLNKSRSLQFNKSWNSNDVVRHEQGRRGDPQPPTRNVRLPSGEGSCELFQERMDLSVVKLFDVQSFTDLMEDLF

SEQ ID NO: 925151 - protein, 151 aa, Homo sapiens
MFGSAVLNPIKYEWLWIQATVQTKPNPTLNKSDAPAHFLVDRFTLGTGLHSQRSVAALDSHRSTNPIVNCICQGSRLHAPYENLVPDDPSLSPVTPGWDHLVAGKQAQGSHRFYITVNGTIVFHETGPWCQKGHSEKAAVCEPGTGPLPVT

SEQ ID NO: 925152 - protein, 149 aa, Homo sapiens
MGLGRPTRQPPAWWRIEGEAAVGQNVIGQGRLSTDTLGKLASEMTLVAPEIKPGKSVRGSVVITKSKADSHGSGSQKQHHSHQSETPQVQIRALPQKGWDLPPPQHPAARSVLFIPAVFSPGQPEHCPCAPPSERGIHPAGAQQASFML

SEQ ID NO: 925153 - protein, 446 aa, Homo sapiens
MHVPKEFADLLFLLASEHQKTTTPDPMDDPCFSHRSRRKLAKIQLPEYILDFGYIILGEVRTHIIKIINTSHFPVSFHADKRVLHETGFSTELDRVKNLPHCETEIFEVRFDPQGANLPVGSKEVILPIKVVGGPTVHICLQAKVTIPTMTLSRGKVDFATIQCGQCLVETIQLSNHLQVPCEWFVQSQKPVDKLEKHMPKYLRQKLRAELKPKTRIFEIQPISGVLDPGEKSNVQVKFMPKEEKFYSQTLVFQIAQSAQKLTLLARGQGLEPRLEFSPSVLDLGPLLLCAPGDEAEVIVKNPCNFPIEFYSLEFDQQYLIEEKQILRKLKGYDSYNTLLLPPRNPGEKLPPELYEYFKEIKKSKEEQMRAKYLENLAQENETGALKAGGGHSHKQKTSPSIVLRPNSNRRAVLCSQNCALSGPPPLSYPIICPGALVCLAIKVPR

SEQ ID NO: 925154 - protein, 155 aa, Homo sapiens
MSLSPSLPTNILLLLQTHFLENFPHHPCWNPFIPKSLFQRSWYFCCKIIFLCSDLLSFLHGLLYGSPDAELTGPDPWDVVAVGHSFQHNGKLEETRKRIVPQILQEGTQPCSPILDFCPPDLWEYKFALCEAMKSVVTCYSSNGALILTTHRLIP

SEQ ID NO: 925155 - protein, 262 aa, Homo sapiens
MQEKKLQQELERQKEEDELKRRVKKGKQGPIKEEPPMKKSQAANKQVPPLTKVDVKMETIERKISVREQTMSEKEELNKKKRNMGDVSMHGLPLVQDQEDSEGDISKDPDKQLAQKFKTYELTLKDVQNILMYWDRKQGVQLPPAGMEEAPHEPDDQRQVPSGGRRGRKDRERERLEKERLEREEAERERLEKLRDLEERSDWEGEGEEDHEEKKEKDLGVPFLNIQTPDFEGLSWKQALESDRLPKGEQVGCNLYCCDNGY

SEQ ID NO: 925156 - protein, 607 aa, Homo sapiens
MKEKIDQVFESQKDKRHMALNRKVLSGEPAGTISQLSDTDLDNFNGQHSQEKFTRLNHFRWIVPANGEVTLQVHFSSDEFGNFDQTFNFEILGTCCQYQLYCRGICTYPYICQDPKVVFPQRKMDMKTNEVIFKKYVMSTETYYFGPLLCGKSRDKYKSSLFPGNMETLTILNTSLMVVEASFYFQNDVKANTYFLEPNTMVLKPNEKQILNVWAYPTSVGVFEDSIVCCINDNPEPAIFQLSCQGIRPELELEPRQLHFDRLLLHRQESRVVLLRNVTLLPVAWRITSLEHLGDDFTVSLMQGTIPPEAEYGLHLYFQPTKPVNIKKAIRLEATCSFSHLDFYRGFLTGFPVGIRHSVQRDLYNVIQTVAGSWGVQGFLWWGCTGGRQQGDIGEVIMTAAYQLVLDAENLLGVVQIENIMVFAEAYDIALDITFPKGAEGGLDFGIVRVTEEAKQPLQLKNRGKYEIAFSFSVDSVGISTPNINSMISVQPKKGSLTPTEKPRNVQVFFHAKKEVKIEHQPVLRCQIIEPNISEGGEIIASIPIKFSANAVYSKYNITPSSVINFGALICGTRKSTTFTIENQGVTDFKFALYKLTGESPIHQKKA

SEQ ID NO: 925157 - protein, 147 aa, Homo sapiens
MDMKTNEVIFKKYVMSTETYYFGPLLCGKSRDKYKSSLFPGNMETLTILNTSLMVVEASFYFQNDVKANTYFLEPNTMVLKPNEKQILNVWAYPTSVGVFEDSIVCCINDNPEPAIFQLSCQGIRPELELEPRQLHFDRLLLHRSEF

SEQ ID NO: 925158 - protein, 263 aa, Homo sapiens
MSQPGIDIDESRHRTDPLPQDSSCDPFVATPFPFPQATPPHPLESNTFLCVYHFVISGMFPIDIFFTPKQQGDVNFNLICNVEKKVHPVTLNVKAEGYTMNVEIKCKDRTGSITLLTPNQTNIINFYEVELNECVQCEFNFINTGKFTFSFQAQLCGSKTLLQYLEFSPIDSTVDVGQSVHATLSFQPLKKCVLTDLELIIKEQTRSSFKNLKGETGKKIFMGGSEKLQHIPWNLDSHACVRCVYLQAVTAQERPEKALSSYL

SEQ ID NO: 925159 - protein, 166 aa, Homo sapiens
MCGEEKEGEGGSRDDAGGDGGGGGDGGGGGGGGGGGGGGGVVVVAAVAAAAAVWWCGDVVVMVVVVVVVVAVVAVVAVLWWCGGGGSGGSGGGCGGGGYDVVVVVVMVVVVMVVVAVVVVMIVVVLVVMVVVVVVIVVVVVVIMVAARMMKTVMLMVKVVMICWWS

SEQ ID NO: 925160 - protein, 351 aa, Homo sapiens
MKTTPKAKMGKENTHINIVIIGHVDSGKSTSTAHLIYECGGIDKRTIVKFEKEAAEMGKGSFKYAWDLDRLKAEHECGITIDISLWNFETSQCYVTIIDAPGHRDFIKNMITGTSQADCAVLIVAAGVGEFEAGISNGTTLLEVLDCILPPTCLIDKPLRLPFQDVYKIGGIGTVPVGRMDTGVLKPSMEVTFALVSVTTEVNCVEKHHEALSEALPGHNVGFNVKNMSVKEIRHSNDAGQISVDYAPVLDCHTAHIACKFAKLKEKIDLHSGKNLEDGPKFLKSGDAAIVDMVPRKLMCIESFSDYSPLGRFAIRDMRQTVAVGVIKSVDKKAAEAGKVTKSAQKAQKAK

SEQ ID NO: 925161 - protein, 146 aa, Homo sapiens
MPQTQGYFVSLAVHGNGGVGFPGHRKLSPGQRTVHRPPFPGSTDAGHRASPLSFGLHQEFRLFQHKSQRLAVSHKPISPESFSATRETRLGLTEWRLKAGDGVSTFLYHVRCGTQSRIEVNSRLPSAEFASSANEKRWYWIQREEA

SEQ ID NO: 925162 - protein, 165 aa, Homo sapiens
MNGKMGDLGFFGSQGQKELYGHLVQLLLPKPSAECLIMSCLAFSNSGKEFGTPDFPVLELSGSIGKGSSPSPEATLPCIVKKLSGLQAKHLRGDFDVLKAFSCKRETEHKSLENLQTDNAIEKKNPFSEEKFKLEAEICISNKEPNYNLQDNGEKVSRACQRPLR

SEQ ID NO: 925163 - protein, 149 aa, Homo sapiens
MRSRKELHPTQMQKRPTRISLPVQQSRGSDGPLMRELVYSKPRERPHAEPRCLSQQLTPAARHVTGKFKAFEFMKEEDFSRTILGGRESAQQRAPSTRKTEAAAPPRGQQGGAAAGVLSSGGELSFLQQAFIEHLLDRDAYTEGREREQ

SEQ ID NO: 925164 - protein, 165 aa, Homo sapiens
MIFLFLFFHPVLPSTLIISRHPQPSEFGEEEEKGKPEKLTTWKQKNEQEADEQMGVIFKKRQQKVVGGECYRQESSGATGIPSLAMANRAELKFYCLTADVSVGHYSQYRETTLYTKLLVLENKLMVNLHKSVQLLLDDRSLYTLPLGMFHKNMEEQISSLLRTP

SEQ ID NO: 925165 - protein, 155 aa, Homo sapiens
MDTKIFLGNSHAGNNCRNITFSGPPAAGLMEFAGGPLQTLFAWVSPAEAAEQAVRQGRLSLQMFLLPFVHLCPAHRGGTIEAVGLAELQLAPPSSSFLATLFTYSSLSNGRRPFPLLGCSFAGRSQTAALAVSKAPWAWDPQSQAQERISWSAHC

SEQ ID NO: 925166 - protein, 154 aa, Homo sapiens
MLQVHYPWHLVLLSTPVFCCQEGFSSRLPTNLFDDLSWLLCNGMSPLSTHPLKTAYLKKDDLGLESIKSGGKPFFSMFGLQQVGWVARETFFTDHCLLVSSASLRDALWLCMQKAPSDLKFIMLEVSYHQRGTFQAVHRRVQSKVAGTWGVGGG

SEQ ID NO: 925167 - protein, 203 aa, Homo sapiens
MQAAELMSTSEFKKAKGWLVLITGDKDDTGNDDGMGFIKRALTVMVNTECQLDWIEGCKVLILGVSNISSPCYLWQRRHRALTEWRKKSFKDCCWGQAAILLGAVHLLGGANSGPCLCLPPHLPFLPPAVLCSQHSASPAVSVPGGAETPSPSYVSISHSPGERYDKIPSPQCPGNPTPVSHVYFLPTLGHAVNVIKMPYLSE

SEQ ID NO: 925168 - protein, 135 aa, Homo sapiens
MLMRPLSTFPSRTNGNSRKVNTALPEPPEAICYNVVWNAVVISGKYFKDRWQIKPDTSNQQLQLPAHLRMNLHLQKVYKRDKEPGNLKMLHGEVRKLFGPKVMVRETRDYCFRGGTNADDDRKVHDEIQVEANLH

SEQ ID NO: 925169 - protein, 147 aa, Homo sapiens
MSQVSVSIGVLQLGRCSSDIFICPHLPWAILSGPRDSCYMMYVSDRFPVHASSRQGRDWAPSGCENQGLVTVMSQCHIGTPHGQLAPSQHGGLVPRSSVPRGEDGTFRSFKTWSCSYTSPSYHIVLVIRGHRANPDLRQGSTDSTSP

SEQ ID NO: 925170 - protein, 165 aa, Homo sapiens
MLQDHSVNHPCPIEGYNLMEAGTESFIMSCGHRHQSGREELDLGLKKFMMRSQRRLGSAAVGEGKVRGEEKGGPAGKSGGLHPEVYIRRSTSGGLHPEVYIRRMMWLGKTQFFLCFYLTTVNPEEVCDPTCGFSPTHQASKQASNSAVDTNCTTTNSILTPSTWR

SEQ ID NO: 925171 - protein, 225 aa, Homo sapiens
MPKRKAEGDAKGDKAKVKDEPQRRSARLSAKPAPPKPEPKTKKAPAKKGEKVPKGKKGKADAGKEGNNPAENGDAKTDQAQKAEEQAKLYKDFKLIPIEMSQIREPRPGPQEGELGPSLVPHFWELLNDLYPSLSLVLPGAGSGGALCLGFRFSSSAHSCYLKSLPNPSNMPKAGSPALNGTGLAGPTATSITSIAMVLPSVCSVDTHRHTSSIEVRREHVNCFS

SEQ ID NO: 925172 - protein, 176 aa, Homo sapiens
MGHTVCEDYCQLASATGSRLPTKLEALKVGSQNVEHGNDKVVEEELVPKIKWVLLDRKIRESRCWARKYKRYSQQQQNNNNNNNSEKMLRCLEAWKLRPISRAYYEISTSIKSASMVPNSQSWQPSPFLSQTYRFLSELLTLMMDEGTGEQESRGSPLRPLGQKQGLPIARLARED

SEQ ID NO: 925173 - protein, 182 aa, Homo sapiens
MFYISGYQAGGAEGLSYSTPIESGEGRSVKLKAMRARTRNLGPSAADMLEFAGGPLQPCLPRYHQRNLQNNKDCCLFLLLEASSQRGTRLMPTEALLYEVSVDRCWEPSPSQEAQGASRWESLSPLKLRPQAPCPPGALSQGDGSFIYKPLTGAADFLLEMPCPERRNLERQSGYSSFAELW

SEQ ID NO: 925174 - protein, 138 aa, Homo sapiens
MGDVEKSKKIFVQKCAQCHTVEKGGKHKTGPNLFGWKTGQAIGFSYTDTSKNKGITWGEDTLMEYLENPKKYIPGTKMIFAGIKKEAERADLIAYLKKATNDQFQEREWVKTILVHKRFWRIYICILERSYWLQQETS

SEQ ID NO: 925175 - protein, 134 aa, Homo sapiens
MDEPGSRIQKGLKASAASWALRISADGTQDFPLFPCLAGSRVGVSAGIQEGPLLHLNRYQWPYMPLAWRCNHRSIPNWPYSVDNRTFTVRTKKIDMSRAQEKNLNAGTLSEEKVPLSPSQKGSVGQENPVLKFA

SEQ ID NO: 925176 - protein, 148 aa, Homo sapiens
MVKMKEKTFKNIDLKLPARLLVTAIYKKVSNSHKALSIAPGPQALKKEGLRDPQDSTRCSGCWGHKPLSARKSPDPTQTSGGEAFVMQRGPDEKPLSCEQQLTMFSDLFTIVIIVAVQEHLEAAISGLNIVMLRLATGQVGFGRGWPS

SEQ ID NO: 925177 - protein, 206 aa, Homo sapiens
MAPSPIDHPRAEECGTRFTPEASETTNPPGGMNNSRRTALRAVTLTTKVCSFTPEPGRPRTHQKEETPNTSEHQKEQTLDTPPLRTVTLTTRVRGFILEVRVALEFANIQFCRGGSCWLNNGDKTGNLSTQVADTLAYNDSLKMIFPQALRRITGLFWEGKLAKFKVKDEHLQPQEEAEDCHEDRKGTVCHQMEKTSHVLHIFFTS

SEQ ID NO: 925178 - protein, 136 aa, Homo sapiens
MFTAEQQEGHWTGRHDQIMKGLRGKGNGEPVEIVERGKTWSLGRHLSKDEGFELTAQQSIDGRTYPGTLSSPWVSDGGCHHCESDAGGRPHCGVDETVNLLVDELKAMNWDLGEKGWKKGDIKDAEERKEEGARHP

SEQ ID NO: 925179 - protein, 156 aa, Homo sapiens
MVTGFQILVKLEDNCHSRTYLARRVYPGVSPMKFSCHLHCLVGSGAEIEGSRLVADCNKALVFAALLWEKKDETDLTVAMPLQALQFSVHLIDLLSILLRCNRFPGIQKAVVDQTGSRPANSKVQSALELLLSSTIELVVFSCHMTSTFHCMSQSD

SEQ ID NO: 925180 - protein, 133 aa, Homo sapiens
MSEPDIDVDTVRMGSTRAPGPLAIVPAVLQPREARYVHVSCPFYRRWSSGLGDRLTVFGTNSTPAFFHLATLFTRSRQQHGGSVLQEDWGSPPSTTTAIEPSAQETEACDSNSSLFALEPWLSLRSIRAPGGC

SEQ ID NO: 925181 - protein, 218 aa, Homo sapiens
MGMMAVMVMMVVMMVLVMVMMVDGDGGDDGDDGDGDDGDGDEDGDNVSDDGDGDGGGDGGDGDCDDSDDDGGDDGYGDDDDGYGDDDDGDDGNDDSDGDVMVVMVMMVMMVAMVVMIIMMVMVVVMMVMMVIDGDDGDNGNDDSDDGNGGDGGDDSDGDDGVGGDDGDDYNDYNDGDGGDDDGDSDDDGSDDGDDSDDDEDYENGDDGSDNDSDNCYM

SEQ ID NO: 925182 - protein, 203 aa, Homo sapiens
MGIGCINSLAGLVADGRDSGTTEKAGALPRRRQRPKNGLLQPDDHMSSLAVNTLPWAVICLQLPARGVVGGDVYTWGPGHSECGPQTSSISTTIEMQSLGPLTDFLDQNLHSNKSPGDSDACGQGREGTEQRRMDAGERPHKEGSANRNLTGCPNTSEDAGHPHISEDAGCPHTGKDAECSHTGENAGWTPSHRQGCWTPSHW

SEQ ID NO: 925183 - protein, 139 aa, Homo sapiens [sequence omitted]

SEQ ID NO: 925184 - protein, 163 aa, Homo sapiens
MPLEGFKKTFAPKDWKRPSAGDGLNRLRTPPPPRPLWEQRQARLGGRRFEAAGPCFLLAGGWGPCQVTAPARVAASYYDLSPGLLPAPCWRRLVQARASLTPARCFRTQSCPALRGISSSGQNAGEGFGGEVVFCRGPYNPPIFLLPVSKWLTLPPLQGPSMM

SEQ ID NO: 925185 - protein, 127 aa, Homo sapiens
MELPEPRPRLTGSALCLTQEESSEENCCARGFAVVSAGAVGIPKTWTEEAERMESKHSDPVVTPPGSTQQRRDTEQGPPGLAASRKTALLAFPCMRVKRLQRAHRPPSKPEVSNPRATAEGEQQGSH

SEQ ID NO: 925186 - protein, 128 aa, Homo sapiens
MTRTPRLLSTGWWAEAAVIPGCCYPAAPALFVVILLHYSPFSITKCDQEEAGEAVYPWFPAVEPMAGPDGGHLRNRHVVHNILNPQRSLGSCAVIITRMNTSFRPALAPSRLRWNAPHPVSLLMVSSS

SEQ ID NO: 925187 - protein, 138 aa, Homo sapiens
METSKCSPEKKVSESGSLVDSEAVAPQHLLFWKPENYFLIDKGGSPVHHRSPIVDCMSVAATSYYNQNCVSKLPQDAEAAPDDNRKGLTEVEKHQQEDWVHHHSNKWTHGEPPYYLRGGKTLRLQEGFIPNNYIANQD

SEQ ID NO: 925188 - protein, 141 aa, Homo sapiens
MVPFSLGRLLERGWFYEGGARADGDSLEHAQEAGGADGEAPHHPVHAEECLTLEVILKIQHQMKFWYFHSTSLFPRPSPEKSATQTILLLVSIFVVIYWVDFIILFTSTLLWAYDPVVLGVQRLVGNVYATNIYCAFTFGD

SEQ ID NO: 925189 - protein, 142 aa, Homo sapiens
MEPGHLCAPSSEIHGWLCRGDVRVGHMPTAVTLHCTHQGSGARLTSDSPGAQLLCLHPGILAAAQCSSEITALRRILLLLLWEKNVGGQCARHLPASTAPPEGALPSLEQASSTAALLPCDDFSRGLGPCCETSPHRPMICP

SEQ ID NO: 925190 - protein, 137 aa, Homo sapiens
MLAPNSLMSQEICHLKVLTGWLWMSNLSASHTEPEAGVVAPLNGCKPVQSFDSAYTFHMSNKARTCFKKFFLSKKQLINCGTPEQKRFSISMAKCQRGEKSRILLALSWQLSLELILLYLEFPSCKLYSGSIDKIIV

SEQ ID NO: 925191 - protein, 136 aa, Homo sapiens
MGCPPFWGPDKTDTIILNGNVNSIEFMTAEGPECFWPLDFSYAPPAVTIAEEDVIVPRSFPVSRPCRSGRAISCPLACCPQPRLAPGKCVRASWWEPQQPSWRSCLSMPAFPWPLGSPTVHYGPRAALLTLPVKGM

SEQ ID NO: 925192 - protein, 149 aa, Homo sapiens
MWKVGPVFHLSALPPGAVAPAIEPGHEVWHPQTAVAHLCDGEQVQQPSVDMHAGHLGEGCDTWAGGRKRAPWSSGNASAWEGTGYLADRQRESPFPWESWGRLCSTTSCGRPDMSQARPQSSRGLNLFLWCCASAVTLLVHFHVPPSAN

SEQ ID NO: 925193 - protein, 145 aa, Homo sapiens
MAPQGGSSQPARRAEGSTVVSQGQGDSRNKRWLWIPLAPWVDGAGAGTGPSACGPALGPAGGPGGIHSHLQWAFQETSVDRALETPFPAGTFVRLEFKLLKTRCRKKNWKKPECKVQPKGSKRKCLACVKLGSEDKVAAWMVTAL

SEQ ID NO: 925194 - protein, 153 aa, Homo sapiens
MSARSAGFHYLCEFIENIFNVIMFLLQLRTFSINILNLRLWLSIPFVLEIRFLWCNSIACNNIYENYKHQHTISILYSVAYVCLPKLKLNQSFHSYTILPQALSFLPPHLLQHHPTFVAVSNFRMNRCRSTISLESSFTSNLLTMSSNCIFIF

SEQ ID NO: 925195 - protein, 151 aa, Homo sapiens
MPTELWAEVKEPGNVSFSKLTLVCAWFSPLPPALSTLFPGARRFSKVPCPLPGPGSSPVAHSHPSTLLWPILSPHWVSHTTTPPPYCPRSPSLVLALSLFPDCFSISILNLPAPVGCPPIPGPRQNQQNYLKWEYLNSTEFVKAETHLVIF

SEQ ID NO: 925196 - protein, 169 aa, Homo sapiens
MPRQGHQRAPWSSRNASVWEDAIAKRTWCSGSICVKEKHPLLSRPGKGVSLSPGEFREDSTPPPLVPAVIRRPILLPVMLCFSGRNPTDPVGLLPTVQSCPERASGQDKVTAQGRDRTMGSLLPAQPPSYVLLLLPQVGLGHNTAPPPFSGWVGFVRLRSGPWANSDPL

SEQ ID NO: 925197 - protein, 147 aa, Homo sapiens
MPGKSLHHSPFLINQGYNALRRATGTFVQESLCIVQDQVGMGSLDGLVSQETLVMQFPADSTLPIAKSIFSLLQLLGQRGPMGSSAGHFKVREMQKKRIKLSLCPSVLLPPANLPPLSLVSLRCLAVPWALLSSGFQPTLSSSTSCL

SEQ ID NO: 925198 - protein, 183 aa, Homo sapiens [sequence omitted]

SEQ ID NO: 925199 - protein, 135 aa, Homo sapiens
MRRRCEQVTLPGPSFLGAFSVSASETVDANVSIPNVNLPHGEKQMPRSPTMLGHGTMDILDWKIIVGMSCALQDAEQYPSCLRFRCQGCQGPVGDQYRIYCYNQYRLFTGQFDAVYHNLKWASCLTCQFYSSDAL

SEQ ID NO: 925200 - protein, 213 aa, Homo sapiens
MQVAMPHLSPIMQARGPPPCQGPNGSYNLEVKCSRELLELMHDSCIQAAKVRLGPACCGSEEQTLEQERWMRRVRSTCSRKRRDEDSPGVEKNKEILKMFIGLAVEGWPHTLLTLLLPYLPWMHVSATCRLEAKDVGQHSWEQTEMAQATGPGCPLENAAWKVHADVAAENQHPFDHEKVPCLLFTFHHDCKFRKASPAMLNWILNITSNFIS

SEQ ID NO: 925201 - protein, 272 aa, Homo sapiens
MPDSRAPPGVSLWDKLLLLHRVPRDDCSFAALYTRAAARGELLVLTLETGSTSGPSDLGVLLPDALFGRTEAEHLGVPGRRCPGGPTSVESQRSSGYANPVFNSDTVLKVADLPHGPRMPPDFTDNREGEDLQDAILDFLQIKTTGIKQGHVCLYNDDNDNCNDDGDGGGDDESDKDDGDNDKHEDEGDDSDEDGDGGDEDGDDGGDGGDDDGEGDDGDEDGDDGGEGDDGDDEDDDAGGDGVTMIMVVVRVMMVMVMMMLMMVVMMMVIIR

SEQ ID NO: 925202 - protein, 117 aa, Homo sapiens
MGHLCTWLELVHLQRSVVKQSDVDGDHEAVPGITVKANSLRACLSTTFFVKYSLCAADVEDRKMYIDNSARDQGAAPGGVLSQMFPSTGMASRSHIMGQSPGPQLGLSCDGVRDWHF

SEQ ID NO: 925203 - protein, 261 aa, Homo sapiens
MVVRALSCEFRQQIPCSHCSYRLCDYRLYDRRWYYDCSHCSYRLCDYRLYDRRWYYDCSHCSYRLCDYRLYDRRWYYDCSHCSYRLCDYRLYDRRWYYDCSHCSYRLCDYRLCDRRWYYDCSHCSYRLCDYRLCDRRWYYDCSHCSYRLCDYRLCDRRWYYDCSHCSCRLCDYRLCDRRWYYDCSHCSYRLCDYRLCDRRWYYDCSHCSYRLCDYRLCDRRWYYDCSHCSYRLCDYRLCDRRWYYDCSHCSCRLCDYRLYD

SEQ ID NO: 925204 - protein, 146 aa, Homo sapiens
MLVTTSGWGLETGLGKTVIPDSCACSARARPRDSAKEQLRSGRACSSEGPGEAAAEWAWGNHLLPTFRLAGLAPNTRNFSPAKRRRWWEGSLTADISPILTSRLESLLHCPRCILWYDCAITDPLSHGGAPAWFPDFGCHCGTCMS

SEQ ID NO: 925205 - protein, 224 aa, Homo sapiens
MKDKEMSASSRREKPSPVEHRSVHLSRETGTSGPNGSYNLEVKCSRELLELMHDSCIQAAKVRLGPACCGSEEQTLEQERWMRRVRSTCSRKRRDEDSPGVEKNKEILKMFIGLAVEGWPHTLLTLLLPYLPWMHVSATCRLEAKDVGQHSWEQTEMAQATGPGCPLENAAWKVHADVAAENQHPFDHEKVPCLLFTFHHDCKFRKASPAMLNWILNITSNFIS

SEQ ID NO: 925206 - protein, 168 aa, Homo sapiens
MLFLFPFSQAGAAPAGVVPASVGSPQGSTAPARWPPGLCPQVPTYRPGHTDVGGSFETPTPKNTYTQKHLRPKTPTIKNTYTQKHNQNTCNQKHLHPKTPTIKNTYTQKHLHPKTPAPKNTYTQKHLHPKIPTPKNTCNQNHLHPKTPAPRRIPSVGRAGARLTLGPG

SEQ ID NO: 925207 - protein, 239 aa, Homo sapiens [sequence omitted]

SEQ ID NO: 925208 - protein, 144 aa, Homo sapiens
MSRGQNKFIDQKEEEEEEEEEEGGGEEKEEEEEEEEEEEEEEEEEEEEEEEEEGEEEGEGEGEGEEERRRRRRKGRERGKKENKKRRRKRRRRKKEEEEEREKKKENNEERRRRGKEFLTFFFSVWNLAAVLKELLFNVPNFNE

SEQ ID NO: 925209 - protein, 155 aa, Homo sapiens
MSWLSLLRKFRPQNIDKDEGKPGLQTKNLGTVEKESSTKSKAEKVKRCFREVGGSVGVKEEPTRKSTESSPLIPQAPGTCPAYTPSTDSKIFLSSAPRLLCCIEQLIHQLWPISPQKTQVCPEIQGHDPCLTTGFFRSNAYMHTCVSSEHCSSHS

SEQ ID NO: 925210 - protein, 153 aa, Homo sapiens
MNPPAQLCCVQMFTGLAGILNRHSKNPGGFWADNGITYVSGESWMEVEFEGADKEFRFGPADFKYVVDNGIWRASAKKNGPYILEMSCNCNHTVFTLYDSIYMKPRKDTSIVTVDQGYQGLEVGVLWGGCLTGKRHKESFGMMKIFYIFFLWR

SEQ ID NO: 925211 - protein, 184 aa, Homo sapiens
MQADLTEAVETASSEGLHVNAEIEVLQQALLYMKTMQEKRETLQKDQEKLEEELVNLKSHMEMNMLECGQLEHYKQESQKIAHDQLQLKEESNATMKSQMELRIKDLEFKLYKARTSQADCNTTELEKYKELYLEELKLRESLSDELNKSQQNTYSKRSLKNSYLKLIVFKYQNGERLVKDVND

SEQ ID NO: 925212 - protein, 134 aa, Homo sapiens
MGGQAETLPSSQYPLLDFLALALPVSPVPHIKLLLFGGRGCGRDTVTARDNSQHQEEPECVGFYQTSPPQSFPKHTQRIPDAARTLPPLESSGPSIPLVAAPVITDFLPFTEPNLSTGFQEEEAWSVPLPGKAP

SEQ ID NO: 925213 - protein, 175 aa, Homo sapiens
MHSLITEYLEDAGHGGKCGEAHSERIRHRLSPSRGLYLHFKLGFFNPKKALRSKNAAQMVDFSGTYHTRLQLSVCVYHQTVEPIPIHLCSSCLWHIVPYQRHEVNIYQMYKDVHNSTLVTHTHIIVIITIIIVVVIIVIYCIHMEKAGPSSAPLRGAWHEYLLLQHAKKEGFIKP

SEQ ID NO: 925214 - protein, 180 aa, Homo sapiens
MDWQPTGLWGMAAPHEHGPSHCTEEVGGGERQFSEKRKRRRRKEEEEEEEEEKRKKKKKKEEEEEEEEEEEEEEEEEKKKKKKKKKKKKKKKKKKKKKKKKKKKKQTNKRATVQKSNVGLLPSEQSPFSLSPNCSRVQLGMGKLEGVGLELVGVFSIMTDPAEKEADKGKPDQAWGKREF

SEQ ID NO: 925215 - protein, 549 aa, Homo sapiens
MKLAWGAAPRGPPPCIHSVLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPGESPYLTQLPDSLAWPQELKGPGRGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIDGKGVLRAWSPERGQLLTPFPGEGPGREHMGAASAGKRGQKGSWQQTPGSEWANLDYPGPGLTYKTAKDSFRWATGEHQAFTSFAFGQPDNHGFGNCVELQASAAFNWNDQRCKTRNRYICQFEDALLMALYLWAPEPRGAMTGPASYSKATQEGLELQLCRGFLQGPSPVMKAASWEPVGFLGVPGSPMNCGGGGDPVGQRSFPVA

SEQ ID NO: 925216 - protein, 172 aa, Homo sapiens
MVTWMKRDTNYLLHMGGEGVSWAVAARTNITYKILYNDAPENYAQVKLPDGVTVHHRSELDVIQRDLRVIPGVTVLVYDQTCAAEKRRRRKKNKPGKTVFPDPARRMVINPAVCEGCGDCGVQSNCLSILPLETEFGRKRQIEQSSCNKDYSCVEGFCPSFVSVLGGSLRNY

SEQ ID NO: 925217 - protein, 167 aa, Homo sapiens
MVRPPLVHRQHQEKQGLAESRCLENGEGKQTPETWHCVLHIVHPGKHKQAEFMEGKACMAGRLLISPPFVGVHCQPGRGLEDSACGSGLSDNTVLKPVSLSPSGMRGLSSSNPTYGTICVPDHVNRPLDSHSSIVANCPLLHTNAQGCGTLQRTLLPLGISLSKQDL

SEQ ID NO: 925218 - protein, 148 aa, Homo sapiens [sequence omitted]

SEQ ID NO: 925219 - protein, 142 aa, Homo sapiens
MYIFGELSSNSHGRSLGVIFKMEYVALSLSERTRKFLWCHKTSLNAEKTMNTAPRGQTWCLYTLNAGAWIYSLRRQLHHYFKAFTSTDITKGLAVTQEGQKCCGDIDGTVYMEHFLQAWFHLSLPQTGRWMTTESLILPDVR

SEQ ID NO: 925220 - protein, 143 aa, Homo sapiens
MLSGSQGLASKPSAIYLMFSCTAAKLAHKPQYKLLSTLSSPFHGHWSLILWPSPPLNSPLRVVDSPLAQCRCRNAVQKPTPKLGDLKSLLIALTRCGQAAKNLISSIALVPIIKKLNCCTIFLFCFMKNSFMYHFNAIVIVSR

SEQ ID NO: 925221 - protein, 173 aa, Homo sapiens
MLSCWPQESGVQNGGLDTAGGDMKKAVLSLPKKKEDKWSYVKTVFRNKKSKLKKRKGDKRNKHKKKTIHLSLWESSGSQSKAEESDLRKDSSQELGQVGDLRELITLGIALKTSIRSLEKAKRRRLTNYTTWDSRNSTVGSSFSFLFASYIPTLRGEEASKSEMPFSTEEKIL

SEQ ID NO: 925222 - protein, 143 aa, Homo sapiens
MNFICKPTSRQSLPSNYPLYLVLPHQTSMSPALSQPRVRYQRTSTSIITIQENMTSPNELNKPPGTNPGETEICDLSDKEFKIAVLKKLNEAQDSTEKEFRILSDKCNKDIKIIKKNQAEFLKLKDAIGILKDASEFFNSRTD

SEQ ID NO: 925223 - protein, 136 aa, Homo sapiens
MADECVFLDFVHHGNQDLRAAAALHGLQVAADERIGLHLVPPSVEDSWLQLVVPAHRALVLVVDNDLLAPGPQLPQRQHLLLYKYQLIWSELTNARWIAFWGKSTLGSTSWSSSRECGGRGMAQTEKAKKLQGPPW

SEQ ID NO: 925224 - protein, 179 aa, Homo sapiens
MEMMLDKKQILAIFLFVFKMGCKAAETTCNINNAFGPGTANACTVQMLFKKFWKGDKSLEDEAHSGRPSEVDKDQLRGITKADPLTTTGEFAEELKVDHSKVVEHLKQIGKGKNKKNLQWLHPDEAPKHFPKSNLHQKKVMVTVWWSAASLIHYSFLNSGETITSENYVQQIDKMHQKL

SEQ ID NO: 925225 - protein, 179 aa, Homo sapiens
MAHMNILTDALKGINDAEKRGKCQFLIRLCSKVIIRFLTLMMKHGYTGKSEIIDGHRAGKIVVTLTGRLNKCGMISPRVDAIEEHLLLAHGAVGIIQFRRGGGKGVQGFPAACKMKGHSLLSLANSPSSIFKVTNSKSTFFKPAKRIGKGTLELRAVCTNESPDTVPSDGHGRIPSIKH

SEQ ID NO: 925226 - protein, 126 aa, Homo sapiens
MWTGVTLGLAAMWTGVSSGLTAMWIGVSLGLSAMWTGVSLGLTAMWTGVSLGLSAMWIGVSLGLAAMWIGVSLGEIRCQLTSGKASGILSQHISSDGILVSSQVSSESSVFPLGFLSDSCFLKQFW

SEQ ID NO: 925227 - protein, 165 aa, Homo sapiens
MSGWGAWLLLLGRGAAALFRREPDAGCSEGGHAGTGEHDRAKAGGAFGPCKAIALLTLSRQPAGHGRRLHGFSTARLAGLGVRGEWEPGAYGAKQPEITQQAWQAWLGLTLARLSGLLRTLRPCHLPAFPPPLKVSDQPSLQHSSEPFRIKSILYPPTPHPPSSQ

SEQ ID NO: 925228 - protein, 190 aa, Homo sapiens
MSVTWINDITAQKVYLGMNAGSHWTLPLLQRVRRSHWHEEGSSDVTCSKEPPQTTLAPLTLSSSEAPCFHKSTPRWWALESMLVPTVRRWPPGALQGLNEVTGGGMCHVANHVACRIDFILLKRPPTFLFRSDTARLSIAVLGSGDIGKQMTYWSVTLSQKRRGLGTGDRRPGSELPRSPRLRDLAKPCV

SEQ ID NO: 925229 - protein, 223 aa, Homo sapiens
MAEGPEEGSVTLWGLPKLMTHEFRSSPKTAAAAAIGCGVICYMAIVTAVRQHWAGMVTRAENASSASPLPMIETDNVSSTSPLPVTGANASSSSPLPVIETENVSSFSPLPVIGANASGSSPLPVIETDKVSSSSPLPVTGANASSSSPLPVIETDKGLAYMRGSVKFSQVVERLEARKHSLLRTDVAPAMTVRVTGTGIQADQYRQYKSCIWVEKIIQTVLL

SEQ ID NO: 925230 - protein, 143 aa, Homo sapiens
MSNTPGMTLCCWHSTLRASQASDGDGSEGCGDDGRSSHWWHLFCARRSSEPCTWMDPLTARGLHDTPQNPPPGNAIAPLGPDPRWQSSTSLVVFPLGFLSSGQTLDTVPQGPSLTQLRSVSVADPACRDAHVPAKKSFILIDF

SEQ ID NO: 925231 - protein, 149 aa, Homo sapiens
MRRFMWGRGQDTITYSCKWELAARQGHAGGCTQGWVTVSGCSQQLICGQRSVLNQVLWAPVDQFEKFCGLQSIGLSLAVRYLALGRQWNINEIFTFSFSYEAFEIQCVTYSEGMSQFQLCFRCSEATEDKHIQEPQGFKIGQIIKGSIS

SEQ ID NO: 925232 - protein, 141 aa, Homo sapiens
MYTPSATIKDLKDAGVVILITSPFNSPIWPVQKTDGSWRMTVDYCKLNKVVIPIAAAVPDVVSLLKQINMSPGTWYATINLADAFFSIHVHKAHQKQFALSWQETDLGLLLGLSIIETECLIMGHQVSMRPELPIMEKVPI

SEQ ID NO: 925233 - protein, 156 aa, Homo sapiens
MHRAHGRVLHPRQGRHCLCGCAWRGLGKHFGPFGKEDKHPHVSMDLSAKKGPEKENFVGSETGVGKGKRVLLGYQSLGPGIASLPSPQPETEPPRSLVESMGPDIKALLRLAGLEEKGPKIIKPHMDRAEIPEWPLEENTAVDKDGHGPGSHETHS

SEQ ID NO: 925234 - protein, 227 aa, Homo sapiens
MSCPLQFGELLGQLGCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLAENVVRHLLTMCLAFLSDHAQGTSCWPKVNLVPP

SEQ ID NO: 925235 - protein, 157 aa, Homo sapiens
MWRWGSCCLCLLTPTLCSAHSRLGCPQESRCPYQPCAPGYDYDGKSEPREVKEFDQGHTASKHSTGTRIVDSFFCSCCYLFHGWKMGGDHSILMLCGQLSGCGCKKDALRPGFEGIYRHMELLEGSSACPLEWFSEVDDAAEAEMLQLSFQVPVENP

SEQ ID NO: 925236 - protein, 145 aa, Homo sapiens
MDLCREIREDLTGKNDMNRVLKEGRESVMWMDIWKKRIPGTRSSKCKGPEAGTYLACCRRARTPVKPESSVLEREVDQTPEKGGLGEGVYTMSGLSGHCKVFLYKKAGKVDRFFTHFHCSHLFFYSTYIHCSSHSVPDSVLIPVP

SEQ ID NO: 925237 - protein, 126 aa, Homo sapiens
MGAVCRTGIPEYMLGTHWQGQMVEPYLIYVHLLLGPVGSPRYVPMTMTGEQEGKPNHTSTFQASAGITMANITLAKAVIPVTTRGMGYTVGPLAFNGKSRKLGLGLSDFEEGKWSDTAHNVQINGN

SEQ ID NO: 925238 - protein, 150 aa, Homo sapiens [sequence omitted]

SEQ ID NO: 925239 - protein, 134 aa, Homo sapiens
MSGSSVDRELSGQWTNFVVVIYVCTVLYTKSLVANNSDGHLCTQGKQSNSVKKQKGLFCPQKHCPYGFDGVCPICELLGHSTYLVTVIGSDWATQPPTKENQRFCDSVAPITGTIYLLLVLPPSVDTAFILEVY

SEQ ID NO: 925240 - protein, 172 aa, Homo sapiens
MVTLKVLLTLGQDTDGHRSGCLLCAPHAGVVTQGGEYVLCTVLIQGWGTCRGGAGWLCAHQISVYNGVWPAVAWSGLYYHTPEGQEKKNPLTQTRASKAMWGVAVVLGDHMLQYGKGVCGLVRGHRGHHAGEASRPRGAQVKLALCDGQDHPAEFRSDSSPRSKVSYGTGAS

SEQ ID NO: 925241 - protein, 410 aa, Homo sapiens
MNTKGIIIEWNRMESSNGIKRNHHRMESNGIIIEWNRKESSSNEFEYSNGIIIEWNRMESSNGLEWNHHQMELNGIMECTRMESSSNGIEWNHRMDSNGIIEWIHQMDSNGIIIEWYRMESSNGIKWNHHGMKSNEIIEWSRMENHHQVESNSIIEWTRKESLNGLKWNHHRMEPNGIIKWTRMEPSSNGIKGYHRMDLNGIIEWPRIESSLNGIEWNHLMDAKGIIEWTQKESSPSGIEKETNGIIKWTRMESLSNGIEWSPRMQSNGIINEWKRVIEGNHQMDLNGIIKWPRMQSLSNEIEWNHRTDSNRIIQWTQKESSNGLERNHHHIELNGTIKWTQMESSSKSNGIILEWNQMETSNGLEWNHHRMKSNGIIEFNRMESFNGLEWNHHRMECNGIIEERIPVIQ

SEQ ID NO: 925242 - protein, 169 aa, Homo sapiens
MESLNGTERNHRLNSNGIIIKWNRMESSKGVEWNNRTDSNGNSIEWNRTESFNMESNGIITEQNRMESSNGLQWNNRMDSNGIIEWNRTESSNALEWNHHQMESDGINEGTQMESSNGLEWDHQGMESNGIIEWNRMESLSNEIEYKHRMESNGIIEWNQTESSLNGIE

SEQ ID NO: 925243 - protein, 702 aa, Homo sapiens
MESNGIISKWNRKETLGNKIEWNHQMEWNGIIKERNQRESSNEIEWNHLTESNGIIIKWTRMELSSNGREWNHRMDMNGIIIKWNRMESKKGLEKDHRMDTNGIIIEWNRMESLNGFDWNHHRMESNMIIIKRNPIIIEWTRMESPSNGIIIEWNQMESSLNGIKWNHRIESNGIIIKRNRMEPSNEIEWNHHRMEANGVIIEWNLLESSVKRIEWNHRMVSNGIINNGIIIIWNLQMDPNGIIEWTRVESSSYGVFEWARMESSSNGIEWNHQMDSNGIINRMESSNELEWNHHRMDSNGIIEWIRMESSLNGIQWNHRMESSLSGIEWNHRMDSNGIIMELTRMELSYNGFKWNYRMDLNGIIEWTRMESSSNGLKWNDRMDSNGIINWTQMELSNGLKWKYRMDSNGIIIKWNQMESLKGIKQNHRMESIRINHRMKLNGIIIEWNLMESSPNGIEWNDQQMESHGIIEWKLMESSSHGTEWSHHGMESNGIIIQWNRMGIIEWELTESSNGIEWNHHMDSNGVIINCIQTESSSTGIEWNHHMYSNGVIINCIKTESGIIIEFNLAESLNGLVWNHHRMDSYGIIVWHRMESSSSGMECNCQMDTNGIIIKWNRMELKRMESSLNGMEWSHQTESDGIIIEWNRREASNEIKWNHQRMDLNGIIIEWTRMESSMESSNELEWKHDQMDSNGIIEWIRM

SEQ ID NO: 925244 - protein, 463 aa, Homo sapiens
MFNVNAMAILKEWSPHRMESNGVIIEWNQKASSSNGLERNHHQMDSKGIIEWNQMESSLNEIEWNHHQLEWNGIIIEWNRMELSSNGIKRNHHRMQLNGVIIEWNQNASSSNGLEWKHHQMDWKGVIIEWNQMESSSNGSEWNHHRMESNGIIIEWNRMESSNGIECNHHQVESNGIIIEWNRMESSSNGIEWNQMESSNIFGWNHQRMELNGIMEWIRMESSLNGNQWNHRMNTNGIIIEWNRMESLNGIGIIIEWNRMESLNGLEWNHHQMEANGIIIKLNQMESSSNGIIIKWNHQIESNGMIIEGNRRETSNGIERRESSNGFKWNYHQMESNGIIEWTQMESSSNGIEWNHQMDTNGITIEWKRKESLNGIEWNHHRIDSNGKIECTRMETSNGLERNHHGMESNGIIEWSRMESSGSGIEWNHRIASNGIIIKWKSSNEIEWNHHQMESNGVIIECN

SEQ ID NO: 925245 - protein, 170 aa, Homo sapiens
MSKDESGRWGRWQKAPSFQWRNYKLIVDPALDPALRRPSQKVYRYDGVHFSVNLDEFYIGQIPLKEVTFARLNDNVRETFLKDMCRKYGEVEEVEILLHPRTRKHLGLARVLFTSTRGAKETVKNLHLTSVMGNIIHAQLDIKGQQRMKYYELIVNGSYTPQTVPTGARP

SEQ ID NO: 925246 - protein, 252 aa, Homo sapiens
MSFQMQTQMLTRLHQLRQGKGLIAASAGPPGGAFGEAFLPFPPPQEAAYGLPYALYAQGQEGRGAYSREAYHLPMPMAAEPLPSSSVSGEEARLPPREEAELAEGKTLPTAGTVGRVLAMLVQEMKSIMQRDLNRKMVENVAFGAFDQWWESKEEKAKNAAKQQAKEEDKEKTKLKEPGLLSLVDWAKSGGTTGIEAFAFGSGLRGALRLPSFKVKRKEPSEISEASEEKRPRPSTPAEEDEDATMAWKLAH

SEQ ID NO: 925247 - protein, 198 aa, Homo sapiens
MVNFPNYHSAGLDPEQEKEAGEPGRPGTKPPKRDEERGKTQGKHRKSFALDSEGEEASQESSSEKDEEDDEEDEEDEDREEAVDTTKKETEVSDDGENDSTSDSESSSSSSSSSSSSSSSSSSSSSSSSESSSEDEEEEERPAALPSASPPPREVPVPTPAPVEVPVPERVAGSPVTPLPEQEASPARPAGRCHRAVG

SEQ ID NO: 925248 - protein, 193 aa, Homo sapiens
MKEAEHRYRVNNLSQRDLAISINFWVPVLLNGVAVWDVVMEAPSQDCSIADCLQFRCDVPSFSVQEELDFTLKGNLSFGWVRETLQKKVLVVSVAEITFDTSVYSQLPGQEAFMRAQMEMVLEEDEVYNAIPIIMGSSVGALLLLALITATLYKASLGFFKRHYKEMLEDKPEDTATFSGDDFSCVAPNVPLS

SEQ ID NO: 925249 - protein, 374 aa, Homo sapiens
MFKTAPEAWGRVLLPDCELVATGSLSAAEAPQLRQVRQSLPYSYSLSGHLRSPAHEKPPLCPDCGKRFSQSSYLLQHRQIHPGPSALQVQGLREGTGGSTATGERPCRCPQCGKTCCGRSNLIKHQRVHSGEAIRLRECGKGLAASSAAGSPRSTHWPKPCVCPQYQQVFGDRWKLIGHQRIHTGECVPSAAAAAVTVSMRRPPSPSASFRTQGRRPAGVGAWRASASHPAQSPRTAPLGSGPVGAPGPSFNICPHPHSCPDLPSFILAPHSVSSLWFHPAFPQCLQCLWEAWKLPSPEGLAAQSGRTARRGQGQASATVPSSSTALEPTLERSPTSVSGVEGLQPEVQPGPTLKNQRAAALGGIVAAAGGLWI

SEQ ID NO: 925250 - protein, 147 aa, Homo sapiens
MRVTRDLRTYVTWSEQASPPPGYVLRVQRVFSRVGGGRAPTALSPVDSGHTAYTAMPLRRATHPPGCPERHSIHCAAGVTAPQFSRCAQFSLCADAAPSTRLGCAASGTVVCRILDPRRLFTDYPWAVEAARAVASLRVRRSALALE

SEQ ID NO: 925251 - protein, 314 aa, Homo sapiens
MVLDSAGSGPHLHPLTLPSRTRAPGKGAPGSPTPLTCQLLCDGQGLSPTLAVHAAFVQDPIHAQDVHLGLLDGPGPGLGSPRPDLPPNFVLLTILLDTEVLELQPLLFPAAGQWVSSDLETLYPRAQDGPQGPGQHRGKTSISFSLSLGLEDVSLQEQGSQAPEWPPCGAASLRGAHPAHLICCRCKYSQLLALAGRSRDSRWALRMVISCLLEDKGTAGAVGGVLGQQRARLPPLQEAFPAGGRRCRLRSPPSNARSVHSIEVEGAPPKGISGPLIITGRGTLGGGTHGPVIISTGRSQEMHFTRLNSFLKGT

SEQ ID NO: 925252 - protein, 134 aa, Homo sapiens
MNRWGFPAQQLGPAKVTQIIQAELKLEDGPEGFPGLHQPGLPRRCPTRGTSFSNASREGDTGLREPRHTHAHSHRWPWQSSCRAGLAQRPPHPGGSGPLLQWPPPPRCLPAAAPLHNYVWYFPVCPALGGCLEL

SEQ ID NO: 925253 - protein, 147 aa, Homo sapiens
MVRKCKLVFLDKQLRIFDPRTKPRASQGPGAFLLAAPAPREGQERHYLALSGRCPESTQAHENSRDSRLAWMGTWEHLVSTGFNQMREREVKLWDTRFFSSALASLTLDTSLGKKGPHPGPLPPPTARHDPRPASSLLVPEPSAAAN

SEQ ID NO: 925254 - protein, 138 aa, Homo sapiens
MQTANKRMYEKMLIAPVTGKMQIKTTRCHVVPIKMAAIKKPQKTASVDESVEKLEPLCTVGGNVKWRSYYGKRPLSQPALHCLAACHIQFRARAFILPWSCVSPNARFWDTGPGLDRLRFPQSRARCLEHSSVSVHGG

SEQ ID NO: 925255 - protein, 141 aa, Homo sapiens
MGSSITIACGSQPTAFQLAVRGSGKGTRPRGFKEEEVREIPDKRSNQRAPKEMSTTGEEGLSSSRESGYWTLMAPGKPTAHTAPSWGQSPFSSSSQTEMDKGGLHSRLTDDEKKEWVSLLPGALNLIRSLIHSSYVEFRGY

SEQ ID NO: 925256 - protein, 143 aa, Homo sapiens
MIGPCDFWLGRLEAATAQHQPIVSMCKIWVQSYQAVQFLRDSGHLEYFMRNPLSCEYKQTVVHPNNGIQLANNEKQTINMHDICNNNRDESHMHSANSGCETVYICDNLQNCPLKRIHFTACTLCIIKPDIKNAKAEKKTGAY

SEQ ID NO: 925257 - protein, 540 aa, Homo sapiens
MGIWCILAPVARLGPALRRGAAHIFTSGSPLSGTMATDSWALAVDEQEAAVKSVSSSAPGEEDMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKCEAGFAFEIPMKITWVSTVERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 925258 - protein, 195 aa, Homo sapiens
MVELLASPAPCARTPQPLGGRWDWAPWSRERRSSGRLWRHRSPRRGWGGSGMAGCRSGALPRGEAVKAGREIERSARSAGYSECGPAKPTPTRNSYWPASTAHSPGSHPRLSLHTSLQAEGAGSGLGQPKKGLPQCSGGLKGSSSAAKAGAQAEEARRANEGCEDYQHAVTSHYHVLSTVLRPEDTMVNKPNILL

SEQ ID NO: 925259 - protein, 129 aa, Homo sapiens
MGTFPKSKFAGDSQGPALQIGFPKESGQACCVLFCPMTNLQIKEEKVKADTNGIIKTSTTAEKTDEEEKEDRAAQSLLNKLIRSNLVDNTNQVEVLQRDPNSPLYSVKSFEELRLRLMWKVTKLAPRYV

SEQ ID NO: 925260 - protein, 388 aa, Homo sapiens
MGFNRPSKIQENALPMMLAEPPQNLIAQSQSGTGKTAAFVLAMLSRVEPSDRYPQCLCLSPTYELALQTGKVIEQMGKFYPELKLAYAVRGNKCEAGFAFEIPMKITWVSTVERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 925261 - protein, 327 aa, Homo sapiens
MLGGRGLGKEWGVGAPRDSEGGGGRRGLAVHCPFQPEPQVQQQLGSLLGVPWQPPGPPIQHSPADQETSTVTQQQWHLQGLDEVVVRQKRAPQGSWKVGTLFHGKRVYAVAISGSTHHVYTCGSGYIRVWDESALHAGEKAPRAQLDLQDRVVTCKLFPDERSLITGGASQAVTLWDLAPTPQVRAQLTSTGPTCYSLAVSSDAHICLACFHGFVEIWDLQNQILIRKHEVPVYGSRCVDITGNIFWTGGEDTILYSWDLRSYQRLHQHNLQNEILSITHDPGEEWVLAGLRTSDIVFLHTRRNEQFKALMKKYTRHHSLKFASCGE

SEQ ID NO: 925262 - protein, 158 aa, Homo sapiens
MTSDQLRKSCLPLSHFTPAHLLSTAQEPLNPLNTSGPSAAGLLEFAGGPPQTLFAWVLAAEAAEQRILLNSTCCCLIVPLEALSQRGTQPSVVGSTQFKLPGCLVYLLKPQQWWVPLPQPCCRLAVSSQTAVLAMSEAPWAWGPLSQARDIISWCAIC

SEQ ID NO: 925263 - protein, 181 aa, Homo sapiens
MACSFLLFFAYRFIWRLVLQTCLFFLASAAASQPSSSIWLHSRMSGGCGSLTSVARWKPVCFLQCGRWSRVFRKDGGDTEQTLQWSADDTTEKSDEENIIRYFCPRLAESETLGVDAGIWVVTVLWVILTNVQGKQPGAMHGSQIAERRSCALGISELTSRTFSLSLTFVQGLSPCSDPAS

SEQ ID NO: 925264 - protein, 251 aa, Homo sapiens
MDYCIDELICFHGFPTLIQGQKWFYFMAASLSVIITITTIITITIVIITIVITTVTIINIITITIVITIFITIIITTVVITIITITIVITIFITIIITIIIITITIVITVFITIITITIVITIFITIIITTTVITIIIITIIIITITIVIMIFITIITITIVITIFITIITITRVITIFITIITTTIVITIFITIIIITIINIITIFIITTTMFITIITTTITTVIIAIFTIFIITGTTTIMIIIIIDIII

SEQ ID NO: 925265 - protein, 156 aa, Homo sapiens
MVYVPFVLATVMMMMMPSLRLHCEHRSQLSVADAGSTHCIRGWMKVGPWKRSTQELSSPVGARLEGSRSVEGAWNLAAWGFLIKPITVRKGNCLISAACVSVCLPETEQINALPEVLRILTRGPLVLGWPDPAGINSRVARVSGTNSGGSGVAFYI

SEQ ID NO: 925266 - protein, 157 aa, Homo sapiens
MWCSLLVLFGPGVLWNLKIKLAWKLLYPKILVHSLHWITYWGKQSTQAILHIYWKPVTKTRLHSKGVESWSSSFLVVCIYLGEFDLEVSSRCVLAPPWNLGCPRSMGPGMGPLYMQRLYVLKEKCRNGNLSFRNAARKGRVANIFGFAGHIISVAVT

SEQ ID NO: 925267 - protein, 134 aa, Homo sapiens
MIDTQDHPLIIYTSGSKMVPKAGLQCGHRVLGAFLSSQVQGWCLMLISGRYKTAYDTRFFPKHWCHKWGHTSNPLIFYFRDPKSHTTLTLSAPAVFICQTLFWAPGISIEHNGQSLFSLGADFLTRKTRQTLNR

SEQ ID NO: 925268 - protein, 153 aa, Homo sapiens
MLDPSFSLWCHHPPITTPIFLLKHSSPLSYAPPCEDFLELHETTNRNWATALPSQPAYSQTKSWLRGGPIAQRKPHTATWHATPIPTLRASPVVGPLSKRAHYTACQPTTPADTWPDNHLYALGPRNIMLPLSQTPIAKAPDTIADIADKDYS

SEQ ID NO: 925269 - protein, 152 aa, Homo sapiens
MRKIFSTAAGTDCDYGEDIMSEGYPCQLPGTCNCDSIWKQGIRSVPRSSVNFRRLGSNTVSKCISAVLRHSVCRYYSSHKKLAQGPLLWAPCEIYFAANGGSWQEGRLNFGYCGSAERATLPTVTPSVPTFEEMVVQLCRVNAPDSNSLSIP

SEQ ID NO: 925270 - protein, 210 aa, Homo sapiens
MELGGTTREVMRKKVLPVTVAEEVRISLTPLPPLQTPTAKRGPTQDMGSKRDFSACCGLQILQIAGGGPHQGVSDENVQLDVASLVPLNALRDRGVERCSLCLKVFLYSKHQAEKRKTQTTSRLSNFDITHQCQRSLHWDRSAGATSCALRKDGHGGDGDDDIDDEKDKASLSGGQKSKIEVSAGLRFLSRLQGRILLCLFPCLVAAGNP

SEQ ID NO: 925271 - protein, 152 aa, Homo sapiens
MPKMKKPFLSEYPLGSKRIPSNSQGEFGVSQIVDLESTALESLRLVLHEKAPSVKNADSQSLPPKWPQPDFLWIGSGNSNFTCFLRDVMLIHNDNRGPWGRNTKCPITNARDPLQITEALLVEAPLVEAPAFRKWGRRLLVCFKLSSLSYRA

SEQ ID NO: 925272 - protein, 186 aa, Homo sapiens
MLFSEMPAWLIPSSPPHLYSHITLLRPSLTTFLEHCNLLHTLSMGMMPIKPSAQCLAQRKRWLNGAICNDNNSDEEEGPTLLGSEEGAVGHNSHFPGRGNCLHSLETLSPVFLECRAGRQEALDEGGGRSHLGGPFMNCSICPVVNENPGRDFNLGERRSSLHLRMVTMTRCVMREPVRSWLQESG

SEQ ID NO: 925273 - protein, 148 aa, Homo sapiens
MGFVQSFSMVYDYYHHHHQGYHHYDHHHHSTTIITSTTIIITTANAITITTSVLPPPSPLPSHNYQHHHHHHHYHQPYNHHHHHHYHQRYHHYHHHHCPATTTIIITTTNTNTKTIITTRATIIIAVTNTILLYIQYAKLSPSKIQQY

SEQ ID NO: 925274 - protein, 154 aa, Homo sapiens
MAPSFIFKASSRASSSLPLNRILLSPSCKDPCDYIEYTEFLELECGHPWSIIMSTPKYLLWSKTCLFIITISFYCLLKAPIEDFPKKQWAKLPDSLFISMAMVQGCQTPTMTFQGLIDSDSSHLHLDSGGPFVGLKKFSATNRGMGLHQYLWIK

SEQ ID NO: 925275 - protein, 143 aa, Homo sapiens
MGPLPRVLSSSKLCACMVVSVAGRGGGIEEDSPPCVQVNATRWPQGDSSLCPWEENYYHSKGVILNSLDNSNTRIKIEAPEGFSENKMKPESPRGNPGFAGEAKHSAIWWTPRSRAGSIIAGESLGRGLLTWPRGGQKARRTT

SEQ ID NO: 925276 - protein, 179 aa, Homo sapiens
MSADARRYPVRIRCPMPGPVRSPFRRPRTARSVAARRFRDPTETVPSQSWSSASAPVSGPLRRRPALSRHLDAIPARPDPFRRGRHGAGYPPRPRPSRPPGRCSRSVPPSPRAARPPADRPVPSARARTHLPARHPSLGRAAFGAAPPPTAGGWSHQHPILWLAPAPRSEQELPTEPLR

SEQ ID NO: 925277 - protein, 210 aa, Homo sapiens
MEEVWKIVRKLLIEGLRLDPDSAAGFRRKLFKRVKCISCDRPVEMMTGPQLITIRKAHLLSRLRPASANSCEYLQRQQMREQQWLQLQDLGIQEDCQQDWGDGPQNATSLKCKSCNLLTLYPYGDPHVIDYDSAEVDILGVDGILYKGRVNSQRGAQPLAVAKELADQQLTRERAVATGPWPVTKDDELGKVLGWCQGTPVHGGRTGQLP

SEQ ID NO: 925278 - protein, 153 aa, Homo sapiens
MPGGGRASAPPRVPAPAPPGPRSSACLAVRAWGRALTGLRRVAIGRVRLDVDVLHPRDAAAENGAHGARRCRAEGQGRNGSGDSGGVLTRTWPGPGRTDARPRPRRRLEPPPPARPGARRHGGPPPPGPGARREMESSRRRRRREAAREAPLH

SEQ ID NO: 925279 - protein, 172 aa, Homo sapiens
MALQPSGTAPVQPGPTLAVQTFLYPNKTIKPSSMKKSLHDCVGSEQPETTTHITGVLAPGEAFGTQEWLFKYIKDESKAEHPGAAVSHQVSCLPVTLPDHSEGQGKRAKPSHVWSVPRVHPWGITCEARWMDRQANQNHLSGKMMLDPNRYISVYKNACLTTKEILPTSTQI

SEQ ID NO: 925280 - protein, 218 aa, Homo sapiens
MDLHRAAFKMENSSYLPNPLASPALMVLASTAEASRDASIPCQQPRPFGVPVSVDKDVHIPFTNGSYTFASMYHRQGGVPGTFANRDFPPSLLHLHPQFAPPNLDCTPISMLNHSGVGAFRPFASTEDRESYQSAFTPAKRLKNCHDTESPHLRFSDADGKEYDFGTQLPSSSPGSLKVDDTGKKIFAVSGLISDREASSSPEDRNDRLKRGATDVLK

SEQ ID NO: 925281 - protein, 146 aa, Homo sapiens
MCFLGAEFALDLSLVILLWGNLPLPSGLLFVMTAPRVGWSGVGQLGTGSRSRTLAFGRLLTHKPLSRQPSDDENSDNSNECVVCLSDLRDTLILPCRHLCLCTSCADTLRYQANNCPICRLREFPGRLFCGRFWKLGTGHTTVVLG

SEQ ID NO: 925282 - protein, 125 aa, Homo sapiens
MYSFSHSTDGYQGQPFSKNTGIIVNKSLCGPHLDLPMGVKLLPEYTHLDARLSFLGEWWVPLINMFILAVGREDSLSPWSSASASLTWWPSPHALSARTFGLLIATHQDPLGRAEWKENPCVRDR

SEQ ID NO: 925283 - protein, 160 aa, Homo sapiens
MKVERKTNKNHKYALALAFSMDEINRNPDLLPNMSLIIKYNLGHCDGKTMTNTADFLDRKKYKRIPNYFCNEETKCSFLLTGPDMTTSLYFQMFLDIFLSPHFLQLTYGPYSSIINDIEQYPYVYQMAPKDTSLALAMVYFILYFHWNWVGLIISDDDEV

SEQ ID NO: 925284 - protein, 300 aa, Homo sapiens
MDQCVNCPEYQYANTEQNKCIQKGVTFLSYEEPLGMALALMAFCFSAFTALVLCVFVKHHDTPIVKANNRSLSYLLLMSLMFCFLCSFFFIGLPNRVICVLQQITFGIVFTVAVSTVLAKTVIVVLAFKVTDPGRRLRYFLVSGTPNYIIPICSLLQCVLCAIWLAVSPPFVDIDEHTLHGHIIIVCNKGSDTAFYCILGYLACLALGSFSVAFLAKNLPDTFNEAKFLTFSMLVFCSVWVTFLPVYHSTKGKHMVAVEIFSILASSAGMLGCIFVPKIYIILMRPERNSTQKIREKSYF

SEQ ID NO: 925285 - protein, 214 aa, Homo sapiens
MNPKMILLLMFETGITSFFLASRARARIFGIFVTQVLLVTCLMFECNRNLALQSLSAEGARPSTLQQHMLCCAQTPLLSMDNVMILQTSYGLLRHQVTYTIGDTPMNTESREAIQSEKKNCIRSNSGKTFTSTSHLNQHRMIHTGEKPFKCREFGKSFSQKVFLVKHFRIHIGEKPFSFSECCRTFKHNCLFVAHQRVHTGETPLYALNVASHT

SEQ ID NO: 925286 - protein, 146 aa, Homo sapiens
MLRHKSRALRGKFTLLVEPSMIYPGYARNWDVKRLQQIEAELLDFGQKCSPTLGSKELEPDAQGSIRASKVSPEHQPLQPPTGCLRRIQGWAWTGAGQLQKVGLSGSIYGAHSLCLWPILLSILILISTLEEQIISVSGCAPTTER

SEQ ID NO: 925287 - protein, 147 aa, Homo sapiens
MRVYYVPSNVLSMTLAGVGIQNLGVAPDSSHSPAASWPSLLRKCLWILSPCSLTLVQALSALSLTLCFCSQALAGIHLSSLMWRLYPDLHSLPLLALPGSLHMGSGHHPLCLPDPSALLRSQDVDIWPKLCQSDALLVYSEEQVARG

SEQ ID NO: 925288 - protein, 137 aa, Homo sapiens
MIYNSFVFIGSAQKLELRIRLFCRNVLLDHWTHRSDSAFWLTRILKPWPMVNQARLLYIIFGPISPQDGQVVWQEMIEEPTDEFSLKGLADAIKLLYDASTKEWTADDVISLVDELSECGKCICMCYNGNAAINYVW

SEQ ID NO: 925289 - protein, 154 aa, Homo sapiens
MQAFFALQGNLDLGQHCSIDSTLLVATLGEAGRVNPRELGKQTSEDLGQIKRDLDKYSEGPDRYIETFQVFELFWKDVILLLNQTLTTVEKQATLQAAGNLGDELSISYWAREGNESYLIGRIAISLEDSKWDPNDEIGEWKRKHFQMWILESL

SEQ ID NO: 925290 - protein, 163 aa, Homo sapiens
MGCQQGQFAPAGKVWAVASLSDLLIFYFALLLKDKGWLESENVGKHKLEKTCAPVAEKKVNAKAVMQELAWQALNFLGSSGLRAISRSCFPTSEFEGFSTKKFVTGQSRNIVVLGPGGNQEQQKVGRASVRTLRYSGSCLWESEVPLKRLSNTYISKVKLEVN

SEQ ID NO: 925291 - protein, 221 aa, Homo sapiens
MSCPLVEEQPGAWSFGSTSGAQSKRLEQHPLRGPGQQYGHHTHLLRAPGSCTSGRGSAWGHPGPHPQVPPHIRVTTKPDTPDGQSWNLQFTPGGAPTRQGHEPGKVEPQASPEHQGHGGELMAMSPLPQTPAQGQQGPGFPTPGCEEAQLKLHAPWSQREPGTNRSPTPSKLLQLPCRGSTLERVCTLSLQGPGKVPPVPTGSTALIHRRHGPVEEVSNLH

SEQ ID NO: 925292 - protein, 116 aa, Homo sapiens
MEYSSATANDSMSSFRSENEKPVDLKEGEENIVLKSLLEAKCGQLPRKHFQVALEVGQRTQGTSSDNEKVYIKVHCYANAAQNSFQISNMNLTWKNKIDYVNENVLEHHMVVPLPI

SEQ ID NO: 925293 - protein, 168 aa, Homo sapiens
MVIKKKKLITIIIIITANIVIITIIITTIITTITIITVTITITITIIITITIITIITITIITTITVTITITITIITTITVTITITITIITTITIITTMITTINIITVTITITITIITTITITIIITITIITVTITITSPSSPTSPSPSSPSPSSTSSPSSLPSSPSSS

SEQ ID NO: 925294 - protein, 135 aa, Homo sapiens
MAIYTGHCKCRETYSLPGEQYGRNHPHDSVISHQVPSTTRGNYGSTIQDLGADTAKPYQLPTHCHCYQGYQEAMNSATINSPGPPLALAVLFFVTLMQGSQDGAKVIEGFAIIFKGKNRNCFCTNLIPYFADEKT

SEQ ID NO: 925295 - protein, 170 aa, Homo sapiens
MCKRGVSLLLQERGRFAVSNNGWPMADGFQALGALTSAPSNNGTWGEPFFRAYALGEYALVPSSTGSGKGETVLKKCMVEMWTAGDLSLALSLHWGASPDSQPVPSEPAASHPYLSMHQVFPVTYLLNSSVLSQMLYFKCGNLLAILALLHGGGEYQTFLAGHLEASSPR

SEQ ID NO: 925296 - protein, 124 aa, Homo sapiens
MVGIIPELGPKGWEGLLKCRNGKNHIKEMEMLKISSEMEQCPACLNMSVNEMQLKGIKPNADKVKFCELFKVEMEFSDFVCAQHHNFQLLYQQKDMRITDLLSFVKMASANPGLGSWRSSEPLT

SEQ ID NO: 925297 - protein, 140 aa, Homo sapiens
MGCKLLVDLPFLGLENHGPLLTAPLGSAPVGTLCGGFSPIFPFHTALLEVLYESFAPAANFFLNIQNNSVAASFQYGFDYSRPFQKTHACSDFSFSWCSNLKCVNYDAEVQGESLGQRVNLDEHLDSNSTSIFAVAAFNH

SEQ ID NO: 925298 - protein, 199 aa, Homo sapiens
MADTPPPARLLPRRSISDCCASSEQGSMGGGPAKPGVGYNLLVCRLLRPLEKYNIWAEVSHFSRYNLSQLPLARKGKSPDPLRFPDEAMPYPASAHPPWAAPTVQPVPVRRTRYLSWKCRNHSSSASVTLGAADRSCSHLANLERNPCISYKILGYQSMGPSVMMMDLWVKRYLGRRYASLDIGTSSFSVHSSTVVHDM

SEQ ID NO: 925299 - protein, 185 aa, Homo sapiens [sequence omitted]

SEQ ID NO: 925300 - protein, 172 aa, Homo sapiens
MHLLDFFRDLVDMDGSGSHYPQQTNTGTENQTPHVLTSPHGWKPATLEGSRSSWTTGHHSEQWLQPKSFVGLWQQNLCSFAHASSSDSTAGCKFISWEGALAGPGLLASMIYPVWESEAGLQARMTRIRPWERPADRRALRSDWPHLIGKITLLSSGLTVPQFTSDSSSVHV

SEQ ID NO: 925301 - protein, 168 aa, Homo sapiens
MDPLVLVLRAPGSPPEEAFTSSQPVPRAALTPPVAQLSLGQEAVDLWLPSLTSRGGQRPCRDHQLPELPWGRAALGKGLVLATHNNSALNDKGHLLVHHLALRLPELTRYHPLKDELSRLHRLPRPKSDRNGQDQDWAPRLTNITVSLITRRKRPFEDVLSHGLRNIC

SEQ ID NO: 925302 - protein, 149 aa, Homo sapiens
MPTTLVLYVLLTESITFAFIKIRVWFLAIKRVLINMEADLVTKGACCCVDITLTHRGSVSFIDELHHEKRAEDQVVKGQEYLPWRIGAGYLQAEEQGSQSKSQNLKNREADRAAFSLWLKALEPLANHWCKSKSPKAEELGVQSTLAAD

SEQ ID NO: 925303 - protein, 256 aa, Homo sapiens
MGSSFKVARELQGCPQAHLDVRHEGSKQLSSIPWEGRGAVNSDSWVLYWGQSLQTPSNGDAPFPGITGKSGGTYLVSEIPSPKRRGGRRRKKEGGGGEEEEEEEEEEEEEEQDEEEEGGKEGKDEEEEEEELEEEEKMIIMIMTDDEEKEEEEEDEEEGEERKRRKKKTMPVLAAPPGCSRAFALAVPSAWGAVTPDIHEFPPLMTDAIKAQADGALRQWILAAVTLKRAVPAWADWQEKPQVNKGWEISMFERSH

SEQ ID NO: 925304 - protein, 195 aa, Homo sapiens
MDTLVSVVYQYFTNALVSAVYHCFTDALVSMIHHCFTDALVSAVYHCFMDAWVSVVHHCFTEALINVVHHCFIHSLILPVLVSPLAAGIQLLLHAWGLLSLCPGPEAPKGRELAPCLSLFSPCNAWYIEHPGSSSQGSLSGPCSAQRGAGASSQSLSFLRVPCLSWLVVTCGAAGRSLKNEVLGKVPSIRPADSK

SEQ ID NO: 925305 - protein, 132 aa, Homo sapiens
MLGGKFYYPILQMKRLGLREVKELVQGNTAEPGNVICMHIPEKRSYPYYSTNLPNVKKMANNSMGNKFDCDYDGVMLQLCKFGFWWFVWKMVPGNASKGIGACGAHFERVAFVPAYSGRPQDNGGQAYRGGQ

SEQ ID NO: 925306 - protein, 133 aa, Homo sapiens
MIVETAVVGFSISTATLACVSREQKLDLFICVLSEPDIMSGTAQMSLIVRKPPLARLVQDASDGASGQFWCGLSGEELDWMLGRANFSLDSEDLPLPKAPEESGISVSHSRFQRDTGEEDCCEMYGPWTEFVL

SEQ ID NO: 925307 - protein, 176 aa, Homo sapiens
MEWRLLHRFFLPAALLKPKFNGVEKIKTIGSTYMAAAGFSVASGHENQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 925308 - protein, 153 aa, Homo sapiens
MRVSIMLAMGLSDPHVLLHIVIDGPEEGCSWCKLTGVQKGDLGGEKQHPTDPRYGSGISHLHLRGSFLDTWGSGGDTEALTTDIANHSPIPKHPVLTWKPLEARLFCKKAGAAQIQVGVITGKAELWPARSEVSAAWAVSSEPVLFVSTKLNH

SEQ ID NO: 925309 - protein, 133 aa, Homo sapiens
MTQHCGWAPLFGSQPMHREWKGPGPLIAFHAENVEAVKQDSEQDLSEATVTGRKHQGARVIPWRAAVQERHLRASVCDGTQCQQQSPDANPEHWTSSVFHFFHVSKFLAASHLMIFPLDLWISLDCIICPLST

SEQ ID NO: 925310 - protein, 160 aa, Homo sapiens
MALDIDQREWLVFPKSVRMGPISRISGAVTQLFLCGYHLPDMAPMGYEEWPGGNQGDITQEVAFALDPEEVKCKDFREDLRICTFSRHAESCGAGGSTVIIEIGSEGQLLFPKQEWACCSWRVCPAPWAAGLPHKAVDWPHFNDMDCLVHECTSDFQVCY

SEQ ID NO: 925311 - protein, 1061 aa, Homo sapiens
MAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRVEASLQRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAASQRSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 925312 - protein, 161 aa, Homo sapiens
MICFDRNLFSSIILASCTDRGDGGRLAEGSWCGTDCRGRSAGEDPRQAEGCKDIPYCAPFRHFEAWPHDYWAITPTEKVCGFTPEVSKTTNPAAGSNSGHIQTSGRTNSGHTIFKNCDTHGEAVCRALHKHTCGCVAVGQCYSAAHAVSHDSEHHDLSLEL

SEQ ID NO: 925313 - protein, 162 aa, Homo sapiens
MPGASPQVFSRAPLEKEEKDYAPPRPTSVRFYNCKPVLQSPLKRFLVEDVLRKDHPAPSLKSSGWLWRVPSEEPCAGTTVMPPASQKSPTSAYRLVSRTSLLHHQIAGKRPQQGLLCLGFQTKYAWCCPQDAHSMGIKTQNAIGATLQNRWTGIEATATIIG

SEQ ID NO: 925314 - protein, 166 aa, Homo sapiens
MFRKVTKNTGLENTEQITPGGITVQLVSCKPLTSDGLLSFSPHFCIQETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEW

SEQ ID NO: 925315 - protein, 140 aa, Homo sapiens
MNAGESYSAIVLCPFLNDWQLNKARNGRINVVDIGSTEHLPDFSRKGDLLTYEDERNGQEGGTYRGRLVSAQNRYRCGSLTGHISCNVMDNQIKAFNNEFIHLPWVPAVYYYVTGRVMCIQNTMVKIPRTGEKKLLLPPT

SEQ ID NO: 925316 - protein, 151 aa, Homo sapiens
MTLDFHQQASAGPSASGALELPALGVDVGFGVAVRGSRGLAKMPVHLSALERTGEQDGAAALAGVHGQLVENFTLLDHLGKGQRWPVGTTHKQPLQHNLVECGVGSSGQKTAQLDQQPQVDILALGLLAPNLSVLVVADVSSHDGVSCSAR

SEQ ID NO: 925317 - protein, 147 aa, Homo sapiens
MIKQFEKEKVNGTYSTVFLTGEIALPQFAMLLQSVISVEFSSYPTEPIPLMLQLLLGSANADRKRGDTTPFLDFLVRSTWDIARNDGGWSNCEIAGRAVFWVSAQAAQLQLWIPRSTVLCAPDNLCPPMNHDWFLEKWLKILRFKYG

SEQ ID NO: 925318 - protein, 350 aa, Homo sapiens
MINVSQSLLFRDPQANGEDKKGAGVLTGNVLRGCALTAHPGLKLSFATSWSCRKTAQCGILGDPSQPAFPGMNFPLQFSLGQSYLNVKDVLRVRAWRKDCLNKEKSRSHSVAAMWRLPCDKNPLSAPEGIPITAVLKDVPHIGLPSCHSSAWKAPILHCGLPVSHPGTQVKSKVKKNGSMKDAEKGWSGKFRKKPKKLPCPIESQKEELARSDRILVMTSDLDVFADEFSLSSFIDVEGYSTDALEALLYYDSVDQYTLGTMNCDRWPDNPMKGLIGAGGWSPLVSNKYQWLQIDLGERMEVTAVATQGGYGSSNWVTSYLLMFSDSGWNWKQYRQEDSIWIEHKIPQHL

SEQ ID NO: 925319 - protein, 146 aa, Homo sapiens
MRGLFLRGTLGLLSVTRSSVETHADSLQHVFRLRSPCKFTALCSETEGGKNHTFKLLLFAKESSQSIEKHTVELGPLSCPGLRDPSCSPSKQRLETHQTFEAPWHPILSPESKGNKGYGHEIAHDLCYKPSLQICGHIIDPVLKSG

SEQ ID NO: 925320 - protein, 134 aa, Homo sapiens
MYQEHVQRLLVIKEKSWVRRRGTGGSRVNPRVGRSSGPERPGDAERHPRNAQKPRNLATEEGQIQINGGVSLHKLPLSSAATSDMRDCETCPDTWNWLYTQRGCLSQAAKQRREQLLGGGPGPEHEGSRNSSVL

SEQ ID NO: 925321 - protein, 145 aa, Homo sapiens
MFTVGFALLRGSNAAAALTGGAAQAVTLARPPLTPAVWPGPWRGTSPLPRELGPCGGRSSPQTVPSTVVAGPHRRRSPSTVVAGPHRRRSPPQWWQVLTADGPPPQWWQVLTADGPLHSGGRSSPQTSPQQWWQVFTADGPPPQW

SEQ ID NO: 925322 - protein, 161 aa, Homo sapiens
MRTVYTGCDEYKLSGQVEMELRNLGAAHQTTGTEQQICSLGWQHVYQLRRVPVPCSTWQHQSTHGHVPTWWCQHGMPPRAHLVLLLLLLLTPGPAWLTSGHGPGTPSPQVSLDHQRARAGHTIPPTSVLPHARTSLAHQQARARHTIPPDQCAASTSRRLG

SEQ ID NO: 925323 - protein, 154 aa, Homo sapiens
MEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQARDSLEVESPVTEGGALMALLQGEVV

SEQ ID NO: 925324 - protein, 249 aa, Homo sapiens
MLLRVEDYITDYITAWPWAGHETSVSIYLPICEAEIMTASVVNSGNSMKGEFPRAQRSQPVDPQKIEVDRESKMGLSKAVYQGFQLEQQGGQYRKRPAAGSPKLKHLHGEEMAVAIRVVEREPYRPRFVCQGKEMGVFLADQRENHKGLPKDPTSGAVWKGMGQCPEGCSGGLLLDVTWDYSGFEEHPPGSQGPRAQQGTFQEPLEAKRGSCPGEQTEGVQSFLHLLLLNCPQLNSLMPKGAHFGAAHF

SEQ ID NO: 925325 - protein, 161 aa, Homo sapiens
MKGYNCIISLTGVNRFVNNASGFRQALGSPGWSRSRVPQEGSLQVSFVWVIPVSTTWSGRGTFLKGSRGEGVLDRRKLQASTTWPYLCPLVVALGGAADHRRERMNPPELGGLQETEIHISFLARCLLHHRPCQQVLALLPERMCFYLVSMSSAWTSVSKC

SEQ ID NO: 925326 - protein, 135 aa, Homo sapiens
MDSWESCASVPRAPGMCSLYAAPIKASIHQMRGDNRQPGEFMSSKDTSGPLITEAQELSYFSFCYPSFGSIDPIPLDTVGEQGITSLSWFSFHLSAYQHPSLVLVHILTLNRILDCKPIRAFTVCLNKFLKKHLL

SEQ ID NO: 925327 - protein, 181 aa, Homo sapiens
MQARYIDLACRGSPRQQIQGLLNQMNPKCMPKDSRQVYENTCSDMRGRGPQRSLEGTQVLVVTLAHSQGDGRDNGGDDSWDSNSDSQLQGFVMMPTTRTALAFLQIARAVRNLLPLEYIAGSSLHILADRALERAFGERVTIPGISPVCHYQQCENGLTPTLSGSGQEPTTPLAVVRQLCF

SEQ ID NO: 925328 - protein, 159 aa, Homo sapiens
MKPGVTVKLLLLLLLLLLLLLLLLLLLLLLLLLLLLLLLLLPPSFLLPPPPPSSSSLLLPPPLPSSSFFLFLFLLFLFFFSCFLLSSSSEDEDEDKDEDKEEGGGRGGEEEEEDKEQEEEEEEGKEEEEEEEWQQQLVVKFVADELIKCNERQEASVST

SEQ ID NO: 925329 - protein, 404 aa, Homo sapiens
MCRGWGHKDSLGMIVLPMRLLVLQRRSRGNGIIAGGLCEQELHSKSKGDAAVLPVWGDIHPDTYYHRVQPHGQGTPTQIHVTIGYSPMARGHPPGYMLPSDIAPWPGDAHPDTCYHRVQSYSQGIYTRIHITIGYSPMAREHPPGYVLPSDTAPWPGDTHPDTCYHRVQPHSQGTHTWIHVTIEYSPIARGYTPGYILPSSTAPWPGDTHPDTCYHRVQPHGQGTPTQIHVTIGYSPMARGRTPGYMLPSGTAPWPGDTHPDTCYHRVQPHGQGTPTRIRVTIGYGPMARGHPPGYVLPSGTAPWPGDAHPDTCYHRLRPHGQGTHTRIRITIGYGPMARGRTCRYMLPSGTAPWPGDTHPDTCYHRVQPHGQGTPTRIRVTIGYGPMARGHTCRYMLPSGTAP

SEQ ID NO: 925330 - protein, 126 aa, Homo sapiens
MHGLQVPSIHWPGTAVSDHIPNLPLKCSLWKGKNSMMSESTLVYWCGPHLLGFPYIHTCVGLDDHALNNLALNSTSGSCSPGPLRLLWTLVRKCVFESLLKSPSSQGGWEHCPPILSSMGWDLPFP

SEQ ID NO: 925331 - protein, 141 aa, Homo sapiens
MVEQAPDRALGLGPWLYTAHGWHWPEMMGSEAGRLRGLCQQRSAGIGFSAGLSGNPGCRALQVTAKLSASVGGPSPYPHQPAASGRFPDWVSSPPPREPAVEPRFRNDDVFLAPWLGLVQFLFLVSALCLMFSWGSGNTEH

SEQ ID NO: 925332 - protein, 137 aa, Homo sapiens
MPWAGGQLRGENRDGLRERALALGVGEWMRNKTGESDSYTLMGTPQNPLATGSSASGWHDFAPCMGLPWLGTRQLTRVAGVGSGKRLLTLGILTPLSRILLCNIHFLLPISLKGLLLVGLLCTVLQVSSAKGASRGK

SEQ ID NO: 925333 - protein, 149 aa, Homo sapiens
MLGRTFGGILTRGLLSPLKSTHFLFLFLLELPLLLSMLGTVLWALFKYNYHRNKEKDLGHESTISLVCWLVKPSSLPQQLVSRLTGCCLASSLSFGLGYTRRTQNSEKLLYAWLWFITLKGYGLKPVKVKSAWCKLPAVLFQRDFADSV

SEQ ID NO: 925334 - protein, 259 aa, Homo sapiens
MHAWCLQPDCAVQGLWWLKYVPHPCGMALGPQQELCNSGPLVPPQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWAIQS

SEQ ID NO: 925335 - protein, 338 aa, Homo sapiens
MCHVCHLIGLAPPSAAVLMPPARVARLSRAWVASARSRGARVSRTLTPGAGVPRRRVTPPRPAPPRLHRRHTPQSSSPPCASGPSPQSPWNPRSRWNLRSPWNLRSPWNLRSPWNLRSPWNRRGRTCGGEALLRELEVLVQDVVRTSSWWERHGWTAPSSRSASSPCRQVRNAGTRRPGRLRVGAGCGGGGGAGSATAAVGVQPAQWTGGGREAEVVGAPHPRMEGHSGTCLTPASGSPQSLAHFSLGSQGFLCLRWENALVFASGITILGVCHYTLTVKGSHLATHGALTESKRWSKIWLLFFVEADKPKFANKGSNPSGQLLLLLHSEEEVGPGGR

SEQ ID NO: 925336 - protein, 315 aa, Homo sapiens
MPIVLVDWSDIREQKRLMVLRASVALHGRSVTLYEKAFPLSEQCSKKAHDQFLADLASILPSNTTPLIVSDAGFKVPWYKSVEKLGWYWLSRVRGKVQYADLGAENWKPISNLHDMSSSHSKTLGYKRLTKSNPISCQILLYKSRSKGRKNQRSTRTHCHHPSPKIYSASAKEPWVLATNLPVEIRTPKQLVNIYSKRMQIEETFRDLKSPAYGLGLRHSRTSSSERFDIMLLIALMLQLTCWLAGVHAQKQGWDKHFQANTVRNRNVLSTVRLGMEESVSYRRRKDAEWKEQKDQIHKKESVRHTGEMISVYQC

SEQ ID NO: 925337 - protein, 117 aa, Homo sapiens
MQCNAQSRSHIPSLNSLLGAYIMTRRCLDDQIWLCHFYPPPPKDLDTHSPWWAFAKKAKQSAMHRTALKSNKCCTENANSTSFDNTRECQERDVFASVPRGCCEDSVGDLPWQELHQ

SEQ ID NO: 925338 - protein, 157 aa, Homo sapiens
MKSPIGENLTDSPRAPHCTAVTVQWGWEYPQGLLEREQVPPHRDLRVQKSQTVRITGPCLSTCSRPLLPSGGSMQPYSIITALAGTVLEAEIKSENQGGLEREKLEEQCKVEYVRFSYRFCKGILRSTEKMYRNCPIGQEAGAFITSFHSYGLTLPL

SEQ ID NO: 925339 - protein, 156 aa, Homo sapiens
MHDRRESIMVALTAWPGYCTENGLEGANMGRGRLVRMPWQMIHTRDNSSFDQGGRSGSVITLGLKPQKTTLHRKGIFWKKQMGVKGLENDQETGLRQRTREQEDNHYFSAEAIWSGCYYQCHHRVPLLDTTIPVNDAQLFVFVPLVQDSVPQEGEK

SEQ ID NO: 925340 - protein, 424 aa, Homo sapiens
MSIKVTQKSYKVSTSDPWAFSSLSYTSGPGAPISFSSFSRVGSSSFRGGQGGGYAGASGMGGITIITVNQSLLSPLNLEVDPNIQAVHTQEKEQVKTLNKFASFIEKSYINNLRWQLETLGQEKLKLEAEFGNMKGLVENFKNKYEDEINKRTEVGNEFVLIKKDVDEAYMNKVELESCLEVLTDEINFFSQLYEEDIQELQSQISDTFVVLSMDNSRTLDMDSIITEVRAQYEEIANCSQAEAVRPCTRSSMRSCRRWLGSTGVTCGVRRQISEMNGNISRLQAEIEGLKGQRASLEATLADAEQCGELAVKDANAKLSKLGGCPTAGQAGHGTAAAYQGLINFKLALDVEIATYRKLLEGEESRLESGMRNMSIHSKTTSGYGGLTSYCLSSSFGSGAGSSSTKAVVVKKLETRDGKLVSES

SEQ ID NO: 925341 - protein, 167 aa, Homo sapiens
MPRWRRVRPQALLTATHSSTLVEVVVALLCTLHSLTQWNGLINKYINSQLRSITHSFAGRPSEGAQLEDYFPDSENPEVGGLMAVLAVIGGIDGRLCLGGQIVHDEFGEGTVTGITPKGKITVQFSDMRTCHICPLNQLKPVGELVLSYCMIREIGFTLGPSTNIST

SEQ ID NO: 925342 - protein, 176 aa, Homo sapiens
MVENRYTDDSVKPSGTKKEDLDDKEKKDETPAPVYRAKSILESWGCSRNARHQKARSMPLQDQHLALAILLELAVQRGTLRESFFTVQNCRNNEEVTLICKADLENHNKDGGFWIVIDEKVYDIKDFQTQSLTGNSILAQFAGENPVVALEAAFEFEVTRESMHAFCVGQYLEKRG

SEQ ID NO: 925343 - protein, 158 aa, Homo sapiens
MAGQGRALAQPLLSPGVPACSLCICPFWLHREGRETAWECKVGNGRGCDQGDLENRPTSPGSPGRAHHPPPPRFFTGPGPVELGLCGRGGGRAEAGGQKELGREGGQESLSQHPDDQTGLHPHPFHGQGVEKDVEFLVLLSGPAQFKPLWCKGHLYSH

SEQ ID NO: 925344 - protein, 162 aa, Homo sapiens
MSTWLRLINLPLRQVWLKLYEKRWGLCQALDVGEGGRVRKQKQYHQRCCCEACGQCLEKSQGLSVSKLYEKRWGLCQALDVGEGGRVRKQKQYHQRCCCEACGQCLEKSQGLSVSGLQHLWEAALDRLICTFLIEDDIDDEMSYNDHLEVYFEQLAIPGMME

SEQ ID NO: 925345 - protein, 151 aa, Homo sapiens
MPYVTVLRLAAAACQEHGDGMPMLHFTKLYHHYRSFGVAYERQNHVIIQETKSSRAAELTRGSALAGRHPSQHCHPGLFPLDTNSKMPGRRDQEHSVVRSKTDARSNHLEIQREHFGPLLWAALNFGAHFLTSVTVSELHPASGVHMGSRW

SEQ ID NO: 925346 - protein, 165 aa, Homo sapiens
MNQPYLPPIKSCVCLPLVNAGIKDKRQRGIFGKRGQGHLASSEQVSPKVTELSRPTNNNFLWEPGASHPLDTTKPSPTPPVCSLCSQVQSLCGKGPGMVFCKIAKNKKDFYFGENYARHSVALTSATVMGARTVTLSFLSCRFLCSCHMHSHDEGLIPCALWFRH

SEQ ID NO: 925347 - protein, 147 aa, Homo sapiens
MWRPLWEAQGPQPARRCSSVGSSRSLWAAPEAYPHLHWQPAPVAQQVRCVQGPHPAGDTDPGGKGVVDPGWARGAAQTPPSVPKFTPGRVASLSPSRPVGGFPSLLHSLMRQPEDPGPALTLGRICGAADIPLPPEFPSGPALSSCG

SEQ ID NO: 925348 - protein, 261 aa, Homo sapiens
MRQARSVCVGILSTAEPPHPPWFLGLCTLGFSGFAHPAAPCQEEEETPRACDTTTCLTAGPAPAAALALAWNLVLSRTCPDSVMALALLCLVLALTLSWLCTGLSLALSWQWSTPALAITLPCCALDVSSPCPGPTLPLTLPWPYLGPHPSDPGPAPALVFALALALDMSVVLTLALPWSCHCLGPALALALPRPWPCPGPSHRPALPWIYPDSALVLPSHLYGLALALPCTGHALPCMSQPGPSPCPTIFLTPPVPLFWP

SEQ ID NO: 925349 - protein, 341 aa, Homo sapiens
MTFASPPRLTLNLGVVLGTLTVAANPKVREQVRLELSFVNSDLQMLKEELEGLNISVGVYQNTEYDSLTGVLVSQQNLLLEKASVLFNTGVLYTQIGTRRYRHTQAGLQSAIDAFQRAAGVLNYLKETFTHNPSYDMIPAMLSVLVKMMLAQTQESVFEKISLPGIWNEFFMLVKVAQEAAKVGEVCRQLHAAMSQVLVKENIPYSWASLACVKAHHYAALAHYFTAILLIDHQVKPGTDLDHQEKCLSQLYDHMPEGLTPLATLKNDQQRQQLGACPSAPRCGSHLVTSWSCSQTATERSLKRARERGVFQVIVATLGSEVMRHSPEPQRASQAVFSWVP

SEQ ID NO: 925350 - protein, 162 aa, Homo sapiens
MAWQWEIRFQVKLRLQRWREQKAAAAKIRGGRGKNPRRREQKAAAGKKPRRQKAASAGWGAKSRSEAKSLGGQKAEAGWRQKAAAGKEPRRCGGPKAAAAGGGKKPGRAKSRGSGGQNSGDGVEGRHSLALLECDVIGNVQPKTKKDVSRLDSLQLRTQMLS

SEQ ID NO: 925351 - protein, 154 aa, Homo sapiens
MTAVACMPPDVSFVPEQGQVAGAREGDYIVSIQLVDCKWLMVSEVMKLLKSFGEDKIEMKAVSLLDSTSSVHNKSATYSVGMQKTYSMICLAIDDDDKTDKTQKISKKLSFLSWGTRKNRQKSASNLCLPSLQAAQSLQCVNVCHNCSQRAPSC

SEQ ID NO: 925352 - protein, 179 aa, Homo sapiens
MEGSHHLPVSLTAARTLGNLCSEPKRTPESLVEAGQTWWSLGQEGNQSLSGGGHTAQPGPDCSSLLQGPPGAAICQPCFPVEDPTHTSPRNLGKARAPQEPPGNRSTDNGCKKKGSDSFRCERKGPWNPGLHPAHRHETWACRKPSSVLSAPLRVNPKNTLGEIFQQEKGTGEYAARLR

SEQ ID NO: 925353 - protein, 143 aa, Homo sapiens
MTAARELVTGHEVGRKVKPCCRVKAKLCFSLSPLCLELLSIFLLPNFNVGKSIILLQRSCSRQAALTSPKNLLQMKNLRPAESERAASRSHTPAPADLFGEEKFFSILTEHDIKCVLQNYLSQIVVHPLFLWLYSKQNLSRHW

SEQ ID NO: 925354 - protein, 138 aa, Homo sapiens
MWQKPISTKNTKISWAWWCAPVIPATWEAEAWELLEPGRWRLQKLKLDPFLTLYTKINSRCIKDLKVSSKCVKTLDENLGSTIQDIGMGKYFMTKTPKAMATKAKIEKWDLIKLKNLCAALFGSVRGVPLSCKNEEKP

SEQ ID NO: 925355 - protein, 518 aa, Homo sapiens
MRRKHLLWPRHLLVTTQDDQGALQMDDPYIPPDCYYLSYLEEVPLSMVTVDMCCGGLRGIMKLDDLAYEIKPLQDSRRLEHVSQIVAEPNATGPTFRDGDNEETNPLFSEANDSMNPRISNWLYSSHRGNIKGYVQCSNSYCRVDDNITTCSKEVVQMFSLSDSIVQNIDLRYYIYLLTIYNNCDPAPVNDYRVQSAMFTYFRTTFFDTFRVHSPTLLIKEAPHECNYEPQSYCCRSDCRLTPGSICHIGECCTNCSYSPPGTLCRPIQNICDLPEYCHGTTVTCPANFYMQDGTPCTEEGYCYHGNCTDRNVLCKVIFGVSAEEAPEVCYDINLESYRFGHCTRRQTALNNQACAGIDKFCGRLQCTSVTHLPRLQEHVSFHHSVTGGFQCFGLDDHRATDTTDVGCVIDGTPCVHGNFCNNTRCNATITSLGYDCRPEKCSHRGVCNNRRNCHCHIGWDPPLCLRRGAGGSVDSGPPPKITRSVKQSQQSVMYLRVVFGRIYTFIIALLFGMATNV

SEQ ID NO: 925356 - protein, 156 aa, Homo sapiens
MVPCESGPAVAAPHGLFSVGFLCVCRSPEERGVNCMVDAAHNHQGALRTRGGGQDNKGGLRTTKANSGAQEMLRTAGSIENQQEVLRTPGGAPDTRGCSGHQDALRKQGGAPDTRVPQNHQGALRTPGGIQDHQGMPRTIRGRSGHQTVLRNTRWP

SEQ ID NO: 925357 - protein, 127 aa, Homo sapiens
MTSCREELPSLLRTGKTTGRLAAGRSYLLCLELNTQPVNLPTERSYSLGVSSEMLECFMKLVFALLTHHMAAYLILSRCRTRTWAKSPLATEGSGQKKQHPSDPETTMQYEKKKMHSFGTTESKALL

SEQ ID NO: 925358 - protein, 147 aa, Homo sapiens
MSHIALELSQGSSLLQCLEAQTQVVSVFAGAQCEVQLVESGGGLVQPGGSLRLSCPDSGFTFSNHYMSWVRQAPGKGLEWISYISGDSGYTNYADSVKGRFTISRDNANNSPYLQMNSLRAEDTAVYYCVKHTARGSQSTYCHLFNS

SEQ ID NO: 925359 - protein, 145 aa, Homo sapiens
MAVLAVIGGIDGRLCLGGQIVHDEFGEGTVTGITPKGKITVQFSDMRTCHICPLNQLKPPQRHEEGFSNLEELEIVKRIRTQLPYERVQLMFNVNAMAILKDDQTGLHPHPFHGQGVDKDEELLVLLSGRAQFKPLWCKGQLYSH

SEQ ID NO: 925360 - protein, 160 aa, Homo sapiens
MCLVNQGLLTTTRGYSGHQGVLRKPGSSVQCEVQLVQSGGGLVQPGGSLRLSCAGSGFTFSSYAMHWVRQAPGKGLEWVSAIGTGGGTYYADSVKGRFTISRDNAKNSLYLQMNSLRAEDMAVYYCARDTIDAYRDEKPSTIVTRIRVLRKLRDTCKEAI

SEQ ID NO: 925361 - protein, 153 aa, Homo sapiens
MITAHYSLNFPGLSITSLPSLKVVTVSWSHNLPVITGAPVAVSSPKDLFGDRGQQPVYCLQGMPLHEITALMTVQDQVTNGTIRCTPGRRPALIQPPDAYPGCTPCEALLIHSLGLGLCLAGELPGQPADRTQTPELNQGRCWEHTGKRPVTV

SEQ ID NO: 925362 - protein, 141 aa, Homo sapiens
MSVMLSSDVLTSVRPKTRARFRGSIWAAGKAGHCQHPELSPPSLWPLRPLSPTTSSPVPSLEGGHPLVWAWRCLMSRAQARFQPLSSPGPAAMSSAQPAHLYRAALSAKLEDGNASDTGSRGSLPLESPQKLRRWLSGGKH

SEQ ID NO: 925363 - protein, 139 aa, Homo sapiens
MGTSIRVVRKLRGARKATTLHKGNHNNKRIISVKISAQQLPVQPYTDVNLVIDASSLGSFSSKCHSDAAYDKNCVFQCSHVLVKPSETLSFTCAASGFLIITSTSSWSWICQPPGKELKWVRCFPCSCAVLSEFLHPEF

SEQ ID NO: 925364 - protein, 148 aa, Homo sapiens
MGSHLAQGQVYKCCPRAYAWTWGPTSPLGPSAAGLLEFARGPLQTLFAWVSAALAAEQWVFVNRECCCLIVPLEVLSQRNTRPCSGVHVQVCYIGNLCVTGIWHTDSFINQVLDSKNASLGVFNGNILHLFCHVMTCTINALITTGNN

SEQ ID NO: 925365 - protein, 162 aa, Homo sapiens
MHEKKDENNDHDDDDDNHGSDSSNDNDCEEAGEDGGDDDDSNDGEPGDDGCGGGDDNDGNDGGDDGGDDDDGNDSDGGGDGGGGGHGGGGDGGGGGDDNDGNDGDDGGGDDGGGDDDDVVMVVMMEDDGAGSDAGGDAGGADGAAVITITTIITTTITAIIM

SEQ ID NO: 925366 - protein, 147 aa, Homo sapiens
MHHKCAWVAQGLLAPTLCPWSPALSSVLTHGARLGVNSRDRQLAVLRTALCFNHQILPEASCFLIPQDESPPRGSQSPEWRHIQLSHEYACTPAVSRAQCQMAVTLQAKQEKGLSLVEESGQAGVCCSNGRLTNLSGFAQSRMFLKS

SEQ ID NO: 925367 - protein, 122 aa, Homo sapiens
MKGRSLSSHPRGLPQFSNSRLRVGELEPRAQFTLHLCTWTMASPPWFSLLTAMGKQLCVSGREEFWLGNTAASAGALVRTPWTDSARRTPQQPQINFYSYRLAQPVLERHRNGITQHVPYCI

SEQ ID NO: 925368 - protein, 143 aa, Homo sapiens
MYSLKTVTYVDTQRVLPANPAPTSEYYPRDGHTSNFDSQCIWKNTRFLNRVLDVDALTCCDGKFTVFATAFLLADITSPSFSSLLPRLDKTSKSPVFSLSCTLGSHGSFEEIPPRLPCVVPGPVTLASLVLVTDETLSPIQTR

SEQ ID NO: 925369 - protein, 151 aa, Homo sapiens
MGGGCCPFSAVPKRMAPPWSLGNVRSHYPSDITASREIFHLHFPVPNTGINTKGVTHGSFTSRFQAPGGNFHITLRKVVSGEPSGAWGVVCSAHVVSGRAEELMASVGWMFVKLVPCGRHRGSVSDHCADLSEVSLGHNGRKRQGPYPVKK

SEQ ID NO: 925370 - protein, 115 aa, Homo sapiens
MRLALASGLHSPPLPFILTTITTTTNIIIINNTNNNTITTNTNNFITTNYNNINIININIIITNIAIINTNTTPVTNTNNTITLNTNNTITTNNITSTNTSTTTLSSPTATPALS

SEQ ID NO: 925371 - protein, 160 aa, Homo sapiens
MHQTSDLESPDFFNTLYPGRQHMSPWSPTAAYTNTGGFIDDNSLQVGQGLGTGAREGHCCARMEKTPGKLAGQTSSFLAVEEGKCAQNGLALGLWKNHSHRPSQASLGFAGHHWASLDITEQHWATLDIWVSLGFTGHHWASLGIWISLGIIEHHWTLRH

SEQ ID NO: 925372 - protein, 137 aa, Homo sapiens
MLKATSSLGSFSAALIPTFPMAPGFRPGADASAKVLKELNSAPHWEKVAQQLLCMEDLLLRPAAWMGQCLKMIVPFMDEEMEAQEVICQQPYQAQAAGWTSVSACEVRDGPTDSVLLGPLGTSDREGSVHSSAQSDL

SEQ ID NO: 925373 - protein, 141 aa, Homo sapiens [sequence omitted]

SEQ ID NO: 925374 - protein, 212 aa, Homo sapiens
MGIIIGVFNNSSIKDTLLKGFHRLESGLPEIKEVVQRIDEDDDDNKGNNHNDGDGDDGDNDDDGDDQGDDDGDDECNGDGDDGDDDGNGDGDGDGDGDGDGNADGDSGGDGNGDGDGDDGDDGDGDDSDDDGSGDDHGDDDNRDDGDDDDGHHGDNDGDNDDGDHGDDHDDDGGGHDDGMVIMMVICEAIEHKVGKQCASSSLFRISTKVET

SEQ ID NO: 925375 - protein, 374 aa, Homo sapiens
MSSAPEKQQPPHGGGGGGGGGGGAAMDPASSGPSKAKKTNAGIRRPEKPPYSYIALIVMAIQSSPTKRLTLSEIYQFLQSRFPFFRGSYQGWKNSVRHNLSLNECFIKLPKGLGRPGKGHYWTIDPASEFMFEEGSFRRRPRGFRRKCQALKPMYSMMNGLGFNHLPDTYGFQGSAGGLSCPPNSLALEGGLGMMNGHLPGNVDGMALPSHSVPHLPSNGGHSYMGGCGGAAAGEYPHHDSSVPASPLLPTGAGGVMEPHAVYSGSAAAWPPSASAALNSGASYIKQQPLSPCNPAANPLSGSLSTHSLEQPYLHQNSHNAQPSCKLSWEPRRLSPEVESDAADQLGEPSTSVFEPQAEGSTAPKCSAHSPFEE

SEQ ID NO: 925376 - protein, 217 aa, Homo sapiens
MSPRGSGRWETTFPSLHLLPVAPRVESAPAMQIIVAVLLDTRPKLNKWQFLKDASGPAKEPSTNQVTSLLNVVRSMPGNQGKKSEKLELEGEEEPRGRGHPATSQGIDYDLHMQVQPFYYVVHKTHFVQDLKGRGAVTFFLLGRSTQDARCYIRQLVHATCPADSARWLGAATALSLFSHLTPGGRDLSCARRNGIVACQAPILFQFCLYAPINLCA

SEQ ID NO: 925377 - protein, 156 aa, Homo sapiens
MCSVQVGSGFYRLLWTKVRTVWGWAARWRGARWFSGWAVQFLLANTVMVEALPEKHRVVGQSVPAWPPGQKLTSSCHNLAKERRAQSLVTSPEGPGPAIFSGYGFLLGAFALVAMGHQVSLDLIVITRTAGERPASIIQLPPTGSPPRHMGIQDGI

SEQ ID NO: 925378 - protein, 159 aa, Homo sapiens
MPLRVLQNSVFRGRVGGSPLADTLGTQRMMSSGLAPTVPINRREGGRDGRRARLLPDGARGVNRRPSPAWKSPGLSSDPPSPPTGGLQNHEKVRLCWTVARTRNTHPAALKDAGLSAFGSPVPLQGTLRLLFDWILTAALRNLHHDSDLTDGDPDTQRD

SEQ ID NO: 925379 - protein, 489 aa, Homo sapiens
MRKVRSFPGHRAKLLLQPRLSEPPHSYLHGCTPKMPPGACYTQMPNQNRRESELLIWSLPPFRSRLQCHLHQEALCSLNSGPPLLGAPSGLCQPHPLCEQLHEGSDCLSLTSQHLGLPHLDFLKVPTSSCPRWSGVGAAGAIGPCSLASIPGKIRIASREEETVTIPMNPSASPCNALFTLVEHDHPLHASSCSGASSQSLAFEVRLSPGSFQVKLHLFLSSQCLWGKLPGYSLWRRQNAGGRAGNNPGLLAVAGLQIPESVGLEGKLCAQSTYAKSTSVFNRIQSAGHRSSIWSPGVGRPGLRNRTRGCGGVSASFCVCRPTVFRQEQHLLHARRVRAQRVHQGTEWGGSVPSQLVRVGVGNEEISAMASEGAENHGKSTQGDYGRRDMREQSETPALQTGVEAGRETHQCMPAVYTDGLSRKTGCSITSYVNLRGSVSSAVLSGHFPSKGSKLKKAGIRLMTLVSSFNAWRTYCIQGRTAPVGICRE

SEQ ID NO: 925380 - protein, 169 aa, Homo sapiens
MSGVNTQGLNLLSGEEAGVCAEQAPRGLYYSKRQGHPDFILPGRRERSFLLLVVTHLHVTFGIQAFWVSGSLMMPCRGPEVEMSLLVAVAPGHTYGIFQDRHWSEWNFHGSVIGITKILIVPTGSSPKYFFLVDFVVKSLLIDNLAAGPDISMFGTCPKAGLPDLVNLV

SEQ ID NO: 925381 - protein, 140 aa, Homo sapiens
MAALLVEFTTLWKAKQWTSYAGDTFLSVHGGHITQLQISFEGGDTSTRSPRGHRKTFHAHSKRAVKDLYKENCKTLLKEITDDTSKGRHIPCSWMGLGVGAGSICVSLRGQGACLSDWGLLICPAEEEEEHQGHNTVPPR

SEQ ID NO: 925382 - protein, 224 aa, Homo sapiens
MLILEGEQLWPPVHSWTPGWPRRTTHHPVGGGPGGNGVQALIPPQGNPPGLIPALSLECLMKLSWSTIWEFQERLFQSWAPEDNVVLRNLQTSVKELTRKHWDLPPPGGLQHQVSSQVTLWGSQWWGVPWPYQPSYLAFLLHLFLLYSKKVKWVCHSSGQALSVCVRDMRCRQAGAVGRTPQLPSPSFHIVPITPSKGPEGHWGSQIQVWKTPPLPPSSRIPHS

SEQ ID NO: 925383 - protein, 433 aa, Homo sapiens
MTAASRANPYSIVSLEEDGLHLVTMSGANGFGNGKVHTRRRCRNRFVKKNGQCNIAFANMDEKSQRYLADMFTTCVDIRWRYMLLIFSLAFLASWLLFGIIFWVIAVAHGDLEPAEGHGRTPCVMQVHGFMAAFLFSIETQTTIGYGLRCVTEECLVAVFMVVAQSIVGCIIDSFMIGAIMAKMARPKKRAHTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRGSEI

SEQ ID NO: 925384 - protein, 134 aa, Homo sapiens
MTVEDSAWLVVRSKAIILLKLRMEEDFLGDSRKLPCVSMAHGPAALVRAVRIWLRKHSLEAWEWVTARLLGFSDAACDLLIVWSSLTLRRTELQPSALCCARGEEEITDTKFLLLDPMAGTGVQDLLIFLGEGS

SEQ ID NO: 925385 - protein, 139 aa, Homo sapiens [sequence omitted]

SEQ ID NO: 925386 - protein, 196 aa, Homo sapiens
MSLHLSETQFPHLQIGAGSGRIAGGFNRTLQHGTGWHTSCWEENKGDAAFSFSLSPGEEASNVFQGGACPRGSHRHCGCLLDGRSDNGSSSSHRDSNVCQALSWPCLFESSSCPQIGVIKPVSQMRKSRHRKVKWIAQIHTMSKDVALGMSDASSPAVFSKLAASGASGYQAQEPSGYQANCFVYVMALNLHNHHT

SEQ ID NO: 925387 - protein, 172 aa, Homo sapiens
MCDFGISGYWVDSVAKTMDAGCKPYMACPSWVISSWTTSAEDTGGLCRSRPALIVRRALGACSQPERINPELNQKGYNVKSDVWSLGITMVLCGAGACPWWSVDWRDGKTTRMCPPARARKLCRRRVEGRCHQQRQVFVLRSLPFIMVMTAGSEGPCAGASEFSVLPGRGQG

SEQ ID NO: 925388 - protein, 138 aa, Homo sapiens
MGCNRTTLTELWQEEKRQRDRKCHLSLSCPNSCLHAEIRLQTYPNWGSDPNSKSYHQGDFWKVLRLLRAQSLHECNSCFRGETLEIIKIPTRGNWIDHEHIPEMKESTTETKMLYFEITQIAIGKGLLYPGEWLGSFS

SEQ ID NO: 925389 - protein, 119 aa, Homo sapiens
MKYVRLNFTFLDQSNVNGNSHFIFSALIGSSCILHFGNYQTAEHGEFYRTHFKGGAWKIPQDEDRLKGQGKATVKAKNSHSPGRMRVRVETCCLVSPNKSQQKGHNWQVFPFTFHYYPG

SEQ ID NO: 925390 - protein, 165 aa, Homo sapiens
MWPRLLPSVTSASKPHSYLRKVLLQRNLVSSPPQAAGALCSMQYPLATCGFELLKHGWSKLRYAISVQYTSDFEDIHKVLKPSRIQAGMKATLKGTGRGHRGGPDTPRGMQGGHPGGGKANAANFPLPTGEFSLLLIYKMGTCKSLTQKHKLPEVGFWYKADDDF

SEQ ID NO: 925391 - protein, 149 aa, Homo sapiens
MMTMVALQTVPGSLDKKSQFRCQAVGKSVTDNTAAKPCKTSTPRMSSETSGLPNPHVALVFQCPASRHLGQFSYQAEKALHFRQLQQVIQRLLHTHRGSVHCLPCFHWGSSKQHHCDRVPQLMLRPRSRPGSPQGLKTHSPPSILVASC

SEQ ID NO: 925392 - protein, 454 aa, Homo sapiens
MDDKSIQKPGFGAPRFGGSRAGPLSGKKFGNPGEKLVKKKWNLDELPKFEKNFYQEHPDLARRTACLVLAPTRELAQQVQQVAAEYCRACRLKSTCIYGGAPKGPQIRDLERECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRYVEDVKFVINYDYPNSSEDYIHRIGRTARSTKTGTAYTFFTPNNIKQVSDLISVLREANQAINPKLLQLVEDRGSDIIDQFAIVFLTGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 925393 - protein, 223 aa, Homo sapiens
MGVGEAREELEGSVTLRYIGAGTLGARAARRLVSPLTRNRTGAAASRLPTCLQQWPRGALRKRLYKGLSPALPSREENRRRAQEETVPAGGRSCRSGGLLGAGLGGDCWRGGAWGSEGWALEIRGSTLLRCLDSGFRPGASRGLVGSWAAMESTLGAGIVIAEALQNQLAWLENVWLWITFLGDPKILFLFYFPAAYYASRRVGIAVLWISLITEWLNLIFKW

SEQ ID NO: 925394 - protein, 155 aa, Homo sapiens
MHVTVGAALAEYPVCLLVLTQEPWTYLAEELVREEAPPTDLQIFAMSQPAHVAWTCGNVSTIMTDLRAVPVPVRRQPMAGACSLRWCLQPLRRPITKWPSCSSEKPLGHVKSGGARTRVPERHGLETAHQCLLDAFWTWGSPDGIERDKQEGAKD

SEQ ID NO: 925395 - protein, 169 aa, Homo sapiens [sequence omitted]

SEQ ID NO: 925396 - protein, 135 aa, Homo sapiens
MCYCHWTSCPTATAPSVRGAWSPSSPHPLQEFSVLDKQHLPFAQAADVTCCLPPLTECEGDGSLLLSLWLYEAQIAGAYGIIYCENEADGEPLGSGLEMVSSDRTVGKTGHFPSEGPPAQGKCQGMNVSAPREIE

SEQ ID NO: 925397 - protein, 145 aa, Homo sapiens
MQLWVAGSNQCPGITPDTNLVPDLTASRCPPPTDGPGCPPAGGDITARELTMFHYQYKRTLAADVLLSEGVATSLRVSLQMISSHLHPGTNLGCRKLKCMLPLIMNGSIIFAESLPSLSLQIESAIQDGRRPHSTISIKRANEAS

SEQ ID NO: 925398 - protein, 140 aa, Homo sapiens
MCPIPSSVGGAPWPPSTFGGLAKDIGRHRDALTEVSIWTIAFDLPNNLISQGVEKMTSGSATLKSILTIKELTSQLESHLRVAQSEVHCHLRVAQSEVHCEERPCEETVEKVVIYKPGREPSPEARTVSALILDFQFLEL

SEQ ID NO: 925399 - protein, 219 aa, Homo sapiens [sequence omitted]

SEQ ID NO: 925400 - protein, 202 aa, Homo sapiens
MAADFTQRRDRCITGMSTLLLRGNVEFSVGRAAATSLESILSLMCAPGMLNNLPRVILKTYQSLPAFGKSLDKQFAIEGSCSLLLEGAWVQLMTMDINLQGGFLQSASSSNLDPSDDIWSIIFNLGHQILGMALMNQSVLRDRLLKMKKVQEIMWCEERLKDQRTFCLEMQTGFVREMHAIEEEAEVELKPKGARYREYTFL

SEQ ID NO: 925401 - protein, 142 aa, Homo sapiens
MVEREREREGRRGRRRREEEEEEEEEEEEEEEEEENKNENKNKNKKNKNENKNKNRNNKKRRKMIRTKMSMMQRVRNPEIDRNRELSTDTGAPPEARAMSPWWPGLAWPGGLHPFGPSREEHVAAEPPEVSKGSKCRSQERF

SEQ ID NO: 925402 - protein, 128 aa, Homo sapiens
MDPTGQSTNFCLQILLAFLCTTLPSPLSGRPRPICASKMALSDPPFWVHMLVQSSPIAKRTDLNSQKDIVEVTACDLQGEIITDIATSTLLSRSLPMGEACWYDTQVALWRGSCVATAVIQARCDELR

SEQ ID NO: 925403 - protein, 134 aa, Homo sapiens
MRAKWLPFVPVIASLQNVPIRPPLYHKCQRDICHLQSPESCERSPEGIERTSTLQVPRTNTFSLQARRQFGCQRQDVVTPTLKHFQGYNLPEAGKSVYLLNLLIYAIAVTLFILQGYCKDKGRSTHVATSIYTL

SEQ ID NO: 925404 - protein, 140 aa, Homo sapiens
MDPVLPVLESCEVKSETEGPRIPGANGVSLSLPESWRTRSDDDQGQEKMDVSVQAERANSPFSQHHNYFLCLLTQRHEEPKVARWQAVSTSSSMESLLCLLVKVFLSLELRPLGQQGIKEAMLCGILDKKQCCVEYYDSV

SEQ ID NO: 925405 - protein, 137 aa, Homo sapiens
MRKKHQYQATGKKLIFLECCLSSGLVPGGPKSNDKCSHKRHTEKRHREKRKRPCEDEDSDWSYAARCQGCLKPLEAGTGKEGFSSRAFGSQQQLQEEEEEEEGRGGGGGEEQEEGGGGEGEGEESLSSSFIPRLLVT

SEQ ID NO: 925406 - protein, 156 aa, Homo sapiens
MPGVSLANVSQKERLFHPARSLIKGEKIKFINQTFDSENGCYLGRILGHWLTRDYLGKLGHRIPFFYSLSKSSYLTLHQDAQLSNVPSIEDIGLSVLKPEWSWAHQGTGCLNERRKHLKSIQGFLSTKPANSLNLSAIIFRPITKTRQLPKRKRDT

SEQ ID NO: 925407 - protein, 325 aa, Homo sapiens
MGLYIAVIFYYKDNILVTNEDQVPIVEIDDSHTSSITQDFLWFTKLSCMWEDIRWLRQSIPISSSSSTVLQTRQKMLAATAQLQNLLGTHNLGRVYYEPIKDRHGNILIVTIREVEMLYSFFNGKWMQISKLQSQRKSLSTPEEPTALDILLITIQDILSYHKRSHQRLFPGLYLGYLKLCSSVDQIKVLVTQKLPNILCHVKIRENNNISREEWEWIQKLSGSESMESVDHTSDCPMQLFFYELQMAVKALLQQINIPLHQARNFRLYTQEVLEMGHNVSFLLLLPASDDVCTAPGQNNPYTPHSGFLNLPLQMFELGIVACFT

SEQ ID NO: 925408 - protein, 134 aa, Homo sapiens [sequence omitted]

SEQ ID NO: 925409 - protein, 136 aa, Homo sapiens
MNAREIRLLEMPEESRYGARTKGKDILGHPGYGKEAQSFTKSGTCQLKKDKFLASMPSPSPSVPMADMTLPFFFNSCAVALGSFEPLLQWIVVLMALYGSMSEISILVQHPWDNTYYLNGCNLVHAPRLLILCIMR

SEQ ID NO: 925410 - protein, 154 aa, Homo sapiens
MRATRHCPTATSRHERIGLVIAFENINYDMSCMRNLRDVMFRETGGAVAEKSAEIGCLQERTLEKPAVHGDRQQVFWGGVVAYGRLNPDGIWTRKRSRRLPMVPQDIYSSMPGSIFFITENEKVFLEVSRHNTDFMGPSKEDNVETKEYKPTSC

SEQ ID NO: 925411 - protein, 174 aa, Homo sapiens [sequence omitted]

SEQ ID NO: 925412 - protein, 159 aa, Homo sapiens
MELKVKAQELREECRSLRSRCDQLEERVSVMEDEMNEMKREGKFREKRIKGNEQSLQEIWDYVKRLNLHLIGVPERDGGVWNQAGKHSARYCPGELPQSSKAGQHSDSGNTLQDIVQENFPNLARQANIQIQEIQRTPQRYSSRRATPRHIIVRSPKLK

SEQ ID NO: 925413 - protein, 340 aa, Homo sapiens
MAAAEDEFLPPPRLPELFDSSKQLLDEVEGATEPTGSRIVQEKVFKGLDLLDKVAKMLSQLDLFSRNEDLEEITSTDLKYLMVPAFQGALTMKQVNPRKRLDHLQQAREHFIKYLTQCHYYRVAEFELPQTKTNSAENHGAITSTAYPSLVAMASQRQAKIERYKQKKVLEHKLSTMKSAVESGQADNERVREYYLLHLQRWIDISLEEIESIDQEIKILGEKDSSREASTSNSCHQKRPPMKPFILTRNMAQAKVFGAGYPSLASMTVSDWYDQHQKHGVLPDQGIAKATPEEFRKATQQQEDQEKEEEDDEQTLQRAREWDDWKDTHPRGYGNRQNMG

SEQ ID NO: 925414 - protein, 602 aa, Homo sapiens
MLRLGGPGGMSQAASLLLRDRRLQKLPGPCSFNIFHPDVWPKHDKPPWESCPAASVITEQLEANLSKNNRALSVLRRIKSGSVVANRANQGKENSENITTPEVFPRLYHLIPDGEITSIKINQVDPSESLSIMLMGGSETPLVRIIQHIYHDGANARDDQLLPGDIILNVNGMDISKVSHNYALHLLRQPYQKFCSRNSGQALDAYRPQDDSCHVICNKSSPKEQLGIKLVCKVDEPGVFIFNVLDGIAGPLHHCMDLCNAKKVESCTMIQCPALKNAAPCVVACLTPTSLLLEVAGLCCILMVPAVFISHNNGSSGLSGVAAAITLAAAGRHSWDCTLHGAGGNLGQVEAPPLLSWWGRSSLGAATTAQTVAADLGLPGHGAGRGPTPPGQLQSTPTTAVDPGIPALLGAQEGSPCPSRLGSTWLPPAVGTHFDLGAKLGPSPGTVKAWPGQKGPEGSGPGYQFHGPKWELVVLFPDPPMAAHGPIGTHFLPLRPIKPPDSARAEQMLGKPAAERSYPFQGLLSAESFRERWDDLPAEGATHSRASSELVYHSIKLLFTLLTLHLSTYLIPPGCGTRTWDLLNGRSERSITQTELKHAPCL

SEQ ID NO: 925415 - protein, 148 aa, Homo sapiens
METMGAGWHPGKSPDLASGCLRWILALQLPTYLALQISASSFVKRVCSNDCFNRALMFCLINKDCNRPDKDITKHTLPLSVLTRGLCGHKKSWTSTAHNSCLDKRLASASKDSAYIKDSSLQSCDAAELPKPDQNILFVHIALPGLAY

SEQ ID NO: 925416 - protein, 154 aa, Homo sapiens
MMMMIAPKRGIIAGCHHLKVRLGLEGLSPSSSAWLLVGGSVPLNRVLECPHNTSAGILQGENPKDAGGHCNAFGDPALGVTHHHLHLTPLGKQTTGVTGHEDWRKAREGRKEKLPVGRDLVAAGRWLRVTYFHGKPAPVRYRDGGPNAGGSRAI

SEQ ID NO: 925417 - protein, 176 aa, Homo sapiens
MCDLVSDLVGFSEMFKVPAKQYKSIHPTLEIDIEGELQNLKEIGELLQTKGREFGVTIGRKRRCGWLDLVLLKYAHIINGFTALEVTKLNILDMFMEIKVGVAYKLDGQIIPHIPANQEVLKLKFNIRLHENGTQTYQMQGHLKNYLLMHKTMFDLLKMSFKFQLNGLVLKQMMKT

SEQ ID NO: 925418 - protein, 139 aa, Homo sapiens
MLPFPEGGAWSESVLGLADMGDPLERRTSPKEQQAWVPPSLGFLGPCDGGKGSLIPHSRRPLLRMESDGETSREKDIPVVEVGGVENEAKQFQGVSRFTLQEWCPKLEVLCQLQILPVMSKNGFPSGRWQWSSPTGNMA

SEQ ID NO: 925419 - protein, 160 aa, Homo sapiens [sequence omitted]

SEQ ID NO: 925420 - protein, 166 aa, Homo sapiens
MAEGEGEARHIFPSMVEQEREKGEVPHIFKPSDLMKTHSLSQEQQGEFHPHDSVTSHQGPPPALVKVFPHSRDESSLTPPLDGASTLYREKSVWEEEYIDAAIFGKYNPATQIKHLAEYNEMGWNKWQRLSNCWEHSRKNIEAQKTFKGQTPCGQGKLYLKWVNES

SEQ ID NO: 925421 - protein, 142 aa, Homo sapiens
MRSLLYANCVSIELFHKKGTASERVLCQEKEVGCGRWSGGKEDQKWLATPGAVAQACNPSTLGGQENCRESPQLSQGAYKMPFALAGLMFAARLGQETWGAEDIKDLDEPNAKSSVAFQPLPPMPHNYPKIFSSCTNLKTAP

SEQ ID NO: 925422 - protein, 143 aa, Homo sapiens
MNTYRREKGGCCKDTQKNQNWNWKSERKWPQGPPPSPAQVHCQAGGVPQALAQGPLAVHAVLSQWAVVYEQTGPVRKSSDSSRDRQNEGQSSELRPSQLLCTEWTPLGSQEDDSSLVRCRNMKDHPLGTGRPLGPWLLLPTWL

SEQ ID NO: 925423 - protein, 164 aa, Homo sapiens
MQYSLLIAVQTSLLLGQLDAIILNRTPHLTSNSGTGPKALGVTSYSGCLRAWLIIPHSMAYTGSLFLVFQRALLPAFADENHSFLEQISYFCSLQEKPQIHKLTQCLLTGGIGVRRWPGLHLPALPWNLLQSPAPGPGVCVHFQDEGSWLWQDAHTTNFRSNKN

SEQ ID NO: 925424 - protein, 118 aa, Homo sapiens
MALWTQQEPDRHSPCSPKVYGLQGKAGRCSINCNTNSCAIATMMSITRKCRGHVTEYNKGWRWQRLRCEHTFDMQTNQSRAHTQTLTTCPSHPRAKCQTTREIPYTLEPAKITHTCQS

SEQ ID NO: 925425 - protein, 138 aa, Homo sapiens
MISSSPPEDVIQALEEKKPTPKESGNSQELARGPQERTPCGPALREGEAAAVEGPCPSQESLSQEENPEPTEDERSEEKGGVEVLESCQGSSNGAQDQEASEQFGSPVAERGKRLPGVAGQYLFKCLINVKKEFSTSR

SEQ ID NO: 925426 - protein, 143 aa, Homo sapiens
MRGAQPDVQVRWHVRDVVRHSYSHGSMDGSWIPGIAGGVPDTHLTSSTSALSDGLLALLLPISAHSATFPFDGDRSGGGQGRMETPYTFLLKAAGDSGSSSVAPEALQVPCHMAAVLLAALTGPAGATAFLSPPPKLGDGFPP

SEQ ID NO: 925427 - protein, 148 aa, Homo sapiens
MTMSSSVRGLPWPRISPAYVASSLELTLTASGTTWPRHKRNLIVKKPQTNPNRGTFFKITSQTLKNVKFMKDDENTEEAFQIKGRSDNRARPAIQDFLLLLRTPLGQNPMTFQNYKSDLKYSRWTIVCFTVHLLKDIWVSSFYYNEYK

SEQ ID NO: 925428 - protein, 145 aa, Homo sapiens
MFGHFLPPCERLEGAEFGYFSSYKLDGKDDFKDLWRQQICCLFGHQISLSLLNEIFTGYKILSWQDFPPKNFEDVVFWHLLLLNKGCTGSTMLASAWLLERPQETDNHGKRRSGSWRTSHGRSKSKRERGEMPHTFKQQHLHQLK

SEQ ID NO: 925429 - protein, 150 aa, Homo sapiens
MGRNQSRKAENSKNQSTSSPPKDCSSSPATEQSWTENDFDKLTEVGFRRSVITNFSELKEHVRTHLKEAKSLEKRLDEWLTRINSVEKTINDLMELKTMARELHDACTSFNSRFDQVEEKKSNPKTHNCQIHQGGNQGKNVKDSQRERSS

SEQ ID NO: 925430 - protein, 804 aa, Homo sapiens
MCHASGHCWPSVAAGAFGPRLYSFSDALFLYKSNEALGPFASKDAEANPVEVCTWWRSVPCGGVYPVDVCTLWRYGSYEGVYHVEVCTLWRCVPCGGVYPVEVWILWRCVSCGGVYPVEVCILWRCVPCGGMDPVEVCTQWRHVPCGGVYPMEVCTLWRCVPCGGMDPVEVCTLWRYGSCGGVYPVEVCTLWRCVSCGGVYPVEVWILWRCVPSAGMYPVEVCTLWRSVPCGGVYPVEVWILWRCVPCGGLYPVEVCTLWRYGSCGGVYPVEVWILWRCVPCAGMYPVEVCTLWRCVPCGVEYPMEVCTLWRCVPCGGVYPVEVWILWRCVPYGTMDPVEVSALWRCVPCTLWRCVPVEVCILWRHVPCGGVYPVEVCPCGGMDPVEVCTQWRCVPCGGVYPVEVCTLWRCGSCGGVYPVEMCTLLRYGSCGGVYPVEVCTLWRCGSCGGMDPAEVCTLWRYGSCGGVYPVEVCPCGGMDPVEVCTQWSCVPCGGVYPVEVCILWRCVPCGDVYPFEVWILWRCVPCGSVYPVEVWILWRYVFCGGVYPVMVWILWRCVPSGGVYPVEVWILRRCVPYGGMDPVEVCTLWRCVSCGGVYPVEVCTLWRYGSCGGVYSVEVCTLWRCGSCGEVCTLWRYGFCGDVYPLEMCTLWSYGSCGGVYPVEVCTLWRYGSCGDVYPVDVRILWRCVPCGDVYPVEVWILWRCVSCGVMDPVELYTLWKYGSSGGVYTCGSMFTYGSMYPVEVCSPVEVCSPVEVYTPLEMCTPVEGVPCGDVYTYEGVYSVEVCTLWSLRDQPYWVLPTP

SEQ ID NO: 925431 - protein, 148 aa, Homo sapiens
MREERAASPLSPAWEEPAGVSGGPGPLPACTTRGQQSVVAAASAGEGAGAVEGHLGVAGSMPVHFLIKFKAQESEDRGSSGWIVGSCRLWGTVPWAAVFFFCQAAVDTEPRSLALRPALSAATCSRRAHTAEKQRQPSGRAASSLLDI

SEQ ID NO: 925432 - protein, 134 aa, Homo sapiens
MGSSRTTLSQGWCVLVGLRGAPAAGLGLSSIGCAVDLLSLELESCSGVIPGKLKIGFPVLEWRQEDGSHEQGTLWLEGNKDGRQCQGEEKTQELSIFRNSSSVAAPDLVITRNGSPMNEVGFLSPFLPPHISSR

SEQ ID NO: 925433 - protein, 137 aa, Homo sapiens
MPGRRLASWWRGRAPGDPKSAEEETGGSREMEDPGARAGSAHAWEETLASSASPRQPAPAMASGAGGSWGRSPPQSAVPTPLSWAVPPAPPQPGRVKEDLLELMMLQNAQMHQLLLSRLVAGALQPRPASPCPQGLS

SEQ ID NO: 925434 - protein, 472 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSWTWGSPPPPHPHPPPPPPPSPRPAPAPAPRLRVLWTAHLAAMAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 925435 - protein, 163 aa, Homo sapiens
MPGLGAEAVPASAVVVSVRLILLVTAQEGQLVLVAEGILRAAAGRRGHLIGLVEVRVVDLVQVLLLKEHGLKAVTPQDLIGQIGAAGLGGHGCGLHHAFQDDHDLKVVRLQVLPADAEERAGLVNLVQDGDGRHQKDAVQAVNLLCTHPLLNPKQPQICFLSL

SEQ ID NO: 925436 - protein, 182 aa, Homo sapiens
MGEALPFLCILFYFLEEWFVVLLEEVLHVPFLLAGRPGADKISIWLSSGPSAAGLLEFARGPLQTLFAWVSAAEAAEQQILVNSKCCCLIVPLEVLSQRSTQLWKALQKPTEVTVPYEKMLQDQSALIVQGLPEGVAFKHPENYYLATLKWILENTAGISFIIKRHFPGSGSCDSKGRIRRS

SEQ ID NO: 925437 - protein, 117 aa, Homo sapiens
MCDYACSGGKLQPSAPISTSYWSHLKAEGKFIISVRLRYLGGVGWARRGVRGDSLKDAKIQPGNKLAPGTSGSAESWSIGPFVTGSFPSTANAFKVHLHGTRAKFMLLSYLTLCSYF

SEQ ID NO: 925438 - protein, 131 aa, Homo sapiens
MQILAHGQCDLRQVTLPASVSLRALICKMEIIHLVPELSIHRLIESSKLPWKTGIFSKLHFAVEKSDVKAVLMAAKQPCRNPAQICLDLEPGLCPVTGLSTNTNIHSLGKGSPLGPQDEDNNAYFDSCCED

SEQ ID NO: 925439 - protein, 163 aa, Homo sapiens
MKRTHFFDVATDTEEKVVLGAEPAPAVCISLPALHFQRQPLIKAGPRMCGHSKTEQRFGGLLGQTIGNAGAMSTPERGQKNNNMNIHDFQICVQKRKMKEWLLEGGGQMLHVDVIAGNDPCDPTLGPGAFHTAEPVQLLGGMRTEAQNPNYRCSLSYYGITSQ

SEQ ID NO: 925440 - protein, 137 aa, Homo sapiens [sequence omitted]

SEQ ID NO: 925441 - protein, 139 aa, Homo sapiens
MPWIGLGPRVLLDLVYHSFLELLLVLCFYPHGFWGFRQFLACGSIIPSFICLHMAFSLVAVASPLPVKTPVIGFTVHSKSAMWLHLREGVGQPGEDVSQQQCYPAGQLVIFTIKQDSNKDRMRNPVVKTQYIILTPGSP

SEQ ID NO: 925442 - protein, 209 aa, Homo sapiens
MRCTDWPSHQSLLVSALIVQTLCSAQPSSLSPAHLAGHLGQLVNPWAQLLLWCKQGGAQGYFAPQMMPSRGRKGGCLEPGSLQKAWRRSPGYPELSCTSLSTTDCPLGSAPSAGAQLPARGVASGVGISQPLTPRRHVLDTVWVESRACLLICLARGTGFGLLVTFSKNGRVSSFCLPCLKASLAPGTRVLFLHDPISTIILMYLFLPV

SEQ ID NO: 925443 - protein, 149 aa, Homo sapiens
MQSLLHKQLVGLHDFPAVRFWEVAILRSCCLLCGRRRRKGRRPGKEQRESDAAYEITGPIQDHPVILDSFGRFLLGVRGSVSVTLQAPALEALTLQWRNLRKILERQLASLFAMTVHLLPSHVDLLPQLLPLAPMVLATDGLRKPSCGV

SEQ ID NO: 925444 - protein, 211 aa, Homo sapiens
MPSTKGRLRALHFVFVNTITIITIVFLISTLITTITIVTIITSITTTITNITIITTITTNITIIITLITIITTITALTPIITSIIIDEGTCATLEDLFFIKSLLLNKYLLLYIIAVTIITIIIINIITTIITITTTIIIVITMNTTIIITTSISIIIIIITIIFITTIIVITIVTIIVIITTIIPTTAIFIIILMVLDISLQLSGPQFPYL

SEQ ID NO: 925445 - protein, 278 aa, Homo sapiens
MGEDFAQFCFPQGMETEQGLSNTECPRGSSTRFSAAIAPSIPDRASSSRGLMEEPPDPALLSWKKQAPLVQHCLTLFPIIDPGAWGVDIKMDTVLTLRGTCFGGDSPCAQSHGTVWVCMPLAPLKMANGNTKLRCDDSACDKWGRRGHRSTERQSLLKVTQLATHSLVCSSSSRLREPLPRMQLSQSGLELPKPPRGPTPPGPEVQRENGAGAGSHSNHWGESRSLPASFMPLACAADNGGMKPWLCGELADISASSLSKRLYQGSLAEFPLPGDPAK

SEQ ID NO: 925446 - protein, 117 aa, Homo sapiens
MCGGAVSGPAERGTGILKGTRGSLEAPKMIANSAGAQALKTPGAGRNWSPINGENTTKGIIKEIIQGSFLALKNMNLQIKGPTKWSKQGVFVRSCTTNCSQGDPEWARLDPHTGETS

SEQ ID NO: 925447 - protein, 181 aa, Homo sapiens
MVEPSPPCPKFCLFFNPSSKSQPTPARPHFLGSAQSGSLPVPAGNCLELKSELAQQVMGSTRHKGPGSCMCLHGNGQPAQNLCALTGFLYSKESGSVRVKPSPNLPGFARAFYLLILMANRCLWREMSASRGLPLLLVNYVALVKSHNSLEPWFSHLSRGGLMFTLQIPQEFCEGWMMQYS

SEQ ID NO: 925448 - protein, 156 aa, Homo sapiens
MEVNANVAQHLLSADIRLARGGCHSNSHQFSLAGETQVYNSIMFLMVTAKKDSVRVKADGHSLNCLPSELLAALPPLAKGFQGDPKVVFISGSPERNTNKEESTVPQVRVQGPPLVTKNHSQGKGKGHKPWRRIFGSVHPTFCSSHTNTTHNLQTS

SEQ ID NO: 925449 - protein, 151 aa, Homo sapiens
MKAAGSETVPCKATGVETPKTMGTYLLHQCDLDVNTPEHGSRFCGSIKGSITLNIRQVQKKPLLIYQCLDSSFFASVFWTSLAQFIWHWEPDLVFSPAFKGTPGLRQPLVLLMEGAKLIPTLYKIHSRVYYLQTLDREGATSQMERAVLHP

SEQ ID NO: 925450 - protein, 139 aa, Homo sapiens
MFIHISPTFPGLVSAVTIFFYFRQELLVNGGSTTATTFTQLCRGNQRLSLANSVENNILKLLQEENQCLIHTFYSQPNQTFSYIYEELEETQQPFTVLFTKLTHGFHGAYMMHVCLIKSQYCAKYSLAYFYFHMHYVNK

SEQ ID NO: 925451 - protein, 139 aa, Homo sapiens
MNTNKETTDTAMYLRVEGRRRKRSRKDKYQKSVHDVAKSAEAELTRQVSPLAGFSIRALRVDESSQGTVFVWNGGGNTAVIAKISEDSGPAPGSVPYDQEEMSQHASFTRGGEGNGKKHSTFPRDLHRGLTFFLPILEL

SEQ ID NO: 925452 - protein, 242 aa, Homo sapiens
MKAWENFQAPQLQVCWSLLVVHSRPYLPGYHQQRLQNSKYCCLILPLEASSQRGSHQMPARALQYEVSVSPYWEVSPSPATRGAVRQGRLSLLKLCSQLSLPPGALSQGDGGFIYKSLTGAAVFCSQMPCPQRCNLERQSALLSCDCSTSSENFKPMDLSLLGSLGEGPTEPSTRGNLLVCQLQRPWEKHSIWAGVYLSSWYSVSQLPLARKGKSPNPLCFPDSSISYSFGILGSDYLTNST

SEQ ID NO: 925453 - protein, 185 aa, Homo sapiens
MALDSEGQEIPSSHFCLSIGSCAVPGREQHEAREEPTTNSWSTQVTAQEAPVDLATAQGPEMTRMVSPTLCVLDDSGGSSRMVLPKSLESWSHEGGVVLKRLQFRPIWEVRSASARPPHLGCEERLCPATTPSGKWGAPLPGHPIWDVRSTSARPPFVWEVRSASARPPHLGSEERLCPAAPSGK

SEQ ID NO: 925454 - protein, 245 aa, Homo sapiens
MSALRVVPDSKSGGWPSVTEGSGKEPGKYPRPDNGGFRGAWMAGHSPLCEAELTAKLEHTQHHLQTPSIPGTQRAVAPNPPPGRQALWLVPTQPAECLSALGVDPPLHTPNLGGLRTAVLPTHSTTVLPGQPPVMVGSRHSSVSPPHRQLLQEPQLSGPPLPMARLCCLCLRPILMTEPPGSPSIAAPQRCSGSDSGPLAPPGHRRLSPAFCLPDCAVLWALNSPSLREPFISLGEGPLGQGNPV

SEQ ID NO: 925455 - protein, 232 aa, Homo sapiens
MRRTPPSTPATERLPRAAWGLGGVLGSDTGDIQAASAEGALDLQQQGMNGECSPQRGTTSLSVAPAKSSGVISTPPFDPQRQSVEASCYVVRTLEQSYGEAHVLSGSQPARNGVGFGAATQFSDGDPRLKERVVMFPRLPSDSGRVAIRTQVILTPSQELSLQRLSHRRSLVLISKVAGEPGEGRGVLAHLRPGCQSVTPCLHGSEEAPAHVGERVLCVKNGPRQPERERLH

SEQ ID NO: 925456 - protein, 146 aa, Homo sapiens
MPNGQLLVQSPHCTDKEIEAQRGIVTLPRMINEHWSQLQVTSCTVPIQRVSLSFEALNLDIDFSSTTMEVLDGIFFRKKAVSSTLEIYLGPVLPSCVHWSSTFNFLQELFLYTYNLAVWHKRPSFWPGLALTCCPRYTPLFLAFDL

SEQ ID NO: 925457 - protein, 238 aa, Homo sapiens
MRTALALIPGSSCPELWPLGSLFIVFWPVAKGSGQQSNLPSSLEGDGISSKAVCYTSILEKIVWYKSCQCLCSEGLQNCGRPTENVWQISKGEDIEGCNICIDLPGFPSDHHPPQYPSSPKSFFLEVIMFYRVADRNTTPCNKKSVWSFRERWPALVGAMGEHHGFCKVKLNFCLGVHVVQGKLTALPAMMGAHDWSTLINGFHAAGHSSGDFDWDGIESIDQVRKNAHLDNIESFYP

SEQ ID NO: 925458 - protein, 183 aa, Homo sapiens
MDPGSVSASSALVYTRSFFLSWRMIGRLTSFAGHFYRKGESIKEGLPQPICTQEMNPLANPDIEAKTEFFIPAAAGSPGPAHLQQDIPFLPLPWAHSFSRTPISLSEKAKAFTMDFETLWDLALSHLSDPCYCHCPLPYPAPATPASPTQGLDVKFSFNLVHSSPSEVTHEATEGTVNINQQN

SEQ ID NO: 925459 - protein, 244 aa, Homo sapiens
MKNVYFEANCGHVQHFGSPPKTVGLYRTRDVAQGGALLFGRSHDHLLVLLLGLAAGTCWQDPNCSPTPSWFLASACMSSAHKMLGSTLGYGSFQKLNSRSNWCLLDNSIQLHSFRTSRCSAWSCSLQHVFHLPMREQGSPHPSAVWTVLPPSVPTIGIRALRLLTVKLDLVEVAGLLLGQQGRVGILPGIHFVNKEGAEPVAFVVLGIEMQHSRSCNIPSTGLGLPVATVTLQRCCTATKPWVR

SEQ ID NO: 925460 - protein, 147 aa, Homo sapiens
MTPGSLPPDICQRWHQGVSLGAIDQHWARGLQPAGPVPHTPRTNLLTKELADAADFYQRVSGGPPEGLDAGSQNGGISMMEDGDFWRSDIKRHLLDTHTDQVEGLIELQILPFYNPEEFKHSPVTIPANFIPNPASFADLQILCKGE

SEQ ID NO: 925461 - protein, 215 aa, Homo sapiens
MPLFRLLGLHVDDCVCVLRQLHTRSGIHKRFCGLKGFLPERHNPGQLIHQNQLIDRVYKGIPMNIRGPVWSVLLNIQEIKLKNPGRYQIMKERGKRSSEHIHHIDLDVRTTLRNHVFFRDRYGAKQRELFYILLAYSEYNPREVLAKVGWAGHCDTEPIPHMTQMKVESVGLYEETNKEARGPVPPPGFLEIPGVEVNALAPNGPGYRGPLVPPL

SEQ ID NO: 925462 - protein, 147 aa, Homo sapiens
MEGGINFKVTQRTPVRTGLNVGFPLGSLGSWEPSPRLPPQPRRNEVSPQAATAPRSLTPLRAPRCWAARTEPAAVVPVSLATGIGHFRYHGRHSSQIKARVAHPLERTGGQRTDAPLPFPACFSPVLALAQVPRRRRLPSRLPGTAK

SEQ ID NO: 925463 - protein, 217 aa, Homo sapiens
MHIREGGRWLEGSDRADSGSPFQEPRYPSSGPFPIPQASFPCPCLLVLGIHGHSTLLQYRGQEHHVLFTGRCLLVDPTLLVLVVSKKSPNALEASQPGIRERRTSAAGGWARGLRAARHARISCHPAGLSAGDQWGRTLRAEEPRPPTAPGGLWGVRGGSRVRVRGGVGVAVGGKSMGLYFCLSACWDLQFVRTFHISRIFTESLPRPRLFWTPNQA

SEQ ID NO: 925464 - protein, 1193 aa, Homo sapiens
MAAGSGGSGGSGGGPGPGPGGGGGPSGSGSGPGSNGGLGSGGELHPRTGRLVSLSACGRTARRQQPGQEFNHGLVLSREPLRDGRVFTVRIDRKVNSWSGSIEIGVTALDPSVLDFPSSATGLKGGSWVVSGCSVLRDGRSVLEEYGQDLDQLGEGDRVGVERTVAGELRLWVNGRDCGVAATGLPPRVWAVVDLYGKCTQITVLPPEPGFSPPTPIPTPPLEPLAPTEDSALAEQGTSADEAFMVSPAQARPETFPNSLESHNDFANMELSEVVSNTILSAYNGGLLNVNLSSPPAGEGLGSSGAATSPILTSNDALLFHEKCGTLIKLSNNNKTAERRRPLDEFNNGVVMTNRPLRDNEMFEIRIDKLVDKWSGSIEIGVTTHNPNSLEYPATMTNLQSGTSPGQGRGCRPGVAEGKEAPYPNPSVHYHPGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQVRIDKMVDKWAGSIEIGVTTHNPAYLQLPSTMTNLRSGTWMMTGNGVMHNGTTILDEYGHNLDRLKAGDTVGVVRREDGTLHFFVNGMTQGPAAWNVPPGVYAVVDLYGQAAQATIVDDVGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPEVYAVVDLYGQCVQVSITNATGPMDNSLATSNTATEKSFPLHSPVAGVAHRFHSTCGKNVTLEEDGTRAVRAAGYAHGLVFSTKELRAEEVFEVKVEELDEKWAGSLRLGLTTLAPGEMGPGAGGGGPGLPPSLPELRTKTTWMVSSCEVRRDGQLQRMNYGRNLERLGVGSRVGVRRGADDTMHILVDGEDMGPAATGIAKNVWAVLDLYGPVRGVSIVSSTRLEESEGTQPPSPSSDTGSEGEEDDEGEEHGLGGQNEVGIIPTTLEFLENHGKNILLSNGNRTATRVASYNQGIVVINQPLVPQLLVQKKVPFCYKLKDM

SEQ ID NO: 925465 - protein, 136 aa, Homo sapiens
MLLSPQAYEGRGQCTASPKPRLPSLEEADGLIFRCSPYPPIMPMPGEAISDREENKRQLVGHDTYNLSGKTMTFWTQKIHFFSYTTSTASFSTVQVLNFWYLGFGIKFKHSIHGTMHITPLSEGRKHLYDNAGPMI

SEQ ID NO: 925466 - protein, 145 aa, Homo sapiens
MDASLSLRLQHATSLPTRKQPSAFVGSDTLPGATLPSPPHMDVLLHSGSEATAGYFLNIQGHEKPFLYIIPCGPHRHPKALLRPLLWWNFRMKRRLTQRFQKLGQRGAHTTTCLLSSSHFLQWSHHKVPASRATAGNPGPQGLMA

SEQ ID NO: 925467 - protein, 154 aa, Homo sapiens
MGASENWLFLDMPRGLFPRTSLELDEECHGRCNAPSPHLPAEENELFPGPVRIFVIIFLVILSVFCICGLAKCFCRNCREPEPDSPVDCRGPLELPSIIPPERVRVSLSAPPPPYSEVILKPSLGPTPTEPPPPYSFRPEEYTGDQRGIDNPAF

SEQ ID NO: 925468 - protein, 142 aa, Homo sapiens
MPSSGNFKIPFTGPKGFLWSVFTENAYIAKCGRGLGSNFNAAGDSDPATSHVLPHKGPSTAVDSGTMQHSRPLLMPKPSLPQYSWDPLGPTDLFPWVILVPCASASTAHLALSSYCPLCRNLSQPPTAPPSSSLALAQTLPQ

SEQ ID NO: 925469 - protein, 149 aa, Homo sapiens
MNTRTLYVRKRACDLPRFIPKMPLRTKVTIQLLEHFRNKLEEGTGLPAETTDRFSRRTFKGLFGLNCSQALDSLLSDTVEEIGWLSKELHKGFIEDLTKAKKLQHLSDLWAYTIDTSDPDDKRQFGFCRVSGTAGTFFFFSSTPSMVLA

SEQ ID NO: 925470 - protein, 138 aa, Homo sapiens
MKSGELGQLKLEFSLAPPPTLSYFPNSFLSETSPSALSNLLGEKKWLSSVQQMMNRRKALAGPRLARGTQGPQFKESVLRTWERVNASLSQYPQCFTCCAVESSTWETFQEGTKRGGEGGETWAMNLKQIRALEEEMR

SEQ ID NO: 925471 - protein, 181 aa, Homo sapiens
MRTGARGIFTAYYAIEVTKEPEHMAALAKNSDWVDQFRVKFLGSVQVPYHKGDVVLSAAMQKIATTRRLTVHFNPPSSCVLEISVRGVKIGIKADDSQEAKGNKCSHFFQLKNISFRGYHPKNNKYFGFITKHLADHRFACHVFVSEDSTKALAESVGRAFQQFHKQFVEYTCPTENIYLE

SEQ ID NO: 925472 - protein, 360 aa, Homo sapiens
MTQNKVLYLGKVKALAPTDEACSEIVGSMLSPIRDPIEIQTPCQRVPKKCILCQGYSRKVWEQLKGRHCYPPPGPQCRAVFCMWRQFGLMVKEGQAHSNCSVNGIIGGVLWMSACDWLNDQRGLKILVMESVVQINCYTDPECGKPWSLKLFSLHILEQTRQFLPGIASVCPSVSSHTLTSDKMILDLIISPSDPYGNNNELFPVSIPKFISNPGYAFPLTCGSAVLPSASQFPSCPRFLCRTHLPTGCTSCEGKDWQTVGSFHFRNGPSTSLGEEFSSPDPDLVSWHPLGKWVLEDKPGIQKYMFVDLFIHVANHFLSAYHGPVSDPTSKAAFTQGSSHTMLVRVKVWTNCQEAACQYA

SEQ ID NO: 925473 - protein, 163 aa, Homo sapiens
MGRCPGKWQTCSKQHAAFPSDAQGHLGGGRDAWGFSSTPQHLRGQPKLSLQVTSQTPGNHNTYDDDDDDDDDDDDTYLKDCPEGSQRCLQGTCMEQAPLLWQVLGEHYLLPGPGAMALRDPASPTWRSCRSCAQSVLVVRLRRVTSFCSPGTSFWVLFSAYVK

SEQ ID NO: 925474 - protein, 116 aa, Homo sapiens
MEWSPPGHTVTLMKRQKCHCFVKNGLEAKENILITFEKADTLWHQGLTSNECITEKIRHLCKCVCFHESADLQRILRSITNCFSNKIGLVEGVAAVDTNCFSDAVQVGMKCESCQH

SEQ ID NO: 925475 - protein, 144 aa, Homo sapiens
MTLSRRVTQKVLRNVFALTGRQAVDFLGFGVGLGQGEALWTQEPLSSAQPAGFLSLSAKQKAHPSLCVTTASFPPPTIGFPCQGKSHNLEAVVILNTVAYSGREGKHLFQKLPSLFQKAGSWKEGFSCQGPEQLLTEKGAGYTD

SEQ ID NO: 925476 - protein, 157 aa, Homo sapiens
MRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKKTFLVGV

SEQ ID NO: 925477 - protein, 137 aa, Homo sapiens
MAPFLVAKSTVQMALKEDSGKQRGLLTGNDSGINRECWHGVAHILATEVPILNTAARVILLRPKPDHVTSLLKLCSGYFPEQKSQSPSYSVHGPMWSDTVSSPPHLPLSSPLLAPAILASLLDPTQARHPLVSGLLC

SEQ ID NO: 925478 - protein, 154 aa, Homo sapiens
MTVPPSWQELSQPDDCLGKLRFNEVKYLVQGKNKNLGGGGAGLVVSWTLEELVLTRQRGPFQGPSSTSEHQARSLYPNKRRNLLRKELVKPLRLLLCSGLAPSLKVPENGTVLILGDGFHAQVGFSSINDAAEFRVVADAMKVIGFNLRRSNSG

SEQ ID NO: 925479 - protein, 140 aa, Homo sapiens
MQITEGKRNKMCACTNDQRWNGYSVHSQQEGELIAGQKNCLLGFAVKRNRHGAAAEEFDGVCVLHTDDLERPLHTKGNDARGKEEWTTTEVNKQSRLGHDCGKPDRCFPVSNRQTNPLGILFECRLLFSSSGIDPEILCF

SEQ ID NO: 925480 - protein, 138 aa, Homo sapiens
MILIRQLPEPLRSDLSAVLELSTGPAGGLGSSCKGARGFEWDLNPAHVGESKKLFSPEDAGPRSILESDAHVLSSVPLLAAGCVASLEVLTCLRGLHIASLFFPASCLSPFFAGPIHPPTPILPHSPPCLLPLFPVLI

SEQ ID NO: 925481 - protein, 972 aa, Homo sapiens
MSVDYQASFVGHPPGSAYPKLNFVEDSKVVLGDSKEGAFAYVHHLTLYDLEARGFVRPFCMAYISADQHKIMQQFQELSAEFSRASECLKTGNRKAFAGELEKKLKDLDYTRTVLHTETEIQKKANDKGFYSSQAIEKANELASVEKSIIEHQDLLKQIRSYPHRKLKGHDLCPGEMEHIQDQASQASTTSNPDESADTDLYTCRPAYTPKLIKAKSTKCFDKKLKTLEELCDTEYFTQTLAQLSHIEHMFRGDLCYLLTSQIDRALLKQQHITNFLFEDFVEVDDRMVEKQESIPSKPSQDRPPSSSLEECPIPKVLISVGSYKSSVESVLIKMEQELGDEEYKEVEVTELSSFDPQENLDYLDMDMKGSISSGESIEVLGTEKSTSVLSKSDSQASLTVPLSPQVVRSKAVSHRTISEDSIEVLSTCPSEALIPDDFKASYPSAINEEESYPDGNEGAIRFQASISPPELGETEEGSIENTPSQIDSSCCIGKESDGQLVLPSTPAHTHSDEDGVVSSPPQRHRQKDQGFRVDFSVENANPSSRDNSCEGFPAYELDPSHLLASRDISKTSLDNYSDTTSYVSSVASTSSDRIPSAYPAGLSSDRHKKRAGQNALKFIRQYPFAHPAIYSLLSGRTLVVLGEDEAIVRKLVTALAIFVPSYGCYAKPVKHWASSPLHIMDFQKWKLIGLQRVASPAGAGTLHALSRYSRYTSILDLDNKTLRCPLYRGTLVPRLADHRTQIKRGSTYYLHVQSMLTQLCSKAFLYTFCHHLHLPTHDKETEELVASRQMSFLKLTLGLVNEDVRVVQYLAELLKLHYMQESPGTSHPMLSIAGHLSGKMNEGDSQVTVVVWWKTGGQNTHRLLQTQMQPFICFLEPTVLGEALDQPVGSVSSTLSAVLATFTWERSACERALGLTPHTLSPGTSRVFTSPSVKRAQVTKANERMSTDLPRGEGLQTRVNMAEATLQLPPT

SEQ ID NO: 925482 - protein, 470 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRELTLQIQSDTGVRATLKEFKERLAGDKYQAAVQALREELKCKT

SEQ ID NO: 925483 - protein, 202 aa, Homo sapiens [sequence omitted]

SEQ ID NO: 925484 - protein, 202 aa, Homo sapiens
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVVESQSGSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 925485 - protein, 181 aa, Homo sapiens
MLKGNAHWRILDSIFQCFIIDKAPLHACSHQRASFPDIEPCPGLSQGERVPAHWAKPTHHPTKPEAWRPASTAEQGLRVMLQSCLWSTQPRLSEFPAGGSLGTSGCRLSSVPGTETPALSRLWGWLMAGTTVLTGLVCFRNLANCERLIEVEDMMVMGRKPDPMCVFTYVQSLYNHLRRFE

SEQ ID NO: 925486 - protein, 385 aa, Homo sapiens
MGPSPGAWGTLLPAHERTKLQCAHPPGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKGEENLGLEQKQKASWRRQDPVLSLGASGGFGWGKGEWPK

SEQ ID NO: 925487 - protein, 487 aa, Homo sapiens
MADYLISGGTRYQPEDGLTAQQLFASADDLTYNDFLILPGFIDFLAGEVDLTSALTRKITLKTPLISFPTDTVIEADMAIAMALMGGIGFIHHNCTPEFQANKVQKVKKFEQGFITDPVVLSPLHTVGDVLEAKMRHGFSGIPITETGTIGSKLVGILTSRDIDFLAEKDHTPSSVSKKGKLPVVNDHDELVAIIARTDLKKNRDYPLASKDSHKQLLCGAVVGTCEDDKFRLGLLTQAGVDVIVLDSSQGNSVYQIAMVRYIKQKYPHLQVIGRNVVTAAQAKNLIDAGVDGLHVGMGCGSICITLEMMACGRTHGTAVYKVAEYAWRFGVPIIADGGIQTVGHVVKALALGASTVMMGSLLATTTEASGEYFFSDGVPLKKYQGMGSVDAMEKSSSSQKRYFSEADKVKFSQGILGSIQDKGSIQKFVPYLIAGIQHSCQDIGARSLAVLRSMMYSGELKFEKGTVSAQIEGGVHGLHSYERWLY

SEQ ID NO: 925488 - protein, 147 aa, Homo sapiens
MSVGPGAEAWGRWTFDCTDETRIQKGLSNDVGNVELCLPCSSHNTEQSSDPRWVGFSLHTGQAVLRQPAPAEGPHVQLNSDMLHLEVASALTGRGLSPTRLLLTSEAHHQPPWESMHKKSPMTTQKKMGEKSLLWIEINDRDITAYT

SEQ ID NO: 925489 - protein, 637 aa, Homo sapiens
MIPTAYCICIQVLVRRPHSLSSELTGTCSLLGPDLRPQAQANFFDLDARVDTGDCYSNKEGGGEDDVNTARQRRATGRRRRRKTRRRRKDEEEEEAGTEIAIILDGSGSIDPPDFQRAKDFISNMMRNFYEKCFECNFALVQYGGVIQTEFDLRDSQDVMASLARVQNITQVGSVTKNCLSHATRLVSVGAAGIILAMPRVSVASLMEEVAGQNRRRRELGLQPFPGRERTDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDEVLLGAVGAFDWSGGALLYDTRSRRGRFLNQTAAAAADAEAAQYSYLGHFEGLTGKVPGPRERPGGSTRCVHSHTTLAPGYAVAVLHKTCSLSYVAGAPQYKHHGAVFELQKEGKRGQLPASAGGRAVSKLICNDPNWMGSYFGSELCPVDIDMDGSTDFLLVAAPFYHVHGEEGRVYVYRLSEQDKLTDVAIGAPLEGFGADDGASFGSVYIYNGHWDGLSASPSQRIRASTVAPGLQYFGMSMAGGFDISGERPCRHHRGHSGPGGCVPHLPELLLTVIPK

SEQ ID NO: 925490 - protein, 135 aa, Homo sapiens
MANGIRASGSTGDDDAGLGEADLSFSRRSREAHFVGCKKFEYLRLPCWGGHMYVLWSHGLLADSNDFQARGERKSILARAKVLGQEGDAERRPEKLQSGEQGEARERHGAQTLQGALVNEPGSTRLEMALEGETV

SEQ ID NO: 925491 - protein, 145 aa, Homo sapiens
MAKTQFSFWEKEEQVKKNMKESKGLQAKTQVDILKPPGKLRGNRLPAPPGSWGKWHHEDPSLHRGVLGHISLQQSSLRAADVRMCVGPQHWQHSCGLTPPALLQPSFILTRLPGLSSPSGPAGGFIPATSETAQELCLAASRFHK

SEQ ID NO: 925492 - protein, 137 aa, Homo sapiens
MWYVQLECDLWVAEPFLLIKHFNIILRSHQALLPAAAKHRQWQPSLLCPLLTPEPGSSDFPSKSNPLIPQINMCQRDPLSWQDPVRTSSASESSKGSLHILLLKTQKKFALENELLPMHLRVKVMLPTAHCMTNSGI

SEQ ID NO: 925493 - protein, 131 aa, Homo sapiens
MGCKDVTIREMQSAKDSRQPTVQGIANTGALRKSSRLTWDSQLCQMLDIACSQMLDHAALEILLNHHSKQKVILYMNDPKRAGPLPLKPSSPVVEIPVYEDPPQPVMVGDLASTAIPFLHTPKDKYRSFAF

SEQ ID NO: 925494 - protein, 145 aa, Homo sapiens
MRNGFKIHPGSYDLGLSNLLEVPESLRCGVRQDEGLKGSPEETCYQVRGIEQGHAGVLEGASRESGESRKYTPYPELQGGGGHKLRWSQEIRAAGAAWEMRTEVHMNVSKRASRDSGARAGGRPPASTWAQSTAVGVWMPQGVNL

SEQ ID NO: 925495 - protein, 136 aa, Homo sapiens
MANEQLLFNYWTQLYFNSLLTAVKQNSYSEFYNSKPHKKTTILEATCIPWLLSPIFHLRSQQQYIDHEERAHPSPGEVVGEAICGNKAMNLTRNVLKIVYMEMNTHCPLHFLDDKLEKKNPKNEVVLFVLTSDLGN

SEQ ID NO: 925496 - protein, 135 aa, Homo sapiens
MELDMQSIQDIIAKKLSGGQKRKLTLGIAILGDPQVLLLDEPTAGLDPFSRHRVWSLLKEHKVDRLILFSTQFMDEADILAASTCHWLQQVTWGVTLQSYMAKYVDKGRGEESGHPWKVLRHWISYGECSEFLRP

SEQ ID NO: 925497 - protein, 390 aa, Homo sapiens
MIQRDLQIQGERAIPDKLEEEKKKEKEEKEKKVEEEKEGEKEEKEEKEKENKEKKEKERKKRRKRKKRNRRMRRKKTRKEEERIRRKEKNKEEEKKRRWRGKMEEGREEEEYPWGAGRPLHMQTAHTKGRIMDTGYWEYANASCNHLEGSEKDMKMWESLELPTDLLNSFDQKPDSNMDNKVQAEVVSDEDQELAGNWSKGGSCYVLAKRLAAFCPFPRDLWNFELEKDDLGCLEEEISKQQTIQEPDNVIEKKNPSSSEEKFKLAVEICISNEVLNVNPQDNGENVSRACQWSSQQPLPSQAGRLREKWFCGPGPGSPCCVQPRDLVLCVPATVAVAEMGQRRASAVASKGASLKPWQLLGSVEPAGEQKSRIEVWEPLPRFQRMYENA

SEQ ID NO: 925498 - protein, 176 aa, Homo sapiens
MIQQIKVEIRCQKPRAQQGAMPGRKGGYLCTGGCSCCIFPAVKLHFSEATDLGAFISLKPTFNNNKLRESGELFTNVWNSDRYLLVLLDHSNKHYKFYCGDASNIDVIDDEINDCSTAVLIREIKCRWSQGSKLLLGRNAWVGCYRCNESSAESSFEELYSQSNLNPKLGGNSTSW

SEQ ID NO: 925499 - protein, 145 aa, Homo sapiens
MCQKYHFNIKIINIKHFKSAAELHAYWNQGLDLELWPREKNGHLPSLSLSCEWSPLYVSFQANGPLWHQPCGNNISGLPHLISFFPRQYAAAYAKVETVENTHYFMWEPEKMEISSDEQTGMFPTVINKASTRPDLKSNTPTAEN

SEQ ID NO: 925500 - protein, 343 aa, Homo sapiens
MINGSQGGMQLACLNKFMGWQTEELYGDFEDLETGDVHKGKSGPDTQRNKEEIDPDKEESAKKKHLDKKRKLKEMFDEEYDEGESTYFDDLKGEMQKQAQLNRTEFEDQDDEARVPYEGFRPGVYVRVEIENVPCEFVQNFDPHYPIILGGLGNSEGNVGDVQVGPFAAYLVPKALWISPPSIILHSHPPQMHLKKHRWYKKILKSRDPIIFSVGWRRFQTIPLYYIEDHNGRQRLLKYTPQHMHCGAAFWEGAFRASFEDKLLMSDIVFMRTWYPVSIPAFYNPVTSLLKPVGEKDTWSGMWTTGQLRLAYGVRLKANKDSLYKSLRSKLQGMGVTLDMGVT

SEQ ID NO: 925501 - protein, 415 aa, Homo sapiens
MRQAEARVTLRAPLLLLGLWVLLTPVRCSQGHPSWHYASSKVVIPRKETHHGKDLQFLGWLSYSLHFGGQRHIIHMRRKHLLWPRHLLVTTQDDQGALQMDDPYIPPDCYYLSYLEEVPLSMVTVDMCCGGLRGIMKLDDLAYEIKPLQDSRRLEHVSQIVAEPNATGPTFRDGDNEETNPLFSEANDSMNPRISNWLYSSHRGNIKGHVQCSNSYCRVDDNITTCSKEVVQMFSLSDSIVQNIDLRPIQNICDLPEYCHGTTVTCPANFYMQDGTPCTEEGYCYHGNCTDRNVLCKVIFGVSAEEAPEVCYDINLESYRFGHCTRRQTALNNQACAGIDKFCGRLQCTSVTHLPRLQEHVSFHHSVTGGFQCFGLDDHRATDTTDVGCVIDGTPCVHGNFCNNTSVFYYFVGER

SEQ ID NO: 925502 - protein, 124 aa, Homo sapiens
MNLGNTKGVLCTVQGVTAKSCNPSKGPANLPHGHRFRPWKVTRGSALSHNCSVDQQLLSTSSLFTLLSVIPFCCLLIEFSAYTLLQVIVVAFTANQWTRSIRVFGNFAVHWTSVPDTVGPGIIH

SEQ ID NO: 925503 - protein, 152 aa, Homo sapiens
MTRARSYKSLEQSSFLELTEGRNHFSLLLLLLLLLVVVVFFFFFFFFFFFFFFFFFFFFFFFSSSPSPSPPSPSPSSSSSSSSSSSSSSSSSSSSSFFFETDENAPTTNALSPKASCLQTDSKQETICRCLIPPLPPPIGTDPELTAETPTQ

SEQ ID NO: 925504 - protein, 240 aa, Homo sapiens
MMTMAVLWNRKGGKADFIPLDGIPANVIQRGKQYQAAALVMLKMEPPGKLLPMVIQAVSTGGGGHVQLLHWAAAQLTCCSLCCPDDLAACGLLGLPPPSPLGRCVEIVHLLHQRDDTVRVDPELQAWDQEIMEVGLCQAQDRVLPFWGQDPTLSSHLPSSTQESICIPFPPPQTQDTSRDLRTVLLGDPGHQPYPHPTPVTDAPELPYPGAQPGQSHSCEGVCRSLLGLMFSLHVCLLFT

SEQ ID NO: 925505 - protein, 184 aa, Homo sapiens
MKHFQVSFFLSSILYNEWHLLQVGHPENLTRHVPHRPGAVSGEQSPPVFRGTDTGAQCEVQLVESGGGLVQPGGSLRLSCPASGFTFSNHYMSWVRQAPRKGLEWVSYISGDSGYTNYAETHSEGKSVRAQAQTSLKGSQRPPGGARTLCTGLSPGQVQVLLRAGFLSWPGAASSSTYCHLFDS

SEQ ID NO: 925506 - protein, 147 aa, Homo sapiens
MGPAEPGPGVHQVQLLSWPLPGVTSNKPYTEEAADEFQQELTRKTLRKLGLEAHFLNLIMAVLRPFNIILETLRSATKQEKEIKDINIGNKEVKLYVFSDDIITHIEDLKKPFKQLPEPISECSKVRGNEVTMQKSITFLYAVLNNF

SEQ ID NO: 925507 - protein, 568 aa, Homo sapiens
MHGRLAQCLLEHTGHWKHSVVAEGAVGQRFQQQVTGNDSAPLTWYLSARPRRKHAEFLLSHHTTGCMDEYTGELFALGGSASNQGCASSQDSASSQGCARNQDSASSQGCARNQDSASNQGCASSQGCASNQGCASSQDSASSQGCARNQDSASSQGCARNQDSASSQGCASSQDSASSQGCARNQDSASNQGCASSQGCASNQGCASSQDSASSQGCARNQDSASSQGCASSQGCASNQGCASSQGSASNQESASSQGSASSQGCASSQGSASNQESASSQDSASSQGSASSQGCASSQGSASNQDSASSQGCARNQDSASNQGCASSQGCASNQGCASSQDSASSQGCARNQDSASSQGCASSQGCASSQGCASNQGCASSQGSASNQESASSQGSASSQGCASSQGSASNQESASSQDSASSQGSASSQGCASSQGSASNQESASSQGSASSQGCASSQGSASNQESASSQGSASSQGCARSQDSASSQGCASSQGCALNPCCRGQSSKASLGPCGFFSARRNLQEHPAPCQMGAFTPGNILFIISCCVSAYFSNELSHKRESLG

SEQ ID NO: 925508 - protein, 329 aa, Homo sapiens
MLPPGRTLGGGDGPAPAGLGHEDPAGNLVLTAHRSRGVEGETASAVLVQHSMEVGGGGEEHASPNPWGPVSAACKLRLQEEACSSAPLTTSRCENVGATPPTTSCSENVDAAPLTTSRSENMDAAPLTTSCSENVNSAPLTTSRPENVDTAPLTTSCSENVDAAPLTTSCSENVDAAPLTASCSENVDAAPLIMSHSKIMDIALLIMSCSENMDAAPLIMSRFKNVNTAPLTTSRPENVDAAPLTTSCSENVDAAPLIMSHSKIMDIALLIMSCSKNNYTQYIPLSIYDLQTWMGSPSIFVYDCSNAGLIVKSFKQFALQREQELEEQK

SEQ ID NO: 925509 - protein, 246 aa, Homo sapiens
MQLAEPQAPRANLVPHGYDPREGAHGYDPREGARGYDPREGARGYDSGEGARGYDPREGARGYDSGEGARGYDPREGARGYDPREAGFPDVCSALSREETLEWVAPLRSWFSRRLLSSQQRGDLGVAGFPDVCSALSREETLEWVTPLRSWFSRRLLSSQQRRPWSVQLLSAAGFPDVCSVLSREETLECAAPLCSWFSQRLLSSQQRGDPGMGSSFLKAGYAIVSLSLAESRVFMGFKGEEVCAD

SEQ ID NO: 925510 - protein, 144 aa, Homo sapiens
MTLSPRVFLGFSWPLGFGEEDHRGECPSGPVIMRVHAVGMADPWWRWPGSLAEVEQTRLRGCDMQKINKIALLGSTFVKLASSTEAVISEEGLLRGHICEASIFHRSCHQRGEPSAFSVALALWAESLRGRRSMHLSLFVKTFS

SEQ ID NO: 925511 - protein, 195 aa, Homo sapiens
MTASAGSSSPPPASLHLGPLALPPAWFPWGAALLCQPSLCFQSHPPACPRMPSSSLSPPSVPPAGAFLLLIRGPVSSPSLSRLARCWFVALPWTLLPGVQTFELCFPSTAGPSPAPARPQLISLHSPFFAEQLTAFQVWLTMGVENRNPPEQLPIVLQCSSPTTGKLLPLHGSPGPMLLTRWLLRGSRAGRPPGA

SEQ ID NO: 925512 - protein, 923 aa, Homo sapiens
MQCNGMEPLRVEWIGMEWNGMKGNGINPRGMEWNGMQWNGMECNGLEWNTPEWNGIEWNGMEWNQPQWNGIEWNGMEWNGMEWNAMEWIGIKPSVMEWNGMEMEWNGMELKRMEWNAMEWNGMEWNGMEWNGKESTRVELTVMDRNGMEWNGMEWNGMGRNGIEWNGKEWIGVEWNGMEWNGMEWNGINASVIEWNGMEWNGAEWNGIDLNAMESPGIEWNGMESNRMERNGMEWTAVEWNGMESTCVECNAKEWNGTEWNGMEWNGMEWNGINKSGMEGNGIEWNGIGMERNGIEENGMEWNGMERNGMECSAMESTRVELRNQHEWNEMERNLTEWNGMEWNPIQCKGMEWNGIEWNGMEWNGMEWNGKNSSGMEWNAKVEWIGMEWNGMKGNGINPRGMEWNGMQWNGMECNGLEWNTPEWNGIEWNGMEWIQPQWNGIEWNGMEWNGMEWNGMECNGMEWNQTECNGMEWNGKEWNGMKSTRNEIEWIGINLSGMEWNGIEENGMECNGMEWNGMEWKGINQSGIDCNGPEWNGMEWNGMEWNGMGRNGIEWNGKEWIRVEWNGMEWNGMEWNGINASVIEWNGMEWNGAEWNGIDLNAMESPGIEWNGMESNRMERNGMEWTAVEWNGMESTCVECNAKEWNGTEWNGMEWNGMEWNQQKWNGTDGMEWHGIEENGMECNGMEWNGMEWNGKESTRVELTVMDRNGMEWNGMEWNGKEWNRMEWKGMDWSGMEWNGMEWNGMVSIQVNGMERNGMEWNGMEWNQQKWNGREWNRMEWNAMELKAKESTRMELNGIECNGMEWNAVEWNGMEWNGMEWNGMEWNGMEWNGMEWNGISQSGIELNGTELNGINPSGMEWNGKEWNQPEWNGIEWNGMEWNQPEWNGMEWKGMEWNGINPSEMEWKRTEWNLMEWNGMEST

SEQ ID NO: 925513 - protein, 184 aa, Homo sapiens
MACNGINRVQWNGMKWNAMQWNGTNKSGMDWNGMEWNEREWNQPEWNGMEWNAMEWNTPEWNGIEWNGMEWNQPQWNGMEWNGMEWNGMEWDGMGWNQTENGMKWNGMEWNGMEWNGIEWNGVDWNQSEWNGKEWKGMELKRIEWNGTEWNGMEWNGMQCNGINQSGIECNGSKWNGMEWNKPE

SEQ ID NO: 925514 - protein, 135 aa, Homo sapiens
MTGKHGHAKVHLVGTDIFTGKKYGDICLSTHNMDVPSIKRNDFQLIGIQDGHLSLLQDSMEVREDFRLHEGDLGKETEQKYSCGEEILIMVLSAMTEEAAAAIKAPRASGRALPPRALPFPAGSLPDTFVKIKPE

SEQ ID NO: 925515 - protein, 523 aa, Homo sapiens
MSIDIDMDMDIDMDMDIDMDIDMDIDMDRLEMDMDVDIDIDVDMDIDMDVDIDKDIDMDRLDMDIDVDMAIDVDTDIDMDRLNMDMDIDMDMDIDMDIDMDRLKMDMDVDMDIDVDMDIDMDVDIDKDIDMDIDIDMDIDMDRLDMDIDVNMDIDVDMDIDMDVDIDKDIDMDIDMDIDMDRLDMDIDVNMDIDVDMDVDMDVDIDKDIDMDIDMDRLDMDIDVDIDIDMDIDMDRLDMDIDVDMDIDMDRLNMDMDIDMDIDMDIDMDRLEMDMDVDMDIDMDVDIDKDIDMDIDMDRLDMDIDVDMAIDVDMDIDMDRLNMDMDIDMDMDIDMDIDMDRLEMDMDVDMDMDVDMDIDMDVDIDKDIDMDIDIDMDIDMDIDMDRLDMDIDVNMDIDVDMDIDMDVDIDKDMDMDIDIDMDIDMDRLDMDIDVDIDIDMDIDMDRLAMDIDVDIDIDMDIDVDIDIDMDIDMDMDVDIDMDMDVDIAMVVDIDINMYRLDMDMDVDMDMDMDINMDTDIDIS

SEQ ID NO: 925516 - protein, 153 aa, Homo sapiens
MSQYDCLLGSPRRVLLGTSCALTYGHWESQILWSHPSVTMGSTLVFNQRQTRTFEDKSSPIKPDIWKEAGYICVKEDREAGPRDLGHSCTKPCWALTEGCFGWGQVLLPWHFWSAALVARERGAGAGSGSSVSKPGNGMGCGQCPHLHLPLRP

SEQ ID NO: 925517 - protein, 125 aa, Homo sapiens
MLKVKGWKTAQVYFWLLIQCSLEDVASIAVFTFHRQGTPHGRHSLQGPRSTALHAQREPSATRSLQVASPGGETKSGLWLSLLAMVKDFTSAGKTVPLAQTPSRTKGQTVKHGLEPSSPNCHFYW

SEQ ID NO: 925518 - protein, 136 aa, Homo sapiens
MPSRCCDSHSVVECSQGAVERRHGAVTVTVLLNAVTVSLNAVTVLVVECSQGAVERRHGAVTVTVLLNAVTVSLNAAMDSQNPDVSSPTHFLAVALSPVAHLWSDPADHTHRLTSKTRGQFSICHMENNLADPLPM

SEQ ID NO: 925519 - protein, 148 aa, Homo sapiens
MERRVVACFPRWLIIDSFLGLSLATLLHNQADRSTKVTKLPSADFLKDFGFYECPGPGDGQYGHYAVPCSMILCHLGLKQSRLGRSLGKAEDEQLGTPQQRECSAFLTRRSNHGLEGQKDLSLNRSSETCCGATVTQVIRMCKQPPAI

SEQ ID NO: 925520 - protein, 153 aa, Homo sapiens
MESQADIQDFSQLASGSRCKGEVASGLPSTEGCSAACKPTDSQSPDSDANTSRSGANIRAGELSHHRTAVSGDRSTKLPSAQGTASLASDQQLGPHVPKAAAAMFDKLERSYVQIKSPQPASAILPLGTGVVGRYACKIPTAPRVPGNGAAGQ

SEQ ID NO: 925521 - protein, 122 aa, Homo sapiens
MVKTTALGWLCPHPNLILNYSCHNPYVSWRNQVEIIDSWGQFPSSCSHDSEFLQDVMVIYGVSPFTQPLFFFSSTMIPFPGAAKILWIREHCGCSFNIIETEGSLTVSFQDGVCGPSLSLEH

SEQ ID NO: 925522 - protein, 223 aa, Homo sapiens
MARLGALLLAAALGALLIFALLAAAVASDYWYILEVADAGNGSAWPGRAELLSSHSGLWRICEGQNGCIPLVDPFASESLDVSTSVQHLILLHRAVIVVLPLSLVLLVCGWICGLLSSLAQSVSLLLFTGCYFLLGSVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 925523 - protein, 241 aa, Homo sapiens
MSTLSHTGQKGRGPISIQISQLSSLVKSGAKFTVSVERTVAGQGDDVSPYFKTEPVRTQVHLEGNRLVLTCMAEGSWPLEFKWLHNNRELTKFSLEYRGQRCLDRMVCTTVHRSRGGVGHRDSLTAAVAVAVTVAPCSLSRTLPSPGDSCCGAWVQWRGGLCSNLGSVKEGTSSIYGKFRGDHKCTTEPKSELPEPWQFLEPQDLDQELDIARPSFLQVAQLCPPLVSFMAMVVVLLQRRT

SEQ ID NO: 925524 - protein, 296 aa, Homo sapiens
MRIFVKTLTGKIITLEVEPSATIENVKAKIQDKEGNPCDQQRLIFAGKQREDGRSLSDYNIQKESTLHLVLRRRGGMQIFVKTLTGKTITLEVEPSDTIENVKAKIQDKEGIPPDQQRLIFAGKQLEDGRSLSDYNIQKESTLHLVLRLRGGMQIFVKTLTGKTITLEVEPSDTIENVKAKIQDKEGIPPISRGSSLQASSWKMAKESTLHLVLRLRGGMKIFVKTLTGKTITLEVEPSDTIENVKAKIQDEEGIPPDQQRLIFAGKKLEDGRTLSDYSIQKESTLHLVLRLRGGC

SEQ ID NO: 925525 - protein, 1945 aa, Homo sapiens
MFLLHIAFPEHQCCEHSCCGMDVCVSHGIPEQSCCHLSVCPSNRIPEPCYDGLYYSPSHRIPEHGYEEQCYEGLNACPTRRIPEHPSCEESCCDLSVSPSNRIPEHCYEGLNYSPSHRIPEHSCYEHCYEHLIYCPSHRIPEHSCCGLNICPSHRIPEHCYEGLYVCPARIQKNPSCGLDDCPSHRIPEHCCWILSVSPSHRIPEHCCWILRVFPLHKIPENSYMGLYVYPSQRIPEHCYEGLNVCPSHRIPEHCYREHCCWDLSVCPSSMIPEPCYVGLNVCPSHRIPEHCYEGPNVCPAHRIPEHSCCVLIVFSSHRIPEQCYENPEPSCCCLNVCPSLRFPEYCCWVLSVCPSRTIPEHCYVGLNVCPSHRVPEHCYEGLNICPTLRFPEHPSYGLNDWPSHRILVHCFWVLRDSLSHRISGHCCWGLNVCPSHRIPENCYEVLNYSPSHRIPEHSSCGLNVCPLLRIPEQCCWVLSVCPSRTIPEHWIPEHCCWVLSVCPSHTIPEHWYVGLNVCPSHRIPEHYYECLNVCSSHRIPEHSCCGLNVCPSLRIPEHSCCGLNVCPSLRIPEHCCWVLSICPSRRDPEQCYMGLSVSPRYGIPEHCYESLNVCPSHRIPEHCYEGLNDCTSHRIPEHSCSRLNVCPSNRIPEHCCYFLSVYPSHRMPEHCCWGLRFCLSHNIPELCCWVLSVCPYHTIPEHCCEVLNVCPSHRIPGHYCCEHCYESLNVCPSRKIPEHCYEDLNVCLTRRIPEHPSCGLNDCPTQSILQQCHWVLSVVPQIEFRTLLRGTPEHCYEGLNVGPSHRIPEHCYKRLNYSPSHRIPELTCWSLNVCSSLTIPEHSCCGLNVCPSLRITEHCCWIQSACPSSTIAEHCYLGLSACPSHRTPEHCYEGLNVGPSHRIPEHCYKRLNYSPSHRIPEHTCWNLNVCSSLTIPEHSCCGLNVCPSLRITEHCCWIQSACPSSTIAEHCYLGLSACPSHRTPEHCYEGLNVGPSHRIPEHCYKRLNYSPSHRIPEHTCWNLNVCSSLTIPEHSCCGLNVCPSLRITEHCCWIQSACPSSTIAEHCYLGLSACPSHRIPEHCYKGLNVCPVHRTPEHTCCVLNVIPEPCCWVLMASPSHRIPENCCECLNDCKSQRIPIPEHCCWVLSVFPSYRIPEHSYEEQWYEVLNACSTRRIPEHPSFGLNDCPSHWIPEHCWVRSVCLSHRIREQCYEEQCCCGLNVCPSHRIPEHCYEDLNVCLSHRILEHCSRVLNICPSHRIPDHYCCGLNVCPLHRISQHCYEGLNVCPLNRIPENSCCAVNVYSSHRIPEHCCFGLKGCPSQRIPKLWIPKQSCCLLSVCPSNGVREHCYEGLNYSPSHRIPEHGYEGLNVCPSHMIPEYSCCEHCYECPNVCSSHRITEHCCWVLCISHSHRIPEHCYEGLNICSSHNIPEHCQESLNVYPSDKITEQCYEAQNVCSSHRIPEHYCSEQCYEGLNGCPTLRIPEHPSCGLNNCPSHRIPEHCCWVLSVCPSHRIPEHCYDGLNVCPSNRIPEHCYEGINYSPSHRIPEHSCCCLNICSPLSIQEHSCCSLSVCPSLRIPEHYCWVLSVCPSGTIPQHCHVGLYVCLLRRIPEQCYEGLNVFLAHRTPEHSCCVLNVFSYDRIPEECYECLNACRTCRIPENPSCGLNDCPSHRIPEHCCWVFRVCPYHSIPEHCDEGLNICHSHRIPEHCYWVLSVCPSQRIPEQCCCEQCYQGLNVFPTLRIPEHLSCVLNDCPSHRIPEHCCWVLSVSPSHTIPEHCYEEQCYEGLNVCPTNRIPEHTSCGLNDCPSHGIPEQCYWVLNVCPSCRIPEHYCWGLNICPSSRIPEDYCCGFQNTPALVWVFVPKIGFQNTAAAIPEHCCWFLSVSPSRRIPVHCYECLNDCTSQRIKEHSCSGLNVCPSDRIPEHCCKVLSVCPSHEIPEH

SEQ ID NO: 925526 - protein, 700 aa, Homo sapiens
MECNGMGWNQLERNEMEWNGMEWKQPEWNAIEWNGMEWNEINSSGMDWNGVEWNGTAWNAMESTTMEWNGMDWNGIERNQPEWNGMEWKEWNGMEWKLKEWNGKETTRVEWNAMECNGMEWNGMERKQSEWNGMQWNGMEWNGMEFLESNGMEWNKYEWNGMEWNGIEWNGINSSGKECNGKEWNGMEWNGMQWNARVWNGVNASGMEWNGIECHGMEWNIMEWIEWNGMEWNGMESTRVEWNGMEWNKHEWSGMEWNGMEWNGINSSGMKCNVMEWNGMEWKGMEWNGIEWNQFECNECNGMEWNQLERNGMEWNGMEWNGMEGIRINWNGRERNEMEWNGMEWNGIESTPVEWSGMEWIIMEWKGINPGGMEWNGMEWNGMEWNGMERNGMESPQWKGTEWNGKEWKGMERNGMQWNQPEWTGMEWNGMEWNGMESTQEWNGINMTGMEGNGKEWNGMEWNGIEWNGMESAQVEWNGMEWNGMEWNGTERKNGMEWNGMECNGMECNGMEWNQPEWNGMEWTWNGMEWKGMEWNQPEWNGLECNGMESTRVERNGMESNRMEWKGMECNGMQWYGMESTRVEWNGMESNAMEWNGMQWNGNGMEWNEINRIGMEWNATEWNGINWKGIKWNGMEWNGMEWNRMEWNQLEGKNGMEWNEINPIGMEWNAMEGNGINRKRMKWSGMEWNGMEWNGMELTE

SEQ ID NO: 925527 - protein, 154 aa, Homo sapiens
MAILKGKNSLHTCLRGGAYRGRQASWSCCGLHPVPAAWLLCLPKKAWAMAGPTPPASLPPCSLISECCPSNQQDSIGIRPSEPGAGHNLLVCRFPSLLEKYSIRVRVTLFSRCHLSPLSLTRKGNSLTPCASRGNASPCFGSHTVRCTHCFSLP

SEQ ID NO: 925528 - protein, 356 aa, Homo sapiens
MRPELPIPNWVLSDSCSHKVGHAQQHSIIKWKWCISDWAQAGPGGHNGQKLKIFVPCVSVDQQVTSAEEDFDNQVDKMTRSVDTTQPLSSDTPVIQGGLPLTKAELSVATAECPICQQQQQRLTVNPLYGIISWGDRPATRWIDRMVGRPFEVAITTSTRLQYFAGPGHHTPEGHVCSESAPNVWYCFSHSQDSQIQDSRGGCESGTTHYDALAKCLLSVPMTLGSALLVILAPEGRTLLPGDTITIPLNWKLRWPLGRFGVLLPLSQQAKNGVTVLAAVIDPDYQDEVSPLLHNGSEEEYAWNIGDPLGRLLVLSCTLIKVNGKLYPIQVGLQMVQILSGSRPAEVLAEGKGNTE

SEQ ID NO: 925529 - protein, 217 aa, Homo sapiens
MTSIGAGADSEENPDSGGRHFRACVVTEAFPGPKSAEVPGAQECLGRRPSLGSCSCAWGVPALATWKGLGSHLSPAATGSIECAALAVTPRCVFPAVVHGRGAGGMGALANAAQMNLMLLGPILQDPAASADGLPDVVGSEIEAAMEGLHLAVGPAQPLGGGGAVRCLGDTGNGVLPPPLLLLLLLLTTLPMRPKRYWHDGNCHSRWPAAPINSVHI

SEQ ID NO: 925530 - protein, 200 aa, Homo sapiens
MESKRIIEWTRMESSNEIEWNNPWTRMQSSSNGIDGIIIQWKLMESKSYGIEWKHHRIETNGIIMKLKWMDSSSNGFEWNHRMKLIEIIIKWNRMASLNGIEWNHHQMEMNGIITEWNRMDSLNGIRWDHRMDLNGIIEWTRKESLLNGIEWNHRMVSNGIIIKWNRMESPNRIEWNNHRMDSNGIILKWNRRELSNAIE

SEQ ID NO: 925531 - protein, 245 aa, Homo sapiens
MESKRIIEWTRMESSNEIEWNNPWTRMQSSSNGIEWNRRMDSNGINIERNRMESSSDGNEWNHYRMESNGIMKWNQMESSSNGIKYNYGMKSNMETNGIIIEWNRMESLNGIEWNHLQMEMNGIIKQWIRMDSLNGIRRNHRMDLNGIIEWTRMESLLNGIESNHRMVSNGIIINWNRMESPNRIEWNNHQMDSNGIILKWNQMELSNGPNGIIECNQIESSNGLEWNHRMEWNGIVNELEWNHH

SEQ ID NO: 925532 - protein, 1040 aa, Homo sapiens
MQWNGMESTGKESKGTEWNGMERNGMERKRMECNGMQWYGMESTRVEWNGMEWNEMECNGMKCNVMEWNGMEWNGMEWNGMECNGMEWNGINTSGMECNGMEGNGKKWNGMEWNGLEWRGMEWNGTEWIGIEWNGLEWNGMELNQPDWNGMECNGMEGNQQERNEMEWNGMEWNGMEWNGMESTRVECNGMEWNGMESTRVEWIGMEMEWNGIERNQPEWNGMEWNEWNGMERILMEWNGKETTRVEWNAMECNGEEWNGMEWNGMEWNGIQCNGNKPSGIGKEWNGKEWNGKERMECNRMQWYGMEATRVEWNDMEWNEMEWNGMEWNGMEWNGMESTQLEWNGMEWNRMEWNGMALERNGMERNGMERKEWNAIECNGMEWSQPEWNGMEWNGMKWNGMECNGMEWNGINSSGMEGNGREWNGQEWNGMKWNGMECNGIINKGMECNGREWNGINTSGMEWNGMEWNGMECNGMEWNGMEGNGMEWTGMEWNGMKSSRLEWNGINWKGMKWNGMECNGLEWNGINASGMQWNGMEWNGINPSGMDWNREWNGMQWNGMESTGKESKGTEWNGMEWNGMEWNGKEWNGMKWNGIDWNTINSIGKECNGKEWNGKERNGMQWYGMESTRVEWNAIMEWNEIEWNGIQWNGVEWNKHQWNGMQWNAVEWKEMEWNGIEWNGMELNQPDWNGMECNGMEWHQLQRNEMEWNGMNGMEWNGIHPSRMQWNGKEWNGINQGGMDWNGVEGNGTACNAMESSRMDWNGIERNQPEWNGMEWNEWNGMERILMEWNGKETTRVEWNAMECNGMEWNGMEWNGMEWNGIQCNGNKPRMEWNGMEWNQPEWSGMEWNGNEWNGMEWKRMEWNGMERNGMERTRVEWNGMEWNGMERNGIYPIGMEWNGMERNGMYPIGMEWNGMEWNGMACNKHDWNGMEWNGIEWNGMERNGIECNGINSSGKEWNGKEWNGTDRMECNRMEWYGMESTRVEWNGMEWNEMEWNGMQWKGVEWNKQQWNGMEWKGMEWKGMEWNGMEWNAMERSGME

SEQ ID NO: 925533 - protein, 793 aa, Homo sapiens
MESNRMEWNGMDWNGIERNQPEWNGMEWNGMEWNEWKGMEWKLMEWNGKETTRVERNGMEWKGNNPSGTEWNGMQWNGIEFNVVETNRVECNVMERTGMEWNGLESTRLQCNGMEWNGLEWNGMEWNGTDWNGMERNGMEWKGMEWNGKEWNELEWNGMQFNGMEWNGINPSGVEWNGMEMNGMEWKLMEWNANNPSGMECNGMEWNGMEWNGIQQNGNTPSEMSWNGKDLNVMEWIGVNPIRKQWNGMEWNGMEGNGMECNGMEWKGMEWNGRDWNGMEWIRMEWNGMKSTRLEWNGMQSEWNGNEWNGMEWNGMEWNGMEWNGMQCNGTERNEPEWNGMEWNRMEWKGTEQNGMEWNGMNTSGMERNGMDWNIMEWNQPEWNRMEWNGMEWNGMGRNGMEWHGIEWNGTERNGMEWNGMQWIGIKQMEWNGMEWNGMEWNRMESIRVQCNGIEWNGMEWNGINQSTMQWKEIEMNRMEWNGMEWNGMEWNGMEWNQPEWNGMEWNLTAWNGMEWTEINPSGMEWNGMDWNAMEWKGINPSRMKWNGMEWKGIQWNGIEWNGMERNGMERNGINMSGMEWNGLEWNKHEWNGMEWNGMEWNGIEWNGINSSGKERDGKQWNGKESNGMHWNEMSGVEKNEMEWNGMQWNGVEWNKHQWNGMEWNGMEWNGMEWNGMAWKGMEWTGLKWNGMERNAMEWNGINWKGMKWNGMEWNGMELNGMEWNQHEWNAMQWNGMECNKINPSGMHRNRVEWKGQAWNAMESTRMEWNGMERNGMEWNGMEWNGMEWSGMD

SEQ ID NO: 925534 - protein, 321 aa, Homo sapiens
MESSNGIFIEWTLMESSNGLKWNHRMDSNVIIIEWYRMESLNGLKWNNHQMESNGIIIRWKRMESSSNGIEWNYQMESDGIIIKWNKIESSNEIEWNHHQTDLSRIIIEWNKIESLNGLQWSHHRNHHRMETNRIIKGTRMELSGIIIKWNPMESSNGIEWNHHRLELNGTIEWTRVESLENGNHRMKSNGFIIEWNQMELSLNAIEWNHYRMESNGIINKWNPMDSSSNRKNGISKGLEWNHRMHSNGIITKWSQMESLKGIKWNHHRMKSNGIIEWTRMETSPDAIERNHGMHLKGIIKYTHMEPTLSGIERNLRMELN

SEQ ID NO: 925535 - protein, 146 aa, Homo sapiens
MEWIGMEWKAVETAGTEFNEMEWNGMERNKPEWNGTEWNAMEWNGMESTPVEWNGMEWNGMEWNGMEWNGMECNGINWNGMEWNGMEWNQREWNGMEWNGLEWNGRQWKQQERNLMKWNGMEWNGINLSGMEWNGMQWNGMEWNQP

SEQ ID NO: 925536 - protein, 174 aa, Homo sapiens
MDSSGIIIKWNPMESSNGIEWNHHRLELNGTIEWTRVESLENGNHRMKSNGFIIEWNQMELSLNAIEWNHYRMESNGIINKWNPMDSSSNRKMEYQKDSNGIIECTRMESSPNGESWNALESNHRIYSYGTNIEWNRKKSSNGIELNHRMDSNGIIIEWNRMESSSNGIEWNHQ

SEQ ID NO: 925537 - protein, 209 aa, Homo sapiens
MPEQASSQLISVPKPGKPWTSWEGLITLLRDEPIAEALTGLQADVEILEWICRQKTKPLYKYQPSWGTSGLAGRRHCPHIAPKTAESVRGSVGEVGEVCLRYIQERLADKVGGEPCRLGPGLGPAGEETCWQSLAEATVSEAVESQLQCQFRQASEGRHRTSSLPSLSPPLPGSLEPGGVSCQDTSRMLPVLSLTTARSAQALCNILNC

SEQ ID NO: 925538 - protein, 149 aa, Homo sapiens
MQGVGHCHSPTEGILCRPHHHSRSFFGRIGVLRNFGKQRCKPGQLGPPGGLEDKVLQWTLKNYPPTVKPKGFFCQECHSQVCSKSSPPFICACGRQRPDGRAEHLGSEDRPFMYQPHLGTSRQYCARPVGCEIVGGGVYLSSVQQWSGN

SEQ ID NO: 925539 - protein, 139 aa, Homo sapiens
MFLIAGLVPKSLIAFTLVQRFSIEWVETEMLLTFLPCTGQFPQQRMILPKLSIALLLRNRFQWKRQARRHMKENREGNYRAGGKAGVSLGYKEGKEPWMCTLRDQPLGLEPSASGPEMKARYYHYNHDHDNDYDDFKIH

SEQ ID NO: 925540 - protein, 137 aa, Homo sapiens
MVKGEANTSFFTWWQPEKCRVKDGGKPFIKPSDLTRTHLLSREQHGGVERNRGPCGVVQMAKPRKGDGEFPLVPSVSRDTIQKPGPRIGNFRNLPGALFYCSRTGTKATRQSPSHSYLLFIQTMRFLPMVTTAPSPM

SEQ ID NO: 925541 - protein, 153 aa, Homo sapiens
MNNQSLPLLTNGIVIGMGRRVLGLLHKGMGQCGYLLIRPAKDFHGSPNHLRLGGLKGKKWFPGPGPGPSCCVQPRDLVSYTLAAPAMAKRGQATDHAVASESVSHKAWWHTHGIEPMGAQKSRIKVRESLPRFLMCEKPGCSDRNLLQGWSLH

SEQ ID NO: 925542 - protein, 163 aa, Homo sapiens
MARGACFPFTFHHDCKFPKVSQSCFLLSCRTVSQLNLFSLHIIQSQLVLYSSGDTGFMELFRENSQGRSLVKLELQHLTLLGLFSRMPGGSSSHSLELVHEALPWFRGHLLRPGDQGLLVVQVEYQRKPHLLHPEVSQIVRKLHKHPRSIVNERTKISITAMD

SEQ ID NO: 925543 - protein, 155 aa, Homo sapiens
MGYLRCAASRCSQIGTLGKASRRDAQIRLAPIHGLDSSFLSRSDSLDRPNQPSGAGQTWEDLLSLAMLHCSHSYAKPTGLCTGCNSVPANSPSSSPSQFKCLHVLWDFLQIDFWRSVEPVLVVTAGVYCWHVIYMFKPQPPILQNVTIFGDLVIT

SEQ ID NO: 925544 - protein, 165 aa, Homo sapiens
MMIDAKHKILENVKPDNATEKKNSFSGEKFKPAAEIHILNKEPNVNHQDNGEMSPGHVKDLHSILSHHRPRRLGEKNSFLGNVQGPPAVAVQKENVGSEPPHRVPPGALPSGAVKRGPQSSRPQSSRSTDSLHSFQVEKPQTLKAIHESWAGAAQDHQGPPLASV

SEQ ID NO: 925545 - protein, 189 aa, Homo sapiens
MRIDYIYIHNQMDIEGYNSGKKLQNTSQSQTCTKKVMVILWWSAAGLIHYSSLNPGKTITSEKYAQQIHEMHQKLQCLQMALVYRNGPILLHNARLHVTQLTLQKLNELGDGVLPHLLCSPDLSPTNYHFFKHLDNVLQGKHFHDHQDVENAFQELLESQSTDFHTMEINKFITHWQKCVDFNCSYFDS

SEQ ID NO: 925546 - protein, 239 aa, Homo sapiens
MTLLNFLKHILVTWPPYELRCLCFRKSHTGIEFCQTTSRGYDESSCYLFWAAPQKQKEDSSASELLTLSSKLIPMGKIIQGQQKVPLRPLVTKETVKVEEGENKEFPETRECNLKELFHFLHQYHQLLKEPLLKRILKGHKNISVERILEVGKLKQAFYKEVVSPFSECFMGMDMMSGWGTLPRSSIVKLKPANKVLMEATVRVDGIQVSVQYEVYDGIEGHKEVWQFQKGWEFIACSS

SEQ ID NO: 925547 - protein, 162 aa, Homo sapiens
MADLSLEKLVITDLLKPTSVNSSNSLSSCQTGKFKSAEAVCCLLYRYALPPEVESREEIGLAELQWGPPNSSFPAALFTLESLIHSKTLTLFNSTKAERDEEAAKEKFEASRSCFLRFKETSYLHNIKVQGEAASTNIEVVGSYTEGLLRSSVGDEGGYTKQ

SEQ ID NO: 925548 - protein, 152 aa, Homo sapiens
MVQGPSASDLLEFAGVPLQILIAWLSPAEAAEQQILLPDPSSGSFAPEDEDSHMLPEWLLGAWIKNRSTGAIIAIVNHEGMTSPQTTYDLLLNLPYTEERGIPDLLSVVEYEVHADAITVTVRIPEYQTMRGLTMSPSPPSRRGTTQGLPCY

SEQ ID NO: 925549 - protein, 152 aa, Homo sapiens
MKLWTFVVNVTVLKGGSDPKSEQQQDLLGGAKEQSFLSVEGDPSGLPLLARWPAVIPLFVHAHILLIDPFYRALTGPFYRVLIGPFYRVLIGPFYKPLASHRALIAAFYNPSYRLLIGAFYNPLVRQKSSPSPHQPRSPSSGNLCNFELVWQ

SEQ ID NO: 925550 - protein, 143 aa, Homo sapiens
MQGWERCRFLSPGNCLGFEQEEAAAHPGTLTPTPSAVNKIKQFLKDKPELVDVKVGVRTRGCNGLSYTVEYTKTKGNSDEVIQDEARVFIEKKAQLTPLGTEMDYVEDKLSSELCSITQHELVAVETPLAIGSRKAGGNLGAH

SEQ ID NO: 925551 - protein, 137 aa, Homo sapiens
MLGVSFRPYSSYAFPCLEMSLKEQRLVPVPSSGTCDLKRRQTDARGTLATDCHSQLVGLWGTSLGTKLSRLPSSSRGKAQPLAIEMYAALQPPRELSVLGSWESQYWLLSLTQGAQTGLHSRKSQLWCWSPLSPGVQ

SEQ ID NO: 925552 - protein, 147 aa, Homo sapiens
MNFTELKEHVLTRRKEAKNLAHPIPGHNIDPDLEKECSGGLGLRSRLWLQFKSQIQFGSEATWVPRHEALCSDDSRPWNSRTWQSRLCETRCNSSKDPRMAEHSYCLGPGRQVAAQRQCTVSALTWGTDSSWQSRDHYSEMQDATST

SEQ ID NO: 925553 - protein, 149 aa, Homo sapiens
MGLLYRALAMMPNGKGEDQTIKAEDEDYIKKQQRRSKELTENEHSDVCASFSTWTSRKNITSWHKASAQKWAFAAEMCDILNSMMNDTYGTLGNLKSLRYVDLLQYFGDMSCKRHTNLNRLLTFSTADGFCGLIPKWSLQWSLIERTSI

SEQ ID NO: 925554 - protein, 151 aa, Homo sapiens
MLPKAVLPARRERASPFSRSHRSFAQTSGALLLLLLLLLLLEAGGGWEQGTKAVSSSDVNLQTLAGSRTWNLQLRKERDISDTQTQRKGPCAETAVMQPQAKECLGPTEAGRGKGGFCPGAFGGSVALLTLQLQTSGLQNCDRKVSVVFRH

SEQ ID NO: 925555 - protein, 167 aa, Homo sapiens
MSISWLPVKSDHNTMISVKVGVCVYVYACVCVCDCESVYVGKCVRVCEHVYECVYLCIHQLSDPPVTNPIVHSSIYSFLFIPTANSKAKHPSSFTQRSQQFLKKALDPNLSSLSFNPSTSSCWGFTPRTPLSSSIYQVPSDMQSISPTSSHSSNPSASSASLLQSLL

SEQ ID NO: 925556 - protein, 158 aa, Homo sapiens
MIVATAFQGAQMCPFCPANYISSPYPRVQGGLQAQLSCMPLRPCVFSYVLLSGDGSELSIPPTQWSAEDGVLVQTRLKTTFAKCENECVVLSDSFFYEKDLPSHTSAASHMAHASVPVVPSSVSIAPEDYPSKLSKSSKTKKVTLRSYHNQEEAKDLL

SEQ ID NO: 925557 - protein, 211 aa, Homo sapiens
MKVKNKKKKKKEKEEEEEKKKEKEEEKKKEEEEEEGKKKKKKKKKKKKKKEKEKEKEKEKEKEKEKKKKKKKKEKEKEKEKEKEKKKKKKKKKKKKKKKKKEEEEEEEEEEEEKEKKKKKKEKEEEEKKKKEEEEEGKKKKKKKKKKKKKEEEEEEEEKKQKQKQKKKKKKKKKKEEEEEGRKEGKGRRKEEGRRRRRRRRRTRRRRKRRK

SEQ ID NO: 925558 - protein, 186 aa, Homo sapiens
MRGVIHKERVRGEGTGEGILGREKSTFKGPEVEKTAYQVLKHQEPPEKDAAGLLIHIDDDDDNNEDEAADQCGEAGREECSPGLVLTLGVLVAFSDSIVQFIQSTKYIFHGAQLLGSTNWDRRSQPLVDQSISQFSFVLISLEEKVVAEAAPCVRKTTVPGLWLQPLFPLAFPYGSVVRSPIPNVK

SEQ ID NO: 925559 - protein, 199 aa, Homo sapiens [sequence omitted]

SEQ ID NO: 925560 - protein, 154 aa, Homo sapiens
MKAEINLGQPKHICFLSACLSHPKYTCLRWQHDKAPFLLSNGLQASGLLFLLPGLCTKLCQFMVGPVHHLPQCNNHLFECPSSSRPKGANVLLKVPDNGDRFNPKDIVQLLVLTEEKPSKMESHSVARLEYNGTNLAHCNLRLLGSRDSPASAS

SEQ ID NO: 925561 - protein, 170 aa, Homo sapiens
MHLCPSPYKINILGQLHIKILIPRWKIESKCLWRFQGPFLLYSEDSSYDTNSRISGWIREKMENGCCKGVNCLECCRQPGSEVAYVAENDGACSEENTKGVAKQPFDKDISMAVTHRSKQPLQPKPERDAIITAEKLQLELKRTEKVKQNKGRQLDFWDATGQVRRAIWL

SEQ ID NO: 925562 - protein, 175 aa, Homo sapiens
MGGQLKINGKCGGILVEVHLQKCSNRKVGAVSEGAMVVATGKHFSRAAEAVLQICVARQGPWERPAEEVVQIRLAPSHGNRGIIPSGIMSFSPLAPKELTQWADVRTPLAMSQTQTIEHWPTPTKEKQSEMQRVPYGFQLQGIRQGERTTAVEVLDDIIFQHKAVSSTFNICCLV

SEQ ID NO: 925563 - protein, 151 aa, Homo sapiens
MLPCVSELIIFKCSRERHKQSREIFKQEAIGLALSLGNSFWSRSRELSEVEDAVEMSNRMQTEDSPLDLAINWIMEVGSEEEKWEKLDAEFDHFVVDMKPFVLKLPHRTVTIFAIDIGLFTLSCSRVDRHSVIMSCQTVERSYCDASSHMS

SEQ ID NO: 925564 - protein, 149 aa, Homo sapiens
MQLPQIIHESDSHKERNAADIHTSREVNPSLVEPLDENPGPSAAGLLEFSGGPLQTLFAWVSPVEAAEQQRLLSVPSSGSFVPEGHPPDASRSSPISYFLLSPTGNILKFQIPTNDLFKSTLSLAHYTQRCFHILRLYFTFRYQNLYYL

SEQ ID NO: 925565 - protein, 317 aa, Homo sapiens
MEWNGVESTRSEWNGMELNGIQWKGRECNGINCNGMVMNGMERNGIESNGMEWSGMEWNGMEWNQRELNAITMEWNGMQRNGMEWNGMQRNVMEWIGMEWNGTEWIPDKWNGMEWNGKDLNGMEWNGMEWNGMESSVTELNGRQWNRINPKGMDYNLLEWKGTEWNCMEWNGINTSGMECNVMEWNGMEWNGMEWNSMELSRVELKGMEWNGMVSTGMELIGMQLNGINPKGMDGMEWNGMGRNGMEWNQPERNAVEWNGMEWNGMDWNGMEWNQHDWNGMEWIQPECIRMDWNGMEWNGINKSGMEWNGMEWNAME

SEQ ID NO: 925566 - protein, 3004 aa, Homo sapiens
MECTAMECNGTEWNAMQWKGMEWNGMEWNGMEWNKQEWNAMEWYGMKRNGMEWNKSEWNGKEWNGMEWNGMEWNGLEWNGMEWNGNNWNGMEWNGMESTRIEWNEMNGIEWNGLEWNGMEWNGMEWNGINPKWHGMEWKGMEWNRMEWNGMEWNGIVWNQTDWNGMEWNGMEWNGMEWNGMESSRVKRNGMEWNGINPSGMEWNEIEWNGMVWNGMEWNGMEWNKSYSNGMEWNGINASGMEWNGMEWNGMEWNGINEKGIEWHGMEWNLSEWNGMEWNGMERNNRMEWNGMEWNGMEWNGMEWNRMEWNGINPPGNEWNKMERNGMECNQTEWNGMEWNGMEWNGINPTGTEWNKTERNGMEWNQPNGIESTRVECCIMEWNGMEWNAMEWNQPEWNGMQWNIMGCKGMEWKQPDWNGFEFNGINPSGMEWNGREWNGMESNGVECNGMEWNRMEWKRIEWNGMEWNGMDLNGMEWNGIKRVEWNGMEWNGIECNGMEFNRINSSAMEWNGMEWNGMESNRVEWNGMEWFAIEWNGIESNRVEWSGMEWNGMEFNAVNPSGMWIGMERNGMQRNQPEWNGMDWNGMEWHGMESNPVEWNILELNGIESTQVEWNGMEWIEMDRNGMEQNVVNQRGMECNGLEWNAMESTRVEWSEWCGMEGNGMQRNGNNMSAMELKGMAWNGMEWNGMEWNGVESTRMEWNGRNGMEWNEMEWNGMECKGINTSGMEWNGMECNGLESSRVQWNGMEWNGMEWNGMEWNGMEWSGINPSGMEWNGMEWNGREGKGRECNGINCNGMVWNRMERKGMEWNEMESTRVECNGMERNGMEWNGMEWNGVEWNGINWNGMEWNGMEWKGMEWNGLELTRVEWNGMEWKGITWNAMVFNGMEWNWTEWNGVESTPVEWNGPEWKGMERKEWNGMECNGMEGNGRKLSGMEWNGMEWNGIKRKGIECKAMESNQPERNGLQFNGVEWNGMEWYGMGWNQHKWNGMEWNGNGMEWNGINPSGMEWNGMEWNGINPSGTEWNGMEWNGMEWNGMAWNGMEWNGVESTRVEWNARNGMEWNGIEWNGMEWNGINMSGKEWNGIEWIGINPSGMERNGMEWNGLEGNKPVSIGMEWNRMEWNGMESTRVEWKGMEWNGMEWNAMEWKQHECNGIEWNGMEWNGIEWNGVESTPVEWNARNGIEWNEMEWNGMEWNGMEWNGINTSGMEWNGMQWIGIMSSTMEWNGMERNEMEWNQPERNGMEWNGMEWNGMEWNGIECNGIKCNGMVWNGMERNGMEWNGMEWDQLECNGMERNGMEWNGMERNGMEWNGMEWNGMERNPLDFNGVEWNGMEWKAMELNGLESTRVEWNGMEWNGMEWNGITWKAMWNGMEWNGMERNGMEWNHPEWKVMYWNGMKWNGMESIRVERCGMEWNGMEWNGMEWNGMEWKGINPCGLQTNRMEWIGMKWHGINTSGMEWKSGMEWNGVEWNGMEWNGMEWNLMQSTRVEWWGMEWNGMEWKGMEWNGMECKGINWNAMESTRVEWNGMEWNEIEWNQSQWSAMEWNGIERNGRESNRVKWEGMEWNGMEWNGMEWNGINPMDRNGKEWNGIESTGVEWNGLEWNGMESNQVEWNILELNGIESTQVEWNGMEWNGMDRNGMEQNVVNPSGMECNGLEWNVMESTRVEWNGMERNQPEWNWNQPEWNGMERMEWNGKKWNGMKWNGINTSGMEWNGMECNALESSQVQWNGMEWNGMEWNGMDWNQPEWNGMESNGMEGKGREENAMESTWNGMECNGKEWNGMDWNQPEWNGMEWNGTESPGMQWCLMEWNGIEWNGIEWSGINPSGMEWTGMERNGMESTGMTWYLMAWKGMEWNGNNQSGNQWNGTEWNVRNGMELNGVNAIGMKWNGTEWNGMEWSGKESTQVEWNGLEWNAMELNGEESNRVEWNGMEWKWNETEWNGMKLEWNGMEREGMEWNGMEWNGMEWNQPEWNAVEWNGMEWNGMEWNGMECNGMEYNGMESTRLEWNGMEWNQPECIRMDWNGMEWNGNNPSGMEWNGMECNGMEWNGINPMEWNARNGMEWNGMETTLVEWSGMECNGLESSRVKWNGMEWSGINPSGMEWKGMEWNGMEWNGMEWKGMEWNGMERNGMEWNGMEWNGKEWNGMEWNGMEWKGARKGMEWNGNNHSGIQWNGTEWNGRNGMEVKGVNAIGMKWNGTEWNRMEWNQPNWNGMEWNGMEWNGMEWKEINPLAWNGIEWNGMQWNGMEWNRREWNGIKRSGKQWNGMETNVTEWNGINTNEKESKGMEWNCMEWNGIEPKRVEWNGIERNGMEYNQKTRWNEMEWNGMEWNGMEWNGMEWNGMEWNSTRGMELNGMEWNGMGWNGIEWTEAQWKRMEWNEMECNAMEWKGINRIGMEWNGTEWNGMEWNGINPKWIGMKWNEPEWNATEWKGMEWNGMEWNEMEWNPLDCNEVEWNGMEWNGSESTRMEWNGMEWNGMEWNGMESPGMQWCLMEWNGIEWNGMQWNQPQWNGMEWNGKEWNGVNWNDMVFNGMERNGMECKQPKRNSLEWNGMEWKEWNGIEWMEWNAMDWIRMEWNLPEWNGMKSNGMEWNGMEWNGMEWNGMEWNGMESTRVECNVLEWNEMEWNGINPSGIWNGVECNGMEWNGMEWNGMEWNGLNHCGKEWNGMIWNAMEWKGINCIGMEWNGAEWNGMEWNGLKPSGKEWNGMIWNAMEWKGINCIGMEWNGVEWNGMEWNGMESTRVGMERNGKNGMEWNGMEWNGMEWNGMESIQEERNGMEWDRMEWNHPSGMEWNGVEWNQPEWNGTNWNGMEWNGIKPSSTECNGMEGNGMEWKGMEWNLIKWNGMQWNGMEWNLIKWNGMQWNGMEWKQVEWNGMEWNGMEWNGMEWNGIQWNQATMEWNRMEWNGIEWNGMEWNPHKWNGMEWNGKEWNGMEWNGMEWNQPEWNAVQWNRMERKGMERNAMEWNGINTIGMEWNGMEWNGKEWNGINTSVLEWIGMEWSGME

SEQ ID NO: 925567 - protein, 137 aa, Homo sapiens
MTWSPPQGPSSLYLHLGSGFSRGIWRGAHKHSVHCCGLISSFASSGPLKVRDEGTQPSKGRADGAAVENAGRRGIRDAPQCLLLLTWRRLGSRVRRKVAFNIQVEKVSKVNLLPTRIHSSTLNNSRKVEATQASIYR

SEQ ID NO: 925568 - protein, 146 aa, Homo sapiens
MWHQISLGLTLRLWDMYLLEGQVLMPIRSIAFKVQKKRLMKTSRSGLLACFRNQFFHTWATDDDTVLKHLRASTKKLTRKQGDLPPPSGLQCHVPSHVTLWGSQYVPLADAADEVSHRATEKAKPASKVKGGGLELMAISSTVQEK

SEQ ID NO: 925569 - protein, 389 aa, Homo sapiens
MLYNKDSEQLRIKEEECGKVVETKQQLKWNLRRLVKELRTVRNNLDLISHRHQKEKDLFHENCMLQEEIALLRLEIDTIKNQNKQKEKKYFEDIEVVKEKNDNLQKIIKRNEETLTETILQYSGQLNNLTAENKMLNSELENGKENQERLEIEMESYRCRLAAAVHDCDQSQTARDLKLDFQRTRQEWVRLHDKMKVDMSGLQAKNEILSEKLSNAESKINSLQIQLHNTRDALGRESLILERVQRDLSQTQCQKKETEQMYQSKLKKYIAKQESVEERLSQLQSENMLLRQQLDDVHKKANSQEKTISTIQDQFHSAAKNLQAESEKQILSLQEKNKELMDEYNHLKERMDQCEKEKAGRKPLIPTVLLSTSVNVFLNFSSHMSENIQ

SEQ ID NO: 925570 - protein, 161 aa, Homo sapiens
MQSSSSGENRLLESGVREEENHPLLGSYEKKEATAVTATATSSARQCRWQCSPHGTPNLPPATSISDVTTNHSEASHGGTGSSLQHVAVPLPSSPPAWQEKLLLLTALLLLYRHYQPQRGSDPGSRLHPSSTLQQVEGCGFFQFSKLDTELLLRWTQKSLK

SEQ ID NO: 925571 - protein, 382 aa, Homo sapiens
MSWGPGEEAPDITPEEALPELPPGEPEFRCPERVMDLGLSEDHFSRPVLRQVIEECKQVILELPEQSEKQKDAVEKSKSVKQTCDKCNTIIWGLIQTWYTCTGCYYCCHSKCLNLISKPCVSSKVSHQAEYELNICPETGLDSQDYRCAECQAPISLQGVPSEARQCDYTGQYYCSHCHWNDLAVIPACIVRNWDFAPRKVSRCSMCYLALMVSRPVLRLREINLLLFNYVEELVEICKLRQDILLMKRYFITCREAMEARLLLQLQDQQHFVENDEMYSVQDLLDVHAGHLGCSLTETHTLFTKHIKLERERCQAKGFVCELCREGDVLFPFDSHTSVCTDCSTVFHRDCYYDNSTTCPKCAQLSLRKQSLFQEPGPDVEA

SEQ ID NO: 925572 - protein, 167 aa, Homo sapiens
MPPVIILRLLLDTGATWESDCSQQQERGTEAGQSLLPHLHGAPVSNCIQSSLAFCHFEANVMLGLLVAIYLGHHVLRPHLAPGEPSCWLLGSLPGPGCRASSDLLVPLLGQGGQAASAPSLRGVACTLHVHARVLSSFVPTSCWVQRHPSVQIGGINFIHEGRALMT

SEQ ID NO: 925573 - protein, 152 aa, Homo sapiens
MEKRRNGTRLHCWWECKLVEPQWKTVWKFLKELKVELLLDPAIPLLGIHREEKKSKKMLYTHVYSSTIHNCKIMEPTQMPINQLVDKATVVYLYVMEYYSSIKRNELIAFAVTWMRLETIILSEVTQEWKNRMSCVLTNMWELSYEDTKAKE

SEQ ID NO: 925574 - protein, 172 aa, Homo sapiens
MLNPEKRGLRFEIATTFAKQKTHGDCKLYSTLKRWCQLGCRAKHSVVGKLSALSRHGAGEDEMGQIEAPAVCKGNEREQARGLSWRRGFPTETTVNVKGPGGSVTSLLKETKETGSLQIFALLETPSTCLCLALCPKKLAYEEIFGVLLCPMASRGKHCPALVAAEILQEEE

SEQ ID NO: 925575 - protein, 204 aa, Homo sapiens
MEATHTTLPSSQRPIPSFAILTKPLYKLTKGNLADPIDPKSFPHSSFHSLKTALETAPTLVLPDSSQPFSLHTAEVPGCAVRILTQGPGLCPVAFLSKQLDLTVLGWPSCLRAAAAAALILLEALKITSYAQLTLYSSHNFQNLFSSSHLTHILSAPRLLQLYSLFVESLTITIVPGPDFNPASHIIPDTTPDPHDCISLIHLT

SEQ ID NO: 925576 - protein, 157 aa, Homo sapiens
MYLQERVDYAVFPKFDGGNALTSPVGMLSPRQWECSPLPSGNALTSPVGMFTSLVGMLPPQWECSHLSSGNALTSPVGMLSPPQWECSPPQWECSHLPSGNVPLPSGNALTSPVGMFSPPQWECSHLPSGNVHLPSGNVLTSPVGMFSPPQWECSPP

SEQ ID NO: 925577 - protein, 133 aa, Homo sapiens
MGNPVGDEEPVGGGEPVGDEKLEGDGEPMGDGEPVGDEKLEGDEEPMGDGEPIGDGEPVGDEKLEGDGEPVGDGKPMGDGEPVGDEEPVGDGEPTGANHTRLANNNTPQADNNTPQADNNTPQADNTPRADNT

SEQ ID NO: 925578 - protein, 128 aa, Homo sapiens
MLSCESSTWGSITPTDSGTSAGTGWQAGSQAQPSQSTRTPEPELRLEGPPAFPHSSMSRMRSLGPAPPPPSQLPLLLCVLQTFPLGNPQFPVAGPQAAARAKGTPIQLLRPPGGLPEEFKPSCVALGK

SEQ ID NO: 925579 - protein, 133 aa, Homo sapiens
MCPTIGSNVEEIILPKTHFFMWDIVRPEALSFIWNTYYSNTEFIILVIDSTDRDRLLTTREELYKMLAHEALQDASVLIFANKQDVKDSMRMVEISHFLTLSTIKDHSWHIQGCCALTREGLVAALPGSLGPG

SEQ ID NO: 925580 - protein, 159 aa, Homo sapiens
MLAAAGHTAGWAVAGLAAAGSTALVEATRQADSRGVVAGSSAVHRCTGAALATAGPTAGLATAAGPTADGLVAGCAAAGRLAAAGHTGGLAAGGPAAGVLTASWVAVRLAAAGHTAGGLAAGCAAAGGHNGGLPAGSPAASGPAADTSHIESEAQFIPI

SEQ ID NO: 925581 - protein, 399 aa, Homo sapiens
MRSQDKPGGKAEGPRNKVSTSTMADGCCPGNTTAIPAVPTITTYPVKGGFRHALCLPSSCHSRMWQLVTCQESCQPSIGAPSGCDPASCQPTRLPATSCVGFVCQPMCSHAACYQSGTGQSPCLVSSCQPSCSESTCCQEKCCDASPCQQSSCQESVCMSGSCQAACGQSVCCDAGSCQPSCSEVTSCPETSCLPTICTASPCQPTWCQGSSCQPVSGEGQPCKSTYYQPICYIFKPCQSALYMPVPCQPSTCVFSSCNTTCCVPSHCQPPHCQLVPSTCFIYQPVANCQAPCSTKNCCKPASCDTVISGQPTCDGPPSYNQSGCKSACCVTGLGTSPSSGSNCLPTSCQPSCEACNGGVARFFRAPLLTLLGEACRWAGFGALTPRQRLGRVYTIYPI

SEQ ID NO: 925582 - protein, 139 aa, Homo sapiens
MLGTRLAPGSIEVGLDFWFAEAGPLAPGAMGINLKPLAGLVLRQCGVGLKSGAMEASLVLGTIWSLGFCLAVCQALRPSLPGMCEAQGCGIWPGTRIDRAACGDSLYKLLLQELLQKHFRKAKRIHRPFKGSSWLLQAP

SEQ ID NO: 925583 - protein, 140 aa, Homo sapiens
MSEHQKEQTLDTPSLRTVTLTARVHGFILEVRETKNPPILDTILHLLTKDPLGPEYPGSTPGALGYETCWLQGKPSTFSVVLAMVKASCLRKAEGKVKGTLPCTLAFLDFLWARGKPTSLKDESQAWHHLPYADGRDLGL

SEQ ID NO: 925584 - protein, 176 aa, Homo sapiens
MYALNQCPIYETVSFTARIHRSRNQGVKVEVAPLTIFPSDPLAKFLLPFTVTFCSAGLEVLVPERGMLPPGDTTKIPLNWKFRVPLGHFGLLLPLNQQAKKGVTVFAGVINPDYQDEISVLLHNGGRNTNDPDPSGIKVSVSPPGKKEKKKEKKPAEVLAEGKENTEWVVEEDTKA

SEQ ID NO: 925585 - protein, 221 aa, Homo sapiens
MSPLSSQCGIGLSRIEPSQQQGTTQGVGCTFISSGAKGLLEFFGGPCETCLPGYHQWNLQISKHCCLFLPLEALSQRGTRQMPSGALLYEVSVDTCWQVTPSQEAWGACRQERLSLLKLRPQPPLPPGALSQGDGSFIYKPLNGAAFFLLEKLCPERRNLERQSSYSGYAESCGSISLPSPPEQVFYNTVLYGKMGLHSSPADLSRDKEHYALEVAESRDF

SEQ ID NO: 925586 - protein, 172 aa, Homo sapiens
MPQSRQGLRGDENLDQSFKLRDDPTMAAEEAALPQDCCFQLFFAQMPPSAHCVPEANKTARFPALPESKEVSAPILHPAPHPHPIPGINRKVGHNPYSDFRQGALEPRHSAGVGGHLDAVLSCAEITEMLARLTPGVQELAAPPILGQQGDMLQSAKPASHKRSPLSYFNVR

SEQ ID NO: 925587 - protein, 144 aa, Homo sapiens
MKRPRIGTCSSKEVPREGRVSQSPGSPPWSQPMLSASCLFFKRDSRHVQIHLSIRRRALEEHHEAQQKNGLLFLVPEFNSCSQDTAASSVWETQWKLHITDIAKVPSNGHPWFYTLSPRGNHYYEFEDVKNPSCYYESSNNHVT

SEQ ID NO: 925588 - protein, 131 aa, Homo sapiens
MTSCQKSKLHSARVISRIIHADVPWSIPLSVSKGTVSHPNPRASRLHQNENWDHGAHPDGHWALTLFLGTLSYDGAQAASSGAGWDEMKGEGQRGTASPRQFIASSPLSGMEQRESILSEEEQGCFQCHIN

SEQ ID NO: 925589 - protein, 176 aa, Homo sapiens
MSSRCSGLSGERASPCLPPFILLSTSPAPHCPLAVPCVHQKRLASPTVRVHQSPDIPSLFLAHDEVSFAACPFSPVSDPWDPDLGSNLDAYLLLEVGRRDVPPARTSQKRPGSQVPAGAGENLAWFGQWFLGRGVASALGVQGSHGVVGRVMGTVAEDARWEAEEPCLGAGDEGCW

SEQ ID NO: 925590 - protein, 131 aa, Homo sapiens
MLGRPRAPGASDSDAPEVKDGDLHLGAGKKGSTWSPTPDLQNWNGHLNKIPPPEFRCTWKFEKHRSTGVNKPFASLWEEDIIPVWNKNAVERKVTQRSINWHRTSFLFCKNASILVTADIKAAKDISVFNK

SEQ ID NO: 925591 - protein, 360 aa, Homo sapiens
MNGIVMKSESLVHPSPSLTALPPLKSYILPGRSKTLHKNGESRGIRIQLDFHRNASGVSNTLPMLSQKKSTGGRKEGRFQEGWRAQDDFAPRWTWRAGRVILSPETGEPYEGVPEKTHGSRIPPRPAATGWRAQPAEPQGDIQLRAAKGIGAWTSPGFSFAGSAGVPPFPSPHWLSLRACDFAQPLRGVESGVQQAVRSGFARNSHWSVKQESHPPGLPIGCCPTAALSFPAAGDLGFLGVEGCSTLLEARFSFHRCVPRARGQRGWTRFRTLQSGSCPRGGLWDSTALRGKWREAGGGVFFALKTWIPCCGLNGRLGWSPGSGYGRGGDHAGRVGGSPSQGLEDQVPDLQGPSCTRIPQ

SEQ ID NO: 925592 - protein, 321 aa, Homo sapiens; identical to SEQ ID NO: 747421

SEQ ID NO: 925593 - protein, 313 aa, Homo sapiens; identical to SEQ ID NO: 747121

SEQ ID NO: 925594 - protein, 315 aa, Homo sapiens
MEPEAGTNRTAVAEFILLGLVQTEEMQPVVFVLLLFAYLVTTGGNLSILAAVLVEPKLHAPMYFFLGNLSVLDVGCITVTVPAMLGRLLSHKSTISYDACLSQLFFFHLLAGMDCFLLTAMAYDRLLAICQPLTYSTRMSQTVQRMLVAASWACAFTNALTHTVAMSTLNFCGPNEVNHFYCDLPQLFQLSCSSTQLNELLLFVAAAFMAVAPLVFISVSYAHVVAAVLQIRSAEGRKKAFSTCGSHLTVVGIFYGTGVFSYMRLGSVESSDKDKGVGVFMTVINPMLNPLIYSLRNTDVQGALCQLLVGKRSLT

SEQ ID NO: 925595 - protein, 322 aa, Homo sapiens; identical to SEQ ID NO: 746095

SEQ ID NO: 925596 - protein, 176 aa, Homo sapiens
MAREKEAAGLSSLASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTADPGSNRVL

SEQ ID NO: 925597 - protein, 171 aa, Homo sapiens [sequence omitted]

SEQ ID NO: 925598 - protein, 172 aa, Homo sapiens
MLQRVGEMDGGNQSEGSEFLLLGISESPEQQQMLFWMFLVRYLVTVLGNVLIILAISSDSRLHTPMYFFLANLSFTDLFFVTNTIPKMLVNLQSQNKAISYTGCLTQLYFLVSLVALDNLNLAVMAYDRYVAICRPLHYVTAMIPGLCILLLSLCWVFSALYGLIHILLMTR

SEQ ID NO: 925599 - protein, 160 aa, Homo sapiens
MSEHNITKECQQENQSIEQWGTITHNDSKKVSWLHEVIKTYLKAKNIKLDLMKKLKELSSQPSRKPKPFIPSQEGIGDSDVICDMKKFQGRTNHSPHLSYCYPDASELPFLLTTGIALIVLWCPPASSTFSNRCSSDPLTCIRAPMNGHHLLRPGRLERP

SEQ ID NO: 925600 - protein, 147 aa, Homo sapiens
MLCSGNGHLTLKHSVLYSGNGHCLLKHGVLCSGNGHLLLKHSFHHKRVYGSECGGTLLSFRCRRPLTRTGFKPVNYWIKSDPGPGLFSAITSKTSSQSWLDSSLEQKFAQRNSELKTQIHGALKSERKFTMIPSCCKRSKDTSVRES

SEQ ID NO: 925601 - protein, 704 aa, Homo sapiens
MVQTDMLLPEPAPQTVPPCELPCKEYDLVVWFQNCYARYHQAFADCNQSERELQGHKSQQLAAEIQALAQPTQQDSKCRVGERLQDMHSWNSELQGEVEALAAETDLLLAQKQRLEHALDAMEVPFSIATDNMQCNQRHQHANLVRDHVETELLKVPAALGGQDFPGTVILTLCSPETFPGWDSCSRGGNPGLGQHCGCGQAYPPAPSQCLKNCCSSRKPSASNKGVCEVMETLTVQEEANPGTEGCRTRALAHKEEAELIRNIQELLKRVIVQAVSQIRLQHGGSPAGPSLATHQDPAPPRPRLNREHMEICEMDWSDKVEAYNLDETCGRHRSQSTEVQAHPALHHLPREGGPSSAPVLALAVVLPPSAWGPQRRCFPQPGPEALAPEDTWATVCPWHEKACKTSSSAQRPRSASTPETRTKFTQDNLCRAQRERLDSANLWVLVDCILRDTSEDLGLQCDAVNLAFGRRCEELEDARHKLQHHLQKGHWSGPPSGHSPRTWVGPDWSLHSICPGMGAQAQGALSCRQMLREITDQEHNMVALKEAIKDKEAPLHIAQTRLYLLSHRPNMELCRDAAQFRYRHDTGQVMGRGPPSARDLCPRGLTPPSATSSSQEEAPSDKPQLTPPNTPKLVSELEELYKSITALWEKLLQAEQSLHNLEDIHMSLEKDVTAMTNSLFLDRQNCMAHHTCYPTILQLAGYQ

SEQ ID NO: 925602 - protein, 144 aa, Homo sapiens
MRCGGEDDVIPHIAGGVQPPRILFIISTWGGDDVTTHIARVNNITEGVYTPCDIDSNIFSPPPDIRSNITEALYTPCDIDSNILSPPDIRNNITEEEQYHGGVYTPCDIDSNIILSPPDISNNITEGVIVDEMVKRKGKNGISC

SEQ ID NO: 925603 - protein, 199 aa, Homo sapiens
MAEEETGGGRVWQALSPGVPAIQRPPRVCSTNWVPSYRRRATLKLAGGPSLAEPGLDVAVAATKPGGLPGGGCTGAGTDPQPHPRWLQTAPGVAPISLRRRRGAGVTARRALRQEGMRACDSGTSRASPGEPASQRRLFLWIMAQVAVSTLPMEDEESMEDEESIEDEESVEDDSVESRMVVTLLISAIESTDTILTLN

SEQ ID NO: 925604 - protein, 148 aa, Homo sapiens
MRAPLPQPHCHLAVRSQTAVLAMKVVSGQSMKSSAGHGGSRQLTKSSAIACAKLCKASTYINWEDNAVIFLLVQSMVVDLKIFLVQNSHSTFHYVLVNSLHQIITNALLVLRQLDSIDLWNPDAPGETFWEIRFQCGYYCDFNRFSQF

SEQ ID NO: 925605 - protein, 152 aa, Homo sapiens
MELRCVTSLMQNRFYLMHCSWTHGYWAELCGGCSAMESLRSSVDLGPGLTLQKLGKVVVELLPHDLSPQLTVHKLQVETLVCLPLIGLLVGLMVLLRLVQSVRGQLCEKHQILLLSSQEWTWVLNPCCSLPSPWASWAARLRIPTLTPSEGH

SEQ ID NO: 925606 - protein, 138 aa, Homo sapiens
MKMESSSYPLRLYDQLICDHRRDRSVCPGNSLNNYPHYTTQKQEGATGRTTDRKEQVSYFSSILMVFLYIPFGSGVNVQGFYIGQLHVTGVGVQIISPFRKKTKMPLIELLKAKISRVPEKGKYMKGAAKYLLPQRTH

SEQ ID NO: 925607 - protein, 134 aa, Homo sapiens
MGGRSEALVDKIHARRRRNLNKFTRKKTNNPIKKWMKDMNGHFSKENIYAANKDTKKSSSSLVITEMQIKTTVRYHLTPVRMAIIKKSGNNRCWRGCGEIEKLLHCWSEHKLVQSTIVEDNVVIPQGSRTRNTI

SEQ ID NO: 925608 - protein, 143 aa, Homo sapiens
MIFPPIQIIKINWEEGRNPSNKELKCLLRFFANSNKVRGCMMTHRLGKRLRPIQAAACGCWVFQGHCGEGSCPASAQQLREGPPRRWLLEGFCCMTPSENLGFARKNGEGPHCSPAAVHAAWGHICLWREQFFHSHQNSRPIE

SEQ ID NO: 925609 - protein, 188 aa, Homo sapiens
MLSEGSHWKSACCYPGLTYLSLYSLDTAICGPNTVQNELPKALDGDPVIDGAKPVTPEQGPEAKATRCTHGGPGMPGALKGALVLSVTGAASAQPGLDQGPAAPGQGTFWQQLSLLQAGCRKLYKLPLRHFVVYVLNTKIRKLAKQQETHFFNLLHLINRVNTIPVKSPESYFEDVNKLIPEFLWKSR

SEQ ID NO: 925610 - protein, 148 aa, Homo sapiens
MKLKPEFASASGISAPSPLHFQSHMQPSQGANHPLELRAKTSYPGRYKEEGVKFANLSGHCPAAQETRHLHLKQTFPKSRECRLPHASQEQNTLWCCDGTDRSRGLIWSQRPSKHLILFGLKQIYDLDRGKIRKVQRESSTKKCDRQK

SEQ ID NO: 925611 - protein, 499 aa, Homo sapiens
MPFTIWSSRGFVGWGQCGEMKLGCGGSENPASYLNLASYLNDASYLNNASYLNLASYLNLASYLNLASYQNLAFYLNLAFCLNDASCLNLASYLNLASYLNHASYLNLAFYLNHASYLNLASYLNQASYLNHASYQNLASYLNLASYLNLASYLNLASYQNLAFYLNLAFCLNDASCLNLASYLNLASYLNLASYLNHASYQNLASYLNLAFCLNDASCLNLASYLNHASYLNLASYLNLASYLNLASYLNHASYLNLASYLNNASYLNLASYLNLASYLNLASYLNHASYLNNASYLNLPSCLNLASYLNLASYLNLAFYLNLAFCLNDASCLNLASYLNLAFYLNHASYLNHASYQNLASYLNLAFYLNHASYLNLASYLNLASYLNLAFCLNDASCLNLASYLNHASYLNHASYLNHASYQNLASYLNLASYLNHASYLNLASYLNLASYLNLASYLNLASYLNLASYLNLTFYLNLKSYLNFTSYANLTSYLKIH

SEQ ID NO: 925612 - protein, 137 aa, Homo sapiens
MPALPPSPLRGTQKPEPVVAEGSCGRWQQTLELSAGHLCPREPSLRHVPAHASAIAGLHLQAGKAAARKKQGAAVPKSLKMQNWVMDRGQKVGARKTDAAVNGLLNLLGSIISSFFPISSFWNAYPMPVPPLDLGST

SEQ ID NO: 925613 - protein, 151 aa, Homo sapiens
MEKLRPRKGQWLNWGQSQVNPLTSAPNPGPSSALRDHLAELSPSQGDNLSLSSVTLAWAQTLSPLPVPAHTLAVLAQALPEKSPSPLVSSRQTLRAPGLPTLSPGLELPPSPSPRPPSRPTFLPHCPSYPRPRAHIDLGGVWFFSAPHVEL

SEQ ID NO: 925614 - protein, 156 aa, Homo sapiens
MPPPTKLKDSPLPAPTCTASPFFAANLRESGKATAVGSWCQDLLRAGDTGLGLCPWGAHCAKGLAPVLRELRVQKELTAPILSGVCPELEARALSVGAHGPKAPVYLALFWGSSQLHSCDSPLLRATTVTTEKTSDFQNEPGIKLLTGAVYVCGVR

SEQ ID NO: 925615 - protein, 175 aa, Homo sapiens
MQYQQSHGGWWKPTVTERLVLGAAHAVIHPPPCPLGAGTGIKPVVRGLPRRAQRWPSKKALARYGPPTFNFPTSRTVGNKSLFFINYPGSGQRLAPGLVPKCTLELLVRGGSSRRDRYGELTINSWPSLFSSAEMVAVAKQPGLGLGGRVEKLGKCLWPRTDLSLASSRATVANV

SEQ ID NO: 925616 - protein, 163 aa, Homo sapiens
MPPPPASGWPSKKALARYGPPTFNFPTSRTVGNKSLFFINYPGSGQRLAPGLVPKCTLELLVRGGSSRRDRYGELTINSWPSLFSSAEMVAVAKQPGLGLGGRVEKLGATEEMGGSYPVPISPSLHFVHFSGHDWEILGSRMWQEFSAMKQNQVLSGPCREIR

SEQ ID NO: 925617 - protein, 254 aa, Homo sapiens
MDSSLSTRSLSPIEGGFCSHCCLCQERVTVASITSGPSWQDPLLGTRMMSGHTEYMFMTQTVQFPNQLCPTGSQQGLVEAAPTWGKWPCSGCGGGGGGGGGGDGGGGDGGDGGIGGGGGGGGTDGGGGGGGGGGGGGGGTDGGGGGGVGGGGVGGVGGGGCDGGGTGGVGGGGVGGGGVGGGGCDGGGGGGIGGIGGGGGGGGTDGGGGVGGGGVGGGGGGGGGTGGGGGGGVGGGGVGGVGGGGGGGGGGWWW

SEQ ID NO: 925618 - protein, 174 aa, Homo sapiens
MVLNYCLDRSLLSYSQLQCTSFQGRPEVAGFPQWLTTQVPPVICLFCQKLISDYLCTECSPYIHPNMPKPNACEYGDYHGSLHWQPLGPMSSQGSLTVEDRGTGGQRETRLPTKGATSPRIWAASERRWKRQINSPRASRRMQPYWHLGFSPERLLSSGTSALYIPDTNLFAIL

SEQ ID NO: 925619 - protein, 150 aa, Homo sapiens
MMWAGSQGSREHREDPNPNHQTHLCHARWRTALEEPGPAGNLCSERFMTCAGFFGRQLGVCWGRPFLLANTARQPRSPSVSGGGDSWLQAEEPWYQVKSEAPDRLSKARCKQGLPISYPSLPDVAAPCSTHGCSGSFFSSLFQSRPSEII

SEQ ID NO: 925620 - protein, 129 aa, Homo sapiens
MVLFSRDDNHGRRDPRGPSSYSRSLKDHDELSFPAKLCGMHRVNENQCRCVKPLGEWRSYCSMTQPILTKEVCGHRALGGQEQRKCFTNGTLPPGDRIKFITYRGKAVIFPALVKTKTYVQSCQLGVWQ

SEQ ID NO: 925621 - protein, 146 aa, Homo sapiens
MLQGTLKIWGKYGSVCALGGPQPAWGDGYSQPFDPQCKTGVALGPGCQFQGAKRSLTPYLRHSHIFQEDPGERQPGLRGSRVPKTITFFKLLLAFPDPLPQARKWQVISKWQRLAMTLKGVISIPISQGLPLHTMPFCFPPPPPAH

SEQ ID NO: 925622 - protein, 141 aa, Homo sapiens
MRAACCLEVEWLPCPANPGLLHAARVPIWKLRLWLSRLGKGHSFLRLCGLPVRWASPLCISGDEWVLAKRLARSLAMQQGPSPLEASQPTFESCASSPGPWRQSALVIGTHVLISAENILSLGREPQCPPIVMRIKNKRNY

SEQ ID NO: 925623 - protein, 204 aa, Homo sapiens
MIRSKCPEQGSKAFVAWPQWPSGPPPPPKLHAVLEVGVSSGVCVVWISPLHTTMCHQGELRSQMPKQWIGGTGSALVLLKHLEQVSGTGARDCRNLETPSQQGQQGIFQSNDRKQQKVVGRARTPEFHPASALIEAQTAGGLQAGAMHLLLFPLHVQETPMGSEVSLFPFRSLRLDGFLKNTMELLGWRCSVGQKAVGCSGPTV

SEQ ID NO: 925624 - protein, 216 aa, Homo sapiens
MQGSGLEKKKKKRGRGRGRRRRRRRRRRRRGRRTEEEEDEEERRKKKEKEKEKEKEEGEGEEEEEEEEEEEEEEEEEEEEEEEEEEEEEGGGEEKRREEKRKICQIVQTEGLISTPNPCSDCSGGLAEPEQAQPGSVCQGPGHQEGSGTHTPTPCAACPAPPCAAGDGLPASCGSSVIPQLLDPSLLLHQPKFHGHPTQAISKATRSTDVLPLGHL

SEQ ID NO: 925625 - protein, 148 aa, Homo sapiens
MHGIYIFLWVCQQFLVLTPFVAGPFSPSPMGGQCPVETQMTSCNDERVEVQEKWTQHASASTYDQGPWSRALVIYEMWRRRDRRRTLDQTQRHPLEKEKLPFKANRIETCFRAKEITFKKQGPQPVSKFMMSQFMIFLTSLSLKSICG

SEQ ID NO: 925626 - protein, 128 aa, Homo sapiens
MDARGQRLVASGGGLTVAETPALPHQLLGTSPCCCHMKKDVFASPSAMIETPGWVCNGNDRGGNTGLEAYAKHLSTKFCQCTLVLGNLSKDGTKNPPKTQGSFDEHQPMEGYGMQPTAGHSYCQLSAG

SEQ ID NO: 925627 - protein, 140 aa, Homo sapiens
MTSDKSSGLDFGICNGGVNICRQMQQYRSKKALETASQFRASCNPHLLWLLDKSFCSSGPLFPHLWGKGETSLDLPGWWCLEAHHRPPISGRMPDPPSTRSLHRKVGFPCKSDSFQKVSSFFFSSQMCPGRDMGTSNIAQ

SEQ ID NO: 925628 - protein, 141 aa, Homo sapiens
MGHSLQPYSQVTAQHPPWVVSQATLRCVDSDILYVGETEGSVTRCKAKGNEDCGWDEGFPRADLKMETILGDPGGPNVITRVLKTESRRWGRRPQCCPRRQACPTSAGCEDGGRGPELRDVGHLQKPGKIGIQALFCSMYL

SEQ ID NO: 925629 - protein, 138 aa, Homo sapiens
MYTGTSLLAAKIPKFFSTKLERLGSQVGRSHRDTDLWSNGRNAFRGDWGYPKLEWATYQLGIWFLALRRVEVKKDPGPGLECGSGRGPSLGRFLVKVPLVCLPPLFLVFFCLETDHQFNFHNYLSELERTFPFCLSRK

SEQ ID NO: 925630 - protein, 157 aa, Homo sapiens
MITALLQCTPAQLAAVLLRDRLCAVSQGAPSGLASRCVHRKHLHRNDLVLGHLQEVSLDHPPNYVLAHNPLSQHLLLRGLKSRPTVFSFSLSPILMQKLGVSMPTPKWSFQCNFSTELPESESKCHCTCICLPINRRGSTGPESRLFVRFTKVITIM

SEQ ID NO: 925631 - protein, 141 aa, Homo sapiens
MAAGDRISASRGNARCLKKPSDLLMIMRLTHYHEKSMKETATMIKLPPPGSTFDMWELQFKLHKTVNMLEIMMMMMMMIMMVRIMMMVVMMMVMMMMVILVMMMIIVMVMMIIAMTTVMIVMEQEMHHSSSPLFLREEAEK

SEQ ID NO: 925632 - protein, 219 aa, Homo sapiens
MWLFGLSPNEALGETLQDERDGGRTLLDYTRPGDPQGQRSKPGQRQGPQMSGTNKGWDESYQMRELLRCKAVVNSPQLHVKGCPCLQTIPRLPVNVISLQPVPGTMEMILDKKQIRVISLFELKLGCKVVETTRNINNACGPGAANKRILHWWCQKFCKGEESLEDEEHSNWPSEVDNDQLRAIIDTDPLTTTQEDIRRYVSDFKQFLMHNIKKLRTVW

SEQ ID NO: 925633 - protein, 171 aa, Homo sapiens
MPDAVARLHGGDGEKQMGTYPHGASDLVVETSKAAEGRMESCRGQRRTNPPWGGWGQGRLPEEMTSEDRSYRLLSGRNLIWRENSLSGMEDLIVGSPEPLALWPGSPSCCWDSRRESIRIACPRIEPCGLEPETGLQHSFILEGGPGLGPIAQDRFTCDKNTMEGPMADSW

SEQ ID NO: 925634 - protein, 135 aa, Homo sapiens
MKKNQAKMVQGTQGFHAATETTLGHLSPHRRNTETPPEGGSQGLLIPRPAGDADAMHNGQKFEKTLWYLNSKQKITNRPFYNHSTWKGQGPLGGPPTGCQTQRAAATCIQPQHCTRQTEGICKHLQKQTRRLQTT

SEQ ID NO: 925635 - protein, 171 aa, Homo sapiens
MRKSSDDSTSSQMLDYHWPGLHKSNMKPDPSLPPVFRPSLLLVLGVFSALVFSTTISLAGMLFNRIWSVALSSDVIEVVFSEKISGGRTGQITPNSVSCVTVKWAGVYCHLAQSQNALALGRTGELQAEQFSAGRVEAEGADSQMLFTDHTPYSWAGKSGLQGEGQRLSLL

SEQ ID NO: 925636 - protein, 173 aa, Homo sapiens [sequence omitted]

SEQ ID NO: 925637 - protein, 157 aa, Homo sapiens
MHEDVCSIETYHFTQIDDFYHLLPDRGLLQGLVNFCDPGPLVLHSNLGKFLAAKNRQAQKSGMQVLPTELIVQQHSLAVPQRTSGLSKEVSPLLVGEVSGMELLITFYVRMPVFREKFSFHSEGSRRLPQVVLERSCIWALEEQGPDTPLQSPSSKS

SEQ ID NO: 925638 - protein, 191 aa, Homo sapiens
MWQMLDQGIYVSRESAVSAGLSGNGSTHCQWGSFRPRTGILKRLHTYSYPSLHNWRVVESSPKSLSPKPLTPHPGLRCFFHIPGKEGNQGEKRYKPQKTLLSPALLLYPNPVKKTGQTTGGESPHTGVPLPMANKNGRPVCGAFLATATLAMFLAEGGSQGTKEPPNRALHKWLNYTDVSYSCGGLFHSKT

SEQ ID NO: 925639 - protein, 136 aa, Homo sapiens
MSMKAMAALLKMYGTGMGRMGLGDVDGFQNLEQMKTDFHQQPTTPGACLYKSVVAGHSQCPGNDQNYCWVHALRDAQSPSSPPGAAHLTPVSRLTKCYQFILKFTLASSLCSHQTLWNILSSVLKQKNGPCVPPRW

SEQ ID NO: 925640 - protein, 177 aa, Homo sapiens
MVIPSDLKTCNAEVSIVLHPHLSDTCLSEYQGLKEAWMCSLESRSQQREVRTSSLLCVLVLVGFAASTHLPLSFVGSINRSQDRDKVTFDESHTAILSHTGQPLAFYLVHVLQRGVRKEKSLGVIDKIKALKSGLWELSALEPCGHVDANQQAAVLASQQSQGVGGNTDCAMCEGCS

SEQ ID NO: 925641 - protein, 147 aa, Homo sapiens
MLQIRGHHEAGCELLLLHEPVLARHVGEKMRRIAGRTETQPIEARKPPDWCRYFWSPEEKPETHTLGKGAAWQVLISPSRFDALDLWKDHTEGKSGYWNHLWLPGIPSTGPWRISEKRTTNKHCKETRFLHQQVGASRYHDLDVDEL

SEQ ID NO: 925642 - protein, 139 aa, Homo sapiens
MGCGCLNGVNDGGSGHDDDGSSGCGGISVDDGDSCGSDNSTGRCGCDCVDSGGGGFGCVSGSCFDGDSECDDGNGSSCDGGCGGDDVVVVVMLVMEVMVAMIILVDVAVLVLMVVVMMVMMVVVMVLMVLMVGIWVKEI

SEQ ID NO: 925643 - protein, 143 aa, Homo sapiens
MPIQMLPEIGNIYMVSRLHRFVEQRWDLYVRQYGEFQVRNMYCRFTFMNVFHPYNSERGICFSVEPPSIAVPLNLEIVFTLNPEAGLSGASGVTDFTQLQPISLFSLTGHINQNSSSGSIGSPPLKGSSSLTSITISGSTMVS

SEQ ID NO: 925644 - protein, 143 aa, Homo sapiens
MDPLQWWEEEKKLESIRAVKLAFALLRELLQTCPDLEALQLLFPLPGLLFSQIYAGLAPTCSEQESADEMQGKAQNEAWQEDPKLLHIGGLLRNWWDLRNASSNGGWRKWKEKRTTYRKAYPEVTDGQRVVQAMTTPSSRGMT

SEQ ID NO: 925645 - protein, 159 aa, Homo sapiens
MQVHVTNGVRTDRTPRHFPWAPVSNSSFSFFPVGASGLSYSKRNPVRPHGPLRRSWSTSGLTATWPSSLCLAIRQDPFISILRGKIPYWDAEVGQFVLAQLSSDSFSGLAIKQDLKALWNDFPWQILLKCERVFLVYMVALHRIIPAECLKWKKSMLCW

SEQ ID NO: 925646 - protein, 142 aa, Homo sapiens
MHSVQTNEPRQRSGQEKQHCSITYSRNTFIKAYTHSGNRCKSTVLSLTVMVLGEELCNVIPASQECDGCWVGVKSRLCALRYPLPFESPPRTESTAPRKLVLEFYYLHGQKCSLSNQNQYYLELKSTSSYLGFEGVGQCLSP

SEQ ID NO: 925647 - protein, 172 aa, Homo sapiens
MHYTGSHVTSHMTTGGHVTSLSSSVLIYVIIFWVSRKINKQNAMTIPQNFAITFAFDQSTFALTGPLPSLVAIALIVLCLRDRTGKAMFHLLLQFFEEMLQNLGPTCLKFPFKALLFSAVDLGRTTYLLTLFTLMVILLLSPLLLSLTYPVPWSVPNLWASKVSSLRMTNGN

SEQ ID NO: 925648 - protein, 179 aa, Homo sapiens
MAQFLQGACFLFPVIGPAWYKSACFSLTIPLKAPGLGLPPLHWHHLSIIPSSPLPPVCDCACWKCSSLLVGRRMTPHAQGAGAGRQRAGGVLAAVQATSSPGGLTADPSVKEKNDFLFSSFTSYLAGQSQRDPQFWFYPTRAAEEPPTVLCVRVTQQVLRPAKIDITNSMDAGDQLYGC

SEQ ID NO: 925649 - protein, 154 aa, Homo sapiens
MVKKANTSMSLMVQTDFLIWVAKGENNISTELIDEGHGTAVGHKAAAKGAASSDTAQEMKALPCLLTEKGEPDTALGLWGSSPPPSSGGTAHENLPEHTGARHRGTVQLGSGLFGISSDLKGPVDSEEFGSQHSPGGIYPRPRNACFTPGSATH

SEQ ID NO: 925650 - protein, 134 aa, Homo sapiens
MKDEVPCDVGRRERAQKPLGTLPCEGQGPETLEEAVSSVTAFLLASLQRELTVQWEEKGAEQTCAALQCSATDQSHVTHKQRAVSFQRGHSMWLGDLNSPSQRRKGFIWSWRENNRKQRQEWTGCTSGTQTHQI

SEQ ID NO: 925651 - protein, 210 aa, Homo sapiens
MSPKFNPNKIKVVYLRCTSGEVSTTSALVPKISPLGLSPKKANEDITKTSDWKGQRIPVKLTVLAPYLSSLESSVLVTAPESSSQRLPPHPLLSTQSSGCATGSRERRRHPAFKELPWELGLPRCISGDVCEAHSWAAQTAPHRRRWAHQLRVGAPPGQILLQVTFKIAVQALGTGLPEACLIQGLISWLCFSSTQLMRGVLGEGGKTEI

SEQ ID NO: 925652 - protein, 122 aa, Homo sapiens
MRQLFKHIPSLPSCGNTVGASSGHTWVQDQTPQLCRPGFLTYDIPPRRFAGKIEPAGHSQCLELNCSQLAAWLNDSPLPEGCLCQPSSFIQVNAYSLSTRARDLDLNGSQRTYGEKAVYEKD

SEQ ID NO: 925653 - protein, 170 aa, Homo sapiens
MTQKTPVWASVLAFSGQQGRDHTLLSQPQEAPRERTKGQGHLLSLYPATVQHPDHLLSRGKARTALRASGRARLRPPRTSFGERVSWWVFADGPGRNVRRWEQPTLHSPTLTPFRSRSLMQKDQQGTKKDGPDSRRHWQWDSWLILSSWEKRGTGTQNAIGSLAGLAGAE

SEQ ID NO: 925654 - protein, 194 aa, Homo sapiens
MNQYQVVLTLYPLKLYNLTFMVAAPGEKKRWQREGEDHGKSHSSYEKFWQLLKMAVRSGIPGRTLDPPRAAEADCETQAHSFWLNPHQTMRLLQSSYPFVVNCKQEARWACLVNATCGSEYLMLILLAQRPPFEYLCSRICIIPDVALHIDIAGSDSNGCHWDAPGGPLGYKISFRLPRSNRTYWLKACAVQPD

SEQ ID NO: 925655 - protein, 153 aa, Homo sapiens
MWDSFLKVRPHMVHVETTLPQSPGSPQHEDSGSKGKGEEKRVSRDRKGVLRWEGQPRSRQRFLPPSRAWSTLNSFIDSIQGSLSRRLVLCQLLATLLHRGFPGPSIPKKGALPCRLGFNLRQACAPLGCWCVVLLTHVPQQLEIVRREGGRRA

SEQ ID NO: 925656 - protein, 193 aa, Homo sapiens
MWVGPDKRIKAGCLSWRWQCFPVSFCTVEALLFYSAINLAAANCLGPRYLYKLFIPEASETTNPAGGTNNSRRAALRAVNTHRKVCSFTPEARETTNPAGGMNNSRCAALRAVTLTAKVCSLTPEPARPRTHQKEETPNTSEPRKEETPNTSKHQKEQTLHTPPLRTVTLTTRVRGFILEVSETKKPPIPDTI

SEQ ID NO: 925657 - protein, 158 aa, Homo sapiens
MRSRQKTGCLAFSCAVRNGLIWLVGESNGLESNEQRGRTGSSWDFRLPFFRSLRQSLAPETVCTETSHKAPSVCGYKPEQLRNPPSPLRPGQGSGAQRRRLERMHFDPPKGSCPHLRHPSPKLLKPIPPPPRLLCASRVSFVSMAMTMAFKVPLPILL

SEQ ID NO: 925658 - protein, 202 aa, Homo sapiens
MKTPCLKQRKCDVNVYVKEGGKLGGDLGALASEIRMFGWMASCLTSRCLSVSSAGSSFSPRRPLEDPTTNPAVTPDGFTSKADPEVTAPQHLTFPLSPGATSSPGPAAAADPCPTCPLLTELGGLTEVKKLPSVNQEGPSPDTDHAGALILDFPSSRKRGFPGPPGSTPACFPSFTFTKQHDLSVHEGSLAKRHVPPAASTV

SEQ ID NO: 925659 - protein, 164 aa, Homo sapiens
MPKSVCSRLLWSLGAALDREEYRTFPSHQHPEFQFVSGLCTKLRNRERGWKVAKEEGKMIFNCLLKRVTIKVKQGSKVGTDYQLGSWRPHQPSESPRVWTVSGRSGTSISPSVLKVAPTIKLDPHPPRPHITLSCPDPQAHLKLSRPTYWQKGDLRATPDWGAI

SEQ ID NO: 925660 - protein, 134 aa, Homo sapiens
MAVDEPGSRPSPGTESAGTLILDFPASRIPGGWQPSLAFFVAASLHSFFLFTWPLIWFGSVSLPKSPVLEEGPVGGDWIMEVHFPLGAILVTSCSSHEDSCFCFAFCQEQKLPEASPEADAAMLPVQPAEPRAS

SEQ ID NO: 925661 - protein, 184 aa, Homo sapiens
MVEEERLENLTWAFHYPCPEVSDIIPSQVHGLELTTGPNLPARKLRNGDPEATDPAERCSHFPARGPLKPYHGSHLQVQAPHPMRPRERKPPPSLNFLSKGGPVCGSTNSENSCSQGGIALPSDPRRTGAPESMGPASVLGQKKKHPQTRKQNSPQTRKKMFCSKIIQRCKFGVCELEKFWRIQ

SEQ ID NO: 925662 - protein, 206 aa, Homo sapiens
MIVRPPQPCGTWMLSCLLSLSIGISHHDGHMEVLGGLLTNHSIESLLNQYPRIPGSMFKNSQGQGLSPKFCNSFLRGETFMEHRNAVDTEHSALLGAPGKEHFLDKAMSKLLTEGTWLGLPLVFVSAVDYDSRVLHLAESTMAVTQAGLSGTSDELVLRDTACFLFCTQKVVIPPLTMPRPGTMQEDPSGLKSMLACHLIDNRRNL

SEQ ID NO: 925663 - protein, 136 aa, Homo sapiens
MLEDVRICQGLPGGRNLEKQLIQSISLADFPFFPSLLYEKFILAIKRQWEGGFGQSSIQETGLACWIHEAQKEGNVTQRKSLMIMYSGDTCNGRLLTSHWQSLECFPVRNDISLSQYPCVIHSFSKLPVNFMNTED

SEQ ID NO: 925664 - protein, 145 aa, Homo sapiens
MRGILRNLNILLEFSLILPRYYHGIAWRFSWNPGNDCQGTYCIPGSLYVTIQFTSHNPGVDVVGEKRQHVQGQELVWVGQNLTQIQCSCAILSTRLLMDYYCHTHTYTHGKKNQCNLNFSSPDESLINCCGELLISYCDVIFKQH

SEQ ID NO: 925665 - protein, 133 aa, Homo sapiens
MTPTPTEKHIRQQLLLKCESPVVCCVPGLMDSCRKGCLGSKTSHTEPEVSKQAESSASNAVSQTPAVRGRLTNASCPRIPCLKPSVAFHHLLAVAWTTRHLGSPHPSLQGPLPIGAFPSMLWIAILKVCPEDP

SEQ ID NO: 925666 - protein, 642 aa, Homo sapiens
MCELDILHDSLYQFCPELHLKRLNSLTLACHALLDCKTLTLTELGRNLPTKARTKHNIKRIDRLLGNRHLHKERLAVYRWHASFICSGNTMPIVLVDWSDIREQKRLMVLRASVALHGRSVTLYEKAFPLSEQCSKKAHDQFLADLASILPSNTTPLIVSDAGFKVPWYKSVEKLGWYWLSRVRGKVQYADLGAENWKPISNLHDMSSSHSKTLGYKRLTKSNPISCQILLYKSRSKGRKNQRSTRTHCHHPSPKIYSASAKEPWVLATNLPVEIRTPKQLVNIYSKRMQIEETFRDLKSPAYGLGLRHSRTSSSERFDIMLLIALMLQLTCWLAGVHAQKQGWDKHFQANTVRNRNSLPFDDGGGGGDDDGDGSGGGGDGDGDGDGDGGGGGGGDGDGGDGDGGGGDGDGGDGGDGDGGAGGGDSGCDDDDGDGDGGDIGGGGGNDAGGGGDGGDIGGGGGNDAGGGGDGDDDDDAGGGGDDYDLVVVMVVMMVVVVMMVVVAVMMMVVVVVVIMLVVVMMMMVMMMVVVMMMVVVGGDNAGGGNDDDGDDDGGGDDDGVVVMMVIGGGDDDGGGGGGGDDVGNDDGGGNDGGDDDGGGGGGGGDGGGGGGDGGGGDDGGDGGGDDAGDGGDDDGVYQGMN

SEQ ID NO: 925667 - protein, 136 aa, Homo sapiens
MPGGLACAMVNFRHQFIWVTRCPDISSDIILDVLVCISICGGHGTLGCNISTRLVYTGTPFTQQEHPTPLGHPFFSPPSVYLRHRIQRSVTCNRNCSSEKPDSLTYPQLHTTLPRHETGSFQQANCMQLTIARSSH

SEQ ID NO: 925668 - protein, 208 aa, Homo sapiens
MTKPQIIGLEKRRGGGRGKKRGYQQSNNATTNACFSTCISLKLVENDLKTGFKLSGGQREGGNMFRSIRSIVESIASAPLESSFIQVQARTPSSCQVRHISSLCRVAEALGLSQRPGAKSPVSLMAASSGLVEKWKGGPRDSGLEKYHVHTEQQKSELKATVVRMTENYLKVWLYTPVQNNAHRVHLSEVACIKSWVHYLAQGWKICR

SEQ ID NO: 925669 - protein, 142 aa, Homo sapiens
MRNKLFLPHVLLPVKKKSVLEEKPINSNIFHLDVDSGSFHLVTLLSSAQLVGRRRPWRRCTSFLTTTYMSLEATGHMDTPRWEGAWATESLSGQWLLDDSSPHWKKELTFWKTCLCHDTSSNSILLYHRQLRQEDSASGPSS

SEQ ID NO: 925670 - protein, 138 aa, Homo sapiens
MRTILTAFVLIPLSTVAQNQLKDSLAIWKVYRNKIKQKSGSKVSTENSRNSISPEFLSSLLFPSNKPLHCSPIFLCKNGMWKRVIAAAFKYENSCCRQGPPDMQPGVSSRADSTWRGAAEAMMLRTWHWTTCPTSVGS

SEQ ID NO: 925671 - protein, 158 aa, Homo sapiens
MWASWVFTASARMRGLGCCFVCTEERCRNARARWHLIYQLPLCWGFGRFCWNLKDRLSYRGPAADSEIEKLGRYANNIQGIDLQLPRQGSLALSCLHFVEVDLTRRSGRHLLSDEPCARFWKGAGDTEMNESSPFPQEVHTLSLGEMDMPFIYVLSIY

SEQ ID NO: 925672 - protein, 140 aa, Homo sapiens
MNMQTPLVILLSTEVQEPLAQSNASSFLCLPEFPTTLPLLSSYTQWLTSTVIKPHSSCGFFWLTLLIFGTGAMHCPLLMRFERTKWVNISRDLRTWPSHSKNWADVSHFPHCYSYSPEMSHIQEAEKLGTISLHLLEILR

SEQ ID NO: 925673 - protein, 145 aa, Homo sapiens
MLLLLLTTVMIMFDDDGDGDDSNDGDNDDNDDNDDDGSDDGDDDHDDEEDDDESDDNDDDDDDDSDMRMLAIMITMMVVMMTMMKVTTDDDDGDNNDDDEDGDGRDDSTDKGTGLGHSRVCLANYKCFWILNAGRGKQLQGVGLS

SEQ ID NO: 925674 - protein, 216 aa, Homo sapiens
MGEKNLDYLSVRRKKAEANRSKTGCSNSRNLGNISSISGDGQAAFFCWLADSAGAAGAAGTTEPVFSNVDASSMGKELRGHRSFKIGHYAKGPEPAEEDFSKPSCHYGGTVSCCWACISLSSSCDEEWLHCLTHGGLYAVSIQYAVSRCRPRFWIMVPASGVGVGLLTASSHSGRQKGKGGANTVPSYHRRAEVSGSTPTSPFNNGNNPFMRAEPS

SEQ ID NO: 925675 - protein, 214 aa, Homo sapiens
MAIIKKTKNNRCWALERDVKANCMLQGFDIQIILSPAKVLHCVVATGSMMVCVFQQQRQHGEVHTHQLRLGTGRHSCASLHKYVCIGGSGSVALVVGGEAAIFCACIHAGRGGIPAGHPGLYSKQAPPGWHPTRGQQMGLLRSYQPHLMGKIALFFSGPSSAGLLQLAGGPLQALFAWVSPAEAAEQQRLLLASSSGSFVPEGHRPDASRGSSV

SEQ ID NO: 925676 - protein, 136 aa, Homo sapiens
MRIKTNPKNPKLLTQQQQEEALDTYLANEYGGSLEIYALEESLYGKLTLEKPQSFRVIFGLAFLLFVQLATKIGQLTSEMTHHFLPLISPELISRGISFVGLLLSSTATTSILAILTLSTLILIPTPHPSLPLSDS

SEQ ID NO: 925677 - protein, 155 aa, Homo sapiens
MRKNQCIKAENSKNQNASSPPKDHNSSPAREQNWMENEFDKLIEVGFRRWVITNSSELKEHVLTQCKEAKNLENRILYPAKLSSMSEGEIKSFTDKQMLTDFVTTRPALQEVLKEALNWKGKTGTSHCKNIPNCKDHRHYEEIASTNGQNNQLAS

SEQ ID NO: 925678 - protein, 134 aa, Homo sapiens
MAHLYLCNKPACSTHHHSSEVDEMSLHTRHTFSSQEAACYTEGCLQRIPFSSCSLLRDMDPAQITYSSLSNSSESVPSNLKRNSQVKRFELIYRLSALPYNPFSHLEVQFPDLAHKQDKAVFGASSHLDTSAFT

SEQ ID NO: 925679 - protein, 179 aa, Homo sapiens
MDSILWWSHQIIRKLKKFYPYDIIAEVFQKKVLLSQANSSMHILVPEDLSEGQDMEMEDSDINDRDSSVAEGSRAHGKPLVKDLAEEAMFEQRPEQSRASESSPWLLTLYSTLLGVCKPPGLSAGLTSGVSVSVYVTHPSLGQGLRDGPPQCTVKQLPRSPLQEKRGLFGGEIELEAPY

SEQ ID NO: 925680 - protein, 169 aa, Homo sapiens
MLEGFSDKAKCGRDARYFLDPFTGLATGVPHLLNPPRANPCGREHTGERVRDPASCFWAPTGANSLWASWQHPGGGMAGSRNSKSCKNSLSFYPYFNLDSLSDRCGPIQQQVSQATVNLHVPWRLTCKKNKSMCFAKWLQCKTQPRFLLTQFGSYTDLWTNYLSMNGEL

SEQ ID NO: 925681 - protein, 124 aa, Homo sapiens
MCKVRCSWLPASIGCGWMERRVLSSLNSIQEMNTESLGRDTKLIGNMWPIYMIFAQHAIHPYRGHMNPLRTELGLLAVIPFCLLLSLVPLASKGNDSEKEVKSCFINVIYSRADKNQEMVRQLD

SEQ ID NO: 925682 - protein, 148 aa, Homo sapiens
MIISIDAEKAFNKIQHPFLIKTLNKLEGMRCRLRLIRCFIAPYLLCETGTPDEAEDWIFPSPPMKDSALEPKKQFFLACVCEILVEFLEVKSMSQNDHVSVQFVDPDASAPEQWPNDRKYNMNIFLNESNEEELDLIGLWSLRRWVSK

SEQ ID NO: 925683 - protein, 186 aa, Homo sapiens
MYTMAHMQAKHADNRFLTIPHVGPRPLFLKSCDDKASAVCGDHKAADKFIDDENLTLEQAYNADETSLFGHYCLGQTLTAADETAFTGIKHVKDRITVLVSNKCANATGKHKCKLATIEVDAEEVFKINNKCPFAHSLTDGEIAKMLLNQGDNDNRDDEDNGVITAEKAPRDNDIFCIFVPTQISC

SEQ ID NO: 925684 - protein, 141 aa, Homo sapiens
MREADQVYPPYNASYWALLTLVGGEGWLSHSKSQDEIEGQHQIQDIKTLLMKQVAGKKWLKPTKSKMAMRVTAGCPHCYTPISAMTVYKCHGNIRKLLPAGQILGIQKLFAFYHLHVLIVNSQCLVNVIVFKFLSFHSKCH

SEQ ID NO: 925685 - protein, 143 aa, Homo sapiens
MRSLILRKEIWTVRNMGSSTQQNRRNSKNKDKGAFPYGRFQHEKQATWLKWIDRMESFKRLTYNDFALCACHQRFGYNSASCLPSAQEVFNSCVFPLTLLLHKLSSLGTLDRVSCGRKFQAAKHSRGDLGAAKGIQFHKGSRV

SEQ ID NO: 925686 - protein, 169 aa, Homo sapiens
MQFILTNGKSRQTLSNAPSETGIHWITVTCPDFLASTWGKGRLSGHSYSRLKHSCLPALKRAADFPAQCSSSAKGQTASSSGSLTPVPPDWETSPSRGRQTPYTGELWLASGRCPSGIKLPEEGTGSNHCCSAASAGEILRQTGSEVDLQQTPADLHQRGLTVRRKTNK

SEQ ID NO: 925687 - protein, 143 aa, Homo sapiens
MRKGYVGLKPPSRVPTGALPSGTVRRRSLYSRTQNGRSTDSLHRSPGKAADTQCQPVKADRREAAPCKATGAELPKTMETHPLHQHDLEVNLESKEIIFGALRFDFSRILHLHGFCNPFVLANCSHLERLYLPNTCTRIVPRK

SEQ ID NO: 925688 - protein, 133 aa, Homo sapiens
MILLPISQGLYTLLVILFLISRAEDDNITPNSAGGVHLPVMLFLVFRGREDNIASNIPGGVHPPVILFLISSKTKDDITPNITGNVHSPCDIVSNIQRAEDDITSYIAGGVESTCDIVNNIQVLEALSCRSSQ

SEQ ID NO: 925689 - protein, 159 aa, Homo sapiens
MPYIYLAFYTLHNTSTFHESFNHHLNSVRCVHPSAILFIIFKGRENDITLDISGDVNNPAILFVISREGEGDITPHITEENVRMILPPISQGVYTPPPPHDIVSNIRRGEEDISPYIAGDIHSPFDIVKISKGNDDITVNIGGGVNHLCDIVPNIQWKG

SEQ ID NO: 925690 - protein, 146 aa, Homo sapiens
MINKYKKKKKKSILWAQSNHFLVNLKQTEKCEKERWASPPSLHLSPVLAAFCPQTSDSKFFSFGTRTGSPCSSACRQPIAVLVIMPTVAIPWLLLMFAHLPGALPTISRWQSQPGLCASFQGGEVPQAQGTCAQRAGMFHVLTRSM

SEQ ID NO: 925691 - protein, 139 aa, Homo sapiens
MNTCAEESLSMAILTPSPWRVLLSYCQYSVKAQELLSQFVVNAASPESVPSGQWASQGPESQPFLGSGSKNLELRYCSQPCRLHGVTLELQGSLGSANDDTLEEFLGRHAGPVYNSLFLALCVNNQGCTCLITEKRIEK

SEQ ID NO: 925692 - protein, 283 aa, Homo sapiens
MGLEEDRKIWESLKLPRDLLNGFDQNANSDMDNEVQGEVVSDGHKELIGNWSKGHSCYALVKRLVAFCLCPRVLWNFELERGDLGYLAEEISKQQSIQEVTCFFLEVYSHMCSQRDDLKWKLMFKREEEHESLKNLLPDHVVEKKNPFSGEKFKPAAEICTSNKELNVNSQENVEYTSRAFQGSSWQLLRSQAWRPSRKEWFFWWIPEPYHFVQPWDIAPCISATPALAMAKRSQGTAQAVAPEGASPKYWWFPCGVGSVGMQKRRVEDWEPPPRFQRMYGHA

SEQ ID NO: 925693 - protein, 189 aa, Homo sapiens
MVYAGIFLSGGGGSQQDGWGAGKGMKWKDYLPLEFGRLLQPISLAVPSGTPLDIQMLLLFSSFSTTPLCCSSAPLLDHSWNLGAAVSRLEGRAFASEPPSSTQYFPASCPYQHCLSKHDNLAAKPGIDNLLMVYRCHIKVLIESRHQGEATSQIKTLEIDNKISGIGWDTGETGMNETDKVPVVTELVA

SEQ ID NO: 925694 - protein, 143 aa, Homo sapiens
MGFLPSAMVVRPPLSCGTSDNAIEKKNPLPEEKFKLAAEICISNEEPNVNGKDNGENVSRECQRSSHQPLPSQPGGLGEHDGFVGRAQGPPAVSSLGTWCSVLQLLQPWLKGVKAQLGPWLQEAQAPRLGSFHVVLDLQVHGS

SEQ ID NO: 925695 - protein, 157 aa, Homo sapiens
MASTSYGIRSKLPQRDTQGLSPVLTLAPGLQCDALLSPNKHRESLQGRTRCPPVTARPQGDRAPSGPVGSPIPELDPWMAFLDLRWGRQEPIVLKGLKGILVVVWQHSLWACGSSSYKVFDSVSDSLMAPLNLRGAVLVGFATCQLQTPRALSKLKQ

SEQ ID NO: 925696 - protein, 183 aa, Homo sapiens
MNALGETNNSRHTTFKSCNTHCEDTEKNKKQDIKTHYQSKSLLHKGRQEGRKDERTNQTTRKRITNWQYGQRHKRLDVERNILVEEHVDRHQQMPARWQAINRWNDLEFGQGSWRRVQLLSGPTPGENFPIPSPFWLPHLLRATSIKKLALILQAQIVLMKDTIVGMNTEEFTGKDVAQTYWI

SEQ ID NO: 925697 - protein, 152 aa, Homo sapiens
MKNLLTYSQGTYIIEIAQYGIAFRNTLFNEEGLTFKKTPETDQQRLSKILGVGRSNARSWKRREMKLLQTQTDTPPVTRENLFTKVEEKENNFITEYALNQNVVCIPCNPLRDCKDNLYDRRSVLNEPTLCLRKLISYELKHHQINDPGKGY

SEQ ID NO: 925698 - protein, 171 aa, Homo sapiens
MLPLLQVLLHQTLWAPHWLACFPYHFSKQLSLQTRAPMVVKWSPPAGIPEAFGKSRLLLNSTLQLIDQDYYRHQTALDFLLVDKTESAQSLENLAVPGLMLWTKSLGTHSIWGVSWVLQEQSASFRGLWIFSEWFPNLSILYLMILVDEKIKNGKSYPPLAGANELMILPT

SEQ ID NO: 925699 - protein, 232 aa, Homo sapiens
MVLWQLTVSQIWDTSVVLSVDNGRTSALLRLAISSDCALTFAMMLSKHSRAEAESMYQIKYEELQTLAGKHGDDLQLTKTEISKMNRNISQLQAETEGLKCQRASLEASITVAEQRRELAVKDAKAKLSELELMNIKLALDIEIATYRKLLEGEESLLESGLQNRSIHGKTTSGYADALISAYGDLTTPGLSYARAPALALAGLQLLQLHQLHQGLGCEDGDPRWEASVRVL

SEQ ID NO: 925700 - protein, 151 aa, Homo sapiens
MVRYIGDIMVIGPSKQEVATTLDLLAAVQAALPLGPHNPADPVMIEVSVVNRDAVWSLWQVPIGESQWRPLGFWSNALPSSADNYSPLERQLLACYWAIVETEHLTMGHQVTKQSKPPFMNWVLSDPPTNKIGHAQKHSIIKWKWYICDQA

SEQ ID NO: 925701 - protein, 178 aa, Homo sapiens
MYVHLNADLWKLTMNIIPFPYLHFFMPGFAPLTSQGSQQYQALTVAELTQQMFDTKNITAACDTSPHYGCYLTVPAIFRGHMSTWEVDEQMLDVQNKNSCYFAYWLPNHVKTAVCDIPPQGLKMSDTFISNNTASQELFRPHLGAVHSHVQVQGLPALLYELLQLTIGSIIYNTEIWP

SEQ ID NO: 925702 - protein, 197 aa, Homo sapiens
MWNCESVNPLSFINYPVLGMSLWKHKDGQIPIPLCVWLPHLAVGLLQTLVTLVFSVPGDICSQVCETAKNSFLWRLLPLEALSQGVLMCCQPEHICKRWLEPLLGSLTESGGMGSWTQLKKQSGRFLVQQVAETPSGRSCQVMMNESWSHLKMQSSYNLATQLCFVVGGLSLSGPLVFPKVQAGPTKSTKLQTVATH

SEQ ID NO: 925703 - protein, 173 aa, Homo sapiens
MLLQLSRPVIRLWLASLVPAAQTSSGSMQTGRTEDFLYPGFLPWCTGRIGSHMGLENERKVLLSGHSSQQMDGEPEGRASGKVVFSWSQASQQLGSLLQPHQPNSKSFCQSMACQRLPVPVGVLLWLPVQETGKVIVLFKLITEATGIRPDTEDVDEDVEKGERWYTVCRNVN

SEQ ID NO: 925704 - protein, 141 aa, Homo sapiens
MEKDYTLVAVLNDDAEAGTCIPGQDLKDGILELEPVLNASEASSTKKPALSALFAGNLIAESLQILQCLQVLQFLALQSTAVSTQLPAASSAPDPMTRKLSSIPLAPASHLVSPVFCSCGVRQPAAHDSKQLSLALCKEDF

SEQ ID NO: 925705 - protein, 153 aa, Homo sapiens
MAATGKLSIILGTQGSLPLNRVQCCEASAQRERQDVSKKSSVWNLLRKLILLRASYLKGVVENRGDLYWKAIKKRLVALIKAKQQSNQKKSGEKLSKNTFPGFRVKFGCQENCVHMLSRAHFRGNQNKNLGRLESILQHMYRFISAKRKPRPH

SEQ ID NO: 925706 - protein, 160 aa, Homo sapiens
MTPDIQGGDFEWATGYWRSNKGYWKQRATSEIAPRSPKPWARLNCKEAERRKSSEKPSSKGKEGYAESRQCGPDKAVRNNGNRKLNKNPEVKDVLRTMTESPLMFWGSYHQKNLSLGQVPIPTPIKMVLNLEPLLQAPDSSRKGCWHQIIITQVERRLLS

SEQ ID NO: 925707 - protein, 120 aa, Homo sapiens
MLKEDMTLCGQKHRTLLLRAQQEACASAYLPPSLTGAIWGAQMDVPQAAGRLFTKDVDIEVQAGQRDLPDWTVLPSSGGIRGLASVPSSCGCPGENSNFFGGNIIHDSQKVEKIQTLMNG

SEQ ID NO: 925708 - protein, 138 aa, Homo sapiens
MLKSSEEKNQFSEEKFKPAAEICISNKKPYVSQQENGKNVSRASQRPLWQPHPLQAQRSRREKWFYGPGPGPPAVCSLGTWCRVSQLLKSWLKEAKDNVKTIATLKVKMGHPAMNYYPTQSPRFGSLSAQLHKEEMNY

SEQ ID NO: 925709 - protein, 148 aa, Homo sapiens
MPVTQSSLSSSYKEHISNTLCSSLEPPSLDAGLEGDSPHPPRPTPNGKGTYTCLTNIWKLGKTSEQVKNVQIYRDHPETCGLHVDEQCELNYCCIWRNSIKESNQSIWIPTAFSCPQRAGTSVGGKTQCIPRQSCLLKRPPGQAPGGL

SEQ ID NO: 925710 - protein, 143 aa, Homo sapiens
MGVGPSEPGAGYNLLVCRFLSPSEKLSIPVGGRTYLKGSCENSICEAYLERGEGNRASVMGKMKKTAAGWNGSRVRRATAVHKPKTPVSLGSEQGPKFWYQDDAGLIKWGNINRSHCIYIQSDNQQNNKEGWGEGTGGGVAGD

SEQ ID NO: 925711 - protein, 151 aa, Homo sapiens
MLLLLLLLLLFGTAATALACSAYRAATLLYTATLGNSAYGRAPLCLWTAILLYTVVFHQLDSLSSIKTPQVSRCFYSSNPYVSSDMDETGNHHSQQTIARTKNQTPHILTHRWELSNENTWTQEGEHHTLGTVVGWGEGGGIALGDIPNAK

SEQ ID NO: 925712 - protein, 128 aa, Homo sapiens
MISTRSVPRVQDDSFPPLASPQLFPGKVEKGGTGSRQTNAPRPEGWGLLESPFPETLKPVLSLAATLVAFKWLTGALCFPPISSEKIERIARERGPMLLTTLEKSQMGSQKGDEKSSSIKGFSRSRAL

SEQ ID NO: 925713 - protein, 135 aa, Homo sapiens
MPLGWNPWENCMFPPLRSLFPFTEFRILCLETCVPHFPATSKGNNHNLPSCDELEKPTLSWFSSYDTSYSFCLTFSGSASFLTLNITQYLGDLIQSHGFKYAADTQIRISSSCLSPLNTKCLYRCSSIYDRVMSQ

SEQ ID NO: 925714 - protein, 204 aa, Homo sapiens
MSVNQVINGYLWYTSHWVGSIGNAEYKIRSPSIGNSHLLQDIQQSSSCAPFVLALSQGAACVLVYKRRVGQGPDLRQTLNFTLLTIRNLIVGDLWPRILLYSEDVTGKSVSPATGRLSARYQSLQKANPMTLRPIGSKIHLKRQKGVLVFDPVLFKKAKEFYEEMQMTDSCVFLEGYLWHFKESPGIKKARHNVKNSQQMTMLQ

SEQ ID NO: 925715 - protein, 142 aa, Homo sapiens
MGPHSLEQLHSCGFAWYSPILAAFTGWCWVSKAFPSPLCKLAVDVPFWGLEEGSGHVMGEAAVKKPMKPHQLHQETFSQLMNDTCFGNSGSFSLIYIASYFQNVFYICMFFIVKALVKILEMSESRSSYVNELCMSFTLKIS

SEQ ID NO: 925716 - protein, 138 aa, Homo sapiens
MCYVRDRKPPAEKASRLMGFQCLRELAEVIQFLQRVCGFSWLFWYVPAAVLGEKVHDKCEEARGKGERHEEELQGIKGRGGQYRGVLGECQQYQEAFWGSLSLKVVKGVDLLGFQSPVVTGGCSLPVQLTCYPGAVVV

SEQ ID NO: 925717 - protein, 155 aa, Homo sapiens
MHRFLVERMTPVVFQKSLDQARVLRARFLERGPGHPWGFSFCCPVPPQVSAPHIPEQHFSTAPAMAQEGPSAALTTTGDGTAVNVGRIHMVITLERCRVHELWDCGGLNLGFKGCIEQSLDSDENMPQGNSCQRESPLELCLLEPWGWRQPTPEQ

SEQ ID NO: 925718 - protein, 173 aa, Homo sapiens
MQQSLDSDIFFLKYNQIYFHLVKKEKQICSISFRGQDSTDVDFKHKCKQQRNGRVKCIGAQTLEHCTDSKPSFAISQKIITGDEIFQLERILEMIQLDSLVFQRRKLEHRESDLLKDTLQSEIAKFYAIQVPLASGTLLVQVHLFQRDHGVWSQALRLRTDSKDFSTLKYHAH

SEQ ID NO: 925719 - protein, 197 aa, Homo sapiens
MLVLESNGGWRQTIGSMMLLVMDPLPTAEPTTFGTLLATSVLPNFSAAIPWSIAFMPGALLRVSLAKADCPSTMAPPKELGAISLFFMAGDDGGQFPGPLAILQGVWVQVSAVGTEALSQATDAQERQDDQEDDDEDPQGAREELVLLAAAREYFKLFPIQYYVGCGYVIDGFYYIKLPLLALGVHLQEISFSIPLL

SEQ ID NO: 925720 - protein, 136 aa, Homo sapiens
MEEPGVTPQPYLGLLLEELRRVSPGAMSVTWPRGRGSRRGKEAVDRLWGLSRRGQRSRSQSSSAARLPPVFEAVVRLVGRLSGFCVMEEDLGLWEGEESTCLAGLCKDVNVSRFLKLISLSAMLFILSRDTWFLRL

SEQ ID NO: 925721 - protein, 472 aa, Homo sapiens
MIFADPWHYIGPTKIILDAFSVLRSFITPGHSGEQNIDIFGQYEGYEVESSLKDASFEKEATEAQSLEATCEKLNRSNSELEDEILCLEKELKEEKSKHSEQDELAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLEHIKNLQTEQASLQSENTHFENENQKLQQKLKVMTELYQENEMKLHRLTETELKFELLEKDPYALDVPNTAFGRGSRGPGNPLDHQITNERGESSCDRLTDPHRAPSDTGSLSPPWDQDRRMMFPPPGGNARLPSSPPAVQTVPNSPRKDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFASMLF

SEQ ID NO: 925722 - protein, 156 aa, Homo sapiens
MLLLMASLLNSLQCRPSAAGLLEFAGSPLQTLFAWVSAAEAAEQQILQNNKCCCLILPLKALPERGTWLYEVSDGLYWEVSPRRDDTSTPVATTTGTVLDQTQSQHSTGPGPRPVPPHIFGWIIKWESQALHSWMVYGQGILIERLATRILNHSGP

SEQ ID NO: 925723 - protein, 402 aa, Homo sapiens
MCELDILHDSLYQFCPELHLKRLNSLTLACHALLDCKTLTLTELGRNLPTKARTKHNIKRIDRLLGNRHLHKERLAVYRWHASFICSGNTMPIVLVDWSDIREQKRLMVLRASVALHGRSVTLYEKAFPLSEQCSKKAHDQFLADLASILPSNTTPLIVSDAGFKVPWYKSVEKLGWYWLSRVRGKVQYADLGAENWKPISNLHDMSSSHSKTLGYKRLTKSNPISCQILLYKSRSKGRKNQRSTRTHCHHPSPKIYSASAKEPWVLATNLPVEIRTPKQLVNIYSKRMQIEETFRDLKSPAYGLGLRHSRTSSSERFDIMLLIALMLQLTCWLAGVHAQKQGWDKHFQANTVRNRNVLSTVRLGMEVLRHSGYTITREDLLVAATLLAQNLFTHGYALGKL

SEQ ID NO: 925724 - protein, 158 aa, Homo sapiens
MPPRYLLECLRRRETATSNGKIDVDGYLIEGSVPYLLIKAPRTERWWTDHSRCFTAPWQMSLYGSNELREAKLANGDCSPNSISDFVISKQESDYVVATNMDFSTATYLSTCLRQCLAPQIPEPSLSLPVKEASLQTPKSSASAFLGQVLLLLRKKLL

SEQ ID NO: 925725 - protein, 141 aa, Homo sapiens
MFENWEKFSTARGRELGKGMRQEMCIGPNHLELYSHINSFAFYFKGDGKGEDNICINFLGLPKCHGLVGLNNRNLFSHSSGGWKSNIKMLQAWFLWRSLSLACRWPPSYCLFIWSFLCVFFSQFELFKNKFLELVLLNHQV

SEQ ID NO: 925726 - protein, 139 aa, Homo sapiens [sequence omitted]

SEQ ID NO: 925727 - protein, 143 aa, Homo sapiens
MRVPGGRRLGRPHTQSLRPALPALGSEGLSTRASSCRQGAGYPSTNGPPALHSNSHWVSAASPQGRAQTCSPPCLSPPCHPHPVVGSRGARASQRGAVPCSAAPGSIDRPRAEECRRALEGCICTNRHSVSSSGLVDAPISTL

SEQ ID NO: 925728 - protein, 144 aa, Homo sapiens
MPYFLDDCLFFAESHHFSAFKVFSGHTRSVMDASICFLWGFKLLPLIVEGVCQLQVCWSLLEVPYRPSLPGITSGGSVGNAEITHLLRQSHWELQTGTVLIRPSYNIAGTERSLIDSQFYMIGRPDNHGRRPNEEQSHILHGSQ

SEQ ID NO: 925729 - protein, 152 aa, Homo sapiens
MLNMSYHSLLACKDSNEVCYQTYWSSTAEEPLPVATTSNNPQRVLPGTADVHLMPKDSSVMAQPSALMRKADDVGSSNGMPLCGWDRGGEHCDLRKLVKRPMHLNQSQICSPTGTSTYAFPAPSQFYFWLVVFLMGHERLTPTQPHLCEELE

SEQ ID NO: 925730 - protein, 202 aa, Homo sapiens
MAIWDWFSTHFILYIEDENSCLFRSLLQFTRGPLQTLFAWVSPVEAAEQPRLLPASSSGSFVPEGHQADASWSSPQSLSTMLGEYSLSGSAALFRASRQESLSLLKLSPQPPLPPGALSQGDGSFIYKPLTGISFRDALLSDEESREAVRPQPLCHAVLSSAQSKLPGPLSTIRGKPPTQASVMVDAPPPTKLYHSRLTSDC

SEQ ID NO: 925731 - protein, 147 aa, Homo sapiens
MAAPLGSAPVGTLCGALSPTFPLDTAQLEVLHEGTTPAAGFCLDNGHLLVFAHGPPSVHIFLYALKSSYKDTSQTGLEPTTNGFILTSLPLQRPYLQMSSHSESVDEHKQIKMSSNSEDNQNSSILVEIQKKQISVMSSSNLKLEEQ

SEQ ID NO: 925732 - protein, 244 aa, Homo sapiens
MDEYSKLVPVKWGGAENVEATMELGTGRGWNGLEGSEEDRKMWESLELPRDLSNGFDQNADSDMDNKVQADVVSDGDEELVGNWNKGFKRETEHKSSENLLTDDAIENKNLFSEKKFKPAVEICISNGEPNVNCQDNGENVTTACQRPSQQPLASQAQGRALMEKLCQGKVEGKCGIEAPHKVLTGALPSGAVRRAPLSSRPQNGRSSDGLHCVPGKAKDTQLQPVKAAGGRLYPAKPQGLPNS

SEQ ID NO: 925733 - protein, 156 aa, Homo sapiens
MTSQLGRSSCFLGPLTARWPREDMAARHGSIFRGSLTPALWDLHPTMGKPFLTWFAPQSLGLIPSACGRTAMAANSTSDLHTPGTQLSVADIIVITVYFALNVAVGIWAGPAGSGWQESSEHIQKRSEPDREDAGDASHREKQTEQARQVQPCKDV

SEQ ID NO: 925734 - protein, 148 aa, Homo sapiens
MAKVEQEGLSNDTEKNSHEDRRQVRGISETQKARKQFQEGESEGPTGPNGTPTLAFWFSLSRLLLHHYKIAMAPIDITNAPGWKKKESPPSASIPLLIRTICQRPLSTDFAYIPYEHPKLQRKPKNKYAVLQTLRLDHDKKEGTRNGC

SEQ ID NO: 925735 - protein, 134 aa, Homo sapiens
MDSDSSDGSGQSKVKSFWKVFTILDAIKNICDLREEVKISTLTGVWKKLIPTLLDNFEGFKTIVEEVTADVVNTRELELKVKPADVTALPQSHDQTLKDEIAAATPTFSNHLLDQSAAINIEARPSTSKMIMTY

SEQ ID NO: 925736 - protein, 159 aa, Homo sapiens
MGCFSKPGPCPSLKDHVCNVTEEKSPFGGGLNPMIYLSNNRELASMANTNWPAPAMDLDTSYSTPTSGLKSLRVLCPLASPQSVKPSTQRPLPLAFRVAWTFCDLTLLLTYSKIADVMPSLADLPDLMTCDLPMPQHDWNAQTVTKQEDKPWVIISIET

SEQ ID NO: 925737 - protein, 157 aa, Homo sapiens
MGEEEHGSFTSGLWSSGKEEDKLSRQAGAQAAEAPEVGAVVKRRQRTCKAGISAAIAFKERRSNGRSFSRRPLPPAPGVSFCQPPSSLYREIRCFCTPKRNMSDPQMTRATGYSSGRLLCSIFSRNIDWLCFPIHVGENGHLRLLLNFLFQSHFQNS

SEQ ID NO: 925738 - protein, 137 aa, Homo sapiens
MWLQHIVYCNQVSFSKSTDAFAFEEDSSSDGLSPDQTRSEDPQNSAGSPPDAKASDTPSTGSLGTNQRMQRCPWLPQHFDASSHSIQRRPLCGVTKAPENTEREPPELHPLTYPLSICSAKQIPFISIFMDKLAKTQ

SEQ ID NO: 925739 - protein, 186 aa, Homo sapiens
MFMSTWHSPCISASFSLYGGGNGETKVGLKHVNRMENTGLDHWMWMVKEREVLDLEEEELNFECMLVPFTEVKTRMRKSYLIGKIMNLIFDQLVSEGHSSQKSSLERSGAQSAFNGDIDMKGVSIQMLTEIMRIAMTYTVCGVRIKEDPEECQHLRTVGTEDSRTARVEGGEDREELLEYPDRRPE

SEQ ID NO: 925740 - protein, 165 aa, Homo sapiens
MLPALDRIPFLILPSWKSLNFFKILIQDLVHLSVHQGLSTASRTLEECLETRVCVCVSVLNESMNECLCGESQRVFQTGSQSMCPLVRSPDLGDRRNCPSFVEALQFHFILLEADHHSEKLSLTTECGQSTWMERQWEMNQSTPSRASTQDPHLKSRDTFLFQTL

SEQ ID NO: 925741 - protein, 177 aa, Homo sapiens
MPILAWPSSLKFLHKPLLNLHAIKGRYKYDCKTALSCYPDCGVALLCRSSHGAVTLPELCVTELLKPRIVAVTRLWDWWIGEHEFFSVTLRLQREESSFPLGIERAPVERESWDLIQGRRAEEDSVSPSVNGDNDELTSYFYFIVARAKGVKLAIDKWCLIPYTLRGHTKGHSTLSS

SEQ ID NO: 925742 - protein, 140 aa, Homo sapiens
MQGVLSAREVQAGPWCPQFVLRPKPILPAWLTVMVNTECQLDWIKGCEVLFLGVSVCQYGHNKSRQENVERLDWFSLLAYIFLPCWMLAALEHQTPSSSALGLGLALLLLSFQTAYCGTSPCDHGYRSSSVAKKKGQNLL

SEQ ID NO: 925743 - protein, 143 aa, Homo sapiens
MKQSFSRIAVLLFPRSPEAGNLALPLNHLKSSFLVPTPELPDQRIIGAGPENTYFPKKLSHGFLDNQSRNWHFGKAKKVFPLDRSFTLFISLKEMQCVKSPALFLADLKPSVQENCLPILCESSGHSENMNSLQLLQEQDPGI

SEQ ID NO: 925744 - protein, 175 aa, Homo sapiens
MNNKKLITFLEDRARSCEEEEEEEEEGEGEGEGEGEEGEGEGEGEEGEGEGEEEGEEEEEEEEAPGRQSKILSQKTEEEEEGEGEGGGGEGRGERGGGGEEEEEEEEEEEGGGGGGGGGGEEEEEEEEGRGERGGGGEEEEEEEEGGGGGGGGEGEEKDLTDYLATSLYFYVLKL

SEQ ID NO: 925745 - protein, 150 aa, Homo sapiens
MFLKVSDFQAQFSASALALRHSEYVDDFVKEDIFQVTLTGKGYHLERALQNDLAGFLLKLGNGQGWSLKPKVKAQLRRGLRGALLKFGFLLKLGDGQGWTVKPKVKVQLRRGLRGFLLKFGQGDSLHQNPPFTVLGKHNPPLASAGRYAL

SEQ ID NO: 925746 - protein, 174 aa, Homo sapiens
MLISSENILTERTQNNAFPRGFGLKDASKSSQAQRFNSRTLLQLLKKKCSSPWAAGLAGCKPELLVIMFSSLIESTQECGGKDDGKYCIICKITEGLVHSWVTENEVDSGYQEEKFYFLCPMRFLFQGDATLSPTLSPTVCPRVARKWKNPQTFWSSRAKLARAPIPYHSDQTT

SEQ ID NO: 925747 - protein, 140 aa, Homo sapiens
MTVMCLEELPEYVKTLAAQCLPEQLLTGAAAMGLPSFVLGIQGPGSVGTRGNLLIHRLQKSVGSVEPWAGTWMKLETIILSKLRGTENQTLHVLIRKWELNNENTWTQGGEHHMLGPVQGIPLYGYTIDYLPVGGHRSHF

SEQ ID NO: 925748 - protein, 137 aa, Homo sapiens
MIGEVEHRFWCGPSGFHMKDVLRRNWKTGVAHSAGRPAWWQQRLVRVAGGGHDVNTSRGVGKWSEKASGGVTDVDVQSQEIAMAGADWMCWNQQCSSYQAQRRCAPQFLRPETKGEQEKPAENKRFRHDWLPTYWVG

SEQ ID NO: 925749 - protein, 184 aa, Homo sapiens
MGGSAAAPACGQLRLPNSHPLGPSSSIPSAAPQSRHFLGQPEPVAQSPSSCHRNPDLPPAPLASEAAPRGAVGAAAAPMPARKGALWPRPRSCGTAGSGAEGSRGQLSPQRTGKGTLSRPGLPLYLCWGLVVRLRSSELLGVAGAAIPSSRRRAQGAARGAGTPGQRRALAQPRGCCWPSRLQG

SEQ ID NO: 925750 - protein, 150 aa, Homo sapiens
MNFEYWTGIFATSQNCADSSFQCLIKYKGRSHVYVLQAECLGGPKCYANLPDGRNLENLEESMSSLPHSLTPNTDHVNQAFDQQNNQPVAGGQLLGCAKALNLGPQLLWIKEENQKWEYKVDPGIVLRNVPQMTMDLIHSFLTAFKKRKP

SEQ ID NO: 925751 - protein, 201 aa, Homo sapiens
MTLLPREEPWVRTTSSGALGSSSQVEPAFGPWSGVQDPGPWLLSLGIAWPLWGRANNSVPENPLSSPSMCLEHGKEKGNTHSGKPVRSKPYPSLSMEGNPDAACRIPSWSQSLKNTDTTHRVYWHSAFHTREPSHLGKLPHFKTQPNQVQPMTTISPTLGGVAGDALAPPEKLRGPESEEYEETGQPQGRRGGPMKQSKSA

SEQ ID NO: 925752 - protein, 141 aa, Homo sapiens
MAVSLASSHFSLGTQPKCHFPLLQAQFGWPDPLLHHRTYHIGLYLNCPRCLLVYKLCNGESCGYNIHVECWMFYCEKAMHGTKAAIFLSWGENLRMKSEYAKDAEWKERKNYILEDTWEPVGQSQDSLSDLEEGTYPKSLP

SEQ ID NO: 925753 - protein, 226 aa, Homo sapiens
MGSQKCWFLKGPEKARRWKMSMELGNKIVGYMPFMSGLGTLLHVITYTGPQLMEQLPQGTLAVALEAEEEGTWPTDLFLLGHTYGAATAASGLGVLASDTKAPEVTQPSMGPNILQSLQVFTELVVQTVGQDLVIFSILYILLSVQKPVGDLVLAWILHNGDHTFHLILNELSRPLGEVNVCFPQYHMSISSAHTLNGSDGKGYFPPPIDVGVEYSQNMLELFRDH

SEQ ID NO: 925754 - protein, 142 aa, Homo sapiens
MAGPCAHSLTTPCCSLPGLPLAGLDILATIDGKRAKAQAPGLEAYSATPGRHLYSYARDLKSTTWLHWTRSQPIPLLGKERGEWAHCVLEAAPQASICVLPTCLQSFLSPQTTTTLLKLAHKLASCFQETAEKAWKGLPPLS

SEQ ID NO: 925755 - protein, 145 aa, Homo sapiens
MGVLSSYLFVGSFAQHYLYNQILSFAKEEIIPYSVSQILRKFMEVPNFSHIFLSSEPSKSLGSSKLSHIFLSSSELSKLFQPLPVTKVVSTFFGYPYSSTPLYQYQFTVLVHSHAAMKKYLKLDSITSNQVPPTTCGDYRNYNSR

SEQ ID NO: 925756 - protein, 161 aa, Homo sapiens
MPLRPHSLALTYQLFDAPNTGAPKFIKQLLIDLRNEIDSNTIIVEDFNTPLTALDRSSRQKVNKEAMDLNYVQEQMDLTDTYRTFHPTTAEYTFYSTMHGTFSKIDHMIGHKMSLNKFKKIEIILSTLSEHSGIKLEMNAKRNLQNHTNTWKLNNLLLNQH

SEQ ID NO: 925757 - protein, 159 aa, Homo sapiens
MGDPPTASKQLWSRGCIKMSTMALVIPSLQMIQLHADVENQHCSAEQSFPNCSTTPSSPDPYRKLTHRVAFGGLDWLNDDDRDDDDDDSLSTISSSMSLALGRVDKKDTSPPGEEARSKKNQLLTSDFLCSRSNGTIIREGFPSHSPPATVMAPLEAGR

SEQ ID NO: 925758 - protein, 146 aa, Homo sapiens
MSEGVLLREPWVSLSMHPKPLGLDYQLMGKVAKEDIAKNPQQLQPDCCSGLLSADNRSEWQNLGTTTQLGGEGSRIAVKLSLKGSDTCVCLGNTDLTVYCENVEFPASAPTPGQPAGILEQSVYLSQRITMKQLLRVQGICPPSFI

SEQ ID NO: 925759 - protein, 233 aa, Homo sapiens
MLTQQPGRKDQNLPCRALTICHSLLYNGGDGKKMSPSPLVPRRRDEGKIHKITQKYRDSAQGIPHSKSPVFHKASWCHSVYQTVLAFLHLPNGSIYPVDPFSFFLLPGRLIPMDCITWAPLTSDFPLDLTDGSHKQETGEWTSPRSEEDPKDGTGGEEMGNHSRQWGHKNKACGRKKRGASQDLAGDRSSTRRMPEKKLSKADTESKLTWEKSILASVQKMDSSRKKVETVEP

SEQ ID NO: 925760 - protein, 147 aa, Homo sapiens
MGMQRHKNDTMDFGYLRARVGGGAILNPALEDCLKEFHRVNVVQRGQPEIQGLRVSPRGTAKRDVQGLKLARPHSSSISAEPQMPSLEQEPAFVLLRTRAKPSCDNISQARNHSTSLFLSSCVPALEGTNAKVSRMLVEINQKERKS

SEQ ID NO: 925761 - protein, 194 aa, Homo sapiens
MKRLDRWMEDHEVTQPGARRKRIGCFSVASLLKSARPRTHWKEETPDTSEHLKEQTPDTPSLRAVTLTTRVRGFILEVIETKNPPEGINSGHKSAGRTAIYKTIRSPSGKFQKENDSYLKSKGIQPHWDKGQKATNSAVSQQVASTNSSAMYVKPCWKWILLPLLRPPQLMPHGMQVNCVYIFKGFCSKETQIR

SEQ ID NO: 925762 - protein, 186 aa, Homo sapiens
MICVHFYFVKEKAKQTRKKLASAKGFLRSADRQAARLLDLRTALFHQCQTRFTADLPRMWILLQDTQSETARSSRKRESPFPLIQCDEKGASRLWLRSQKSITRIELGEKYNRQTQTGGHEGLQLHSRSQQDQNPSEGRNSGYVGTSEGTNSGHTIFKNCSTHCQAFPQLPKEPSTIITFSFRDLE

SEQ ID NO: 925763 - protein, 147 aa, Homo sapiens
MPKTTNIYYLTVLEIRGLKWVHWAKIKVSSSTWANNIIWGLAIRTPPSTQLWKFFQSKVHSLASLPGGTLQDVLIPSSAYPGTPNKMLGSHKMQADASSKGEGSRKEMDTKCATSECPQLPANPNLFPNHHCTPESQTGYTHFWPNY

SEQ ID NO: 925764 - protein, 165 aa, Homo sapiens
MSPRTCVDRTEKDDNSLPWEEARMALCQLSYPMNEFPSVAKSVLTETINLTVNKVQEFKLEEVVPPNPPHDPTCPLLLFIAADVIKVPLNIGFRPSTSRSPKAVGRRCRYSSLVENNCSRRFQQLALCGIDFVTSSSDSQLQVKEGMVQYFSSNREGLRLKWSSG

SEQ ID NO: 925765 - protein, 138 aa, Homo sapiens
MVGCTLYSKMASRSFDNNYTTHSSSKKETPSLSSANKWGMNGNESPELSRKWGRKEMHCYSPSFFLGKLSGAGSTEGLAKRVCNGEWASTTGLDFHQETWLLQSDLSELPTSFILYFHSWKFVYWDPTPSSQTQPHRP

SEQ ID NO: 925766 - protein, 181 aa, Homo sapiens
MVQERGPDPDIKRGFLDLMQERIQDESIDSWTAPTQVKPVVYMLPAAELNLDKQRHSLMKGRWRMRIKPAKREATCPPFSTLKIQGSLMGTLAPWPTLHSLPCSSKSTKRQNPPEGRRKRRETFGLMGGRCLVGGRRLDERVFRAEGKATRGDDTRSAGFSSYSHTFCRSTPTQYCFFRKH

SEQ ID NO: 925767 - protein, 160 aa, Homo sapiens
MLWCEEVEPLGELRRKGPGFIISLSRCGAQGVEEGRRYKSRQQLNTRKWIQILCYNYVDIRENKDDAILQSDYCGKLEVLQEAKTKTRSNVQGLLRKMPAGRKYLWEGIAVQTIAGFGQGAELQGVTRKVTHIPTASKSLFLFKTHLSLIRMLLLGSESS

SEQ ID NO: 925768 - protein, 158 aa, Homo sapiens
MIHRVVREGFHERMMFQFRSEGRLQPVSSYYQLYPHVLIVNHASEQMQTGGSRAVTQKAPTQGFAVPEQPADDTMPPSPILKAIKAPARKMVSTLDLHCALLEIGESYTSCLLQVLALNSELHSQQPSGNEAGELNSSGEDALKRVSLRPGILQCRSQ

SEQ ID NO: 925769 - protein, 146 aa, Homo sapiens
MAHGTLSSLKMSSTFCPRERAVKCKGIDSALLQRMSEDHMKDVVIKDGILDTDMQVERRACDDEDRDWGDASTSQETPKIASKPPEVRDEDGEPHEGSILMGRIGAIIKGRISAFIYGGAEDDEVKEDSVHQIELLRGANDNFRGA

SEQ ID NO: 925770 - protein, 150 aa, Homo sapiens
MLLAAGPPLYLLLLLLLLLLLLLLLLLLLLLVLTNLSTFLVFMLSPFVSYLKNLCLPQGHEDVFLEKFYLSHFEYKSEEASLHLLVIFFPGLSESTAGLRGNKSIMVGARSQNQTSGSSSYQLFNVRQLFKLAVPQFPRGNNPAFFIVFW

SEQ ID NO: 925771 - protein, 332 aa, Homo sapiens
MVPGQLTPVSRDEEAATAAVECSYNLLPSLHQTLPIGLTHQTVLKMSFGGASRKDEAWRTYRSQRKVMEVIEVVVMVVEVEVLMEMKVVVEMEVMVEMVVVVEVEVMVVVEMKVMVEMEVVVVEIEVMVEMKVVVEMKVMVEMVMVVVEVEVMVEMVMVVVEAEVMVEMEAVVVVEVEVMVVVEMKVMVEMVMVVVEVEVMVEMEAVVVEVEVMVEMEAVVVVEVEVMVVVEMKVMVEMVMVVVEVEVMVEMEAVVVVEIEAMVEIVVEVLEAVKLKAGGHAGCGCEGRADRGRSGCSGDEGGDDEESRDCGGGYSVGSGHFPASFLELHLE

SEQ ID NO: 925772 - protein, 129 aa, Homo sapiens
MESGFSRGCPGTHPHSPVMLTRCFGLVVEGVLVSPPDFCFHSERENGMAERAVGQESESVCSSPALWPRYDRLPLVLWVLLVISAISHGDEVVRNVDLIIMANLTLNSFENNRFIALESGGLMSSNSVP

SEQ ID NO: 925773 - protein, 168 aa, Homo sapiens
MVLGGLRPTRTDGSFHFHGGKCSPGKVHREGGQICVQWLSSKGAVKKITVGYIQGGNGDIITRFRFKIGFQSTTFVLSYSHVGLKKLQVTTCTRQQLNLMESVSPRQHSNPQTGINDGIGARKEGVTTGGFILPLLERLQVTLYQQTIKMKLPIHHLESAGPNTLKLI

SEQ ID NO: 925774 - protein, 143 aa, Homo sapiens
MCQWTITNVPRVIDVGTRSLGWGPRALAWCQDPLALSFYTGRCKNVFIIQGLGSPSLIPMGFFWVHSPCHTLYSSHPGPLTLLQTYRAFLPLHVVSGAHVVLPSGNALSPFPVHKSKPSGPWVLGCRRPSDVTDWPVLWGCDL

SEQ ID NO: 925775 - protein, 142 aa, Homo sapiens
MQLIKPYLQPTQSETLGDSDSEEMERNSENFMEKVPLPGKFHEVKDVTIKHIYRHCRMSPGGAGGWNCPQVENFCPRQCLSWPLPPILAIQSLFLVTQQQNQCHCPPFQSSVLQRWGVLLPMSLHPHHAYHPPFLIITFIIM

SEQ ID NO: 925776 - protein, 174 aa, Homo sapiens
MILRSPSSNFTTTIIMTVIITIIIIIITVIIITIITFITIKITTITITTITIIIITITIFSRSPSSPSSSSPPPSQDHHHHHHHHHHHLLKITITIIIITTTITIIITTTFSRSPPSPSSPPPPPSQDHHHHHHHHHHHHHHHHHLLKITITIIIITTTITIITITIIIAESVH

SEQ ID NO: 925777 - protein, 146 aa, Homo sapiens
MTWWPIGASLFASSEGSGLFIGLAGSGAAGGLAVAGFEWNVSPGGLAACGRARAQDVVAALEGDSSQWLVSADVQATYVLLALAWVFVPIYISSEIVTLPEYIQKRYGGQRIRMYLSVLSLLLSVFTKISSLGAASFIQPQASEGA

SEQ ID NO: 925778 - protein, 167 aa, Homo sapiens
MRVYETIHIKKRGKNNFRSAASRKITITPTGLREIHSWSNQSTTPNPVGETLTRFKTNLKRIELICKAYKKENKVDMHPKKYVIPVLGNAWHTMNTLWVLAISVVTVDRIPSFEGSRRDIFAAPKRWRHLLKITVLAGPLCQQLPQENKAAEFTSCWASCALVSPPS

SEQ ID NO: 925779 - protein, 191 aa, Homo sapiens
MQENVKGKSQKKHLLQVLESVSRVEREDRGSKREAREDFETQPLLPVLRPLILDSFTTEQVKNDSKEQRSRYIDTANALEQETKLGLRRFEVCDNIDLETILMEYESYYFVKFQKYPKIVKKSSDTGDLLSVLKITTKMSIGEANSSCIDNEKLLKAINPDNDQYNIKTQYRLAVNKAGWRKDLKWGPCAL

SEQ ID NO: 925780 - protein, 169 aa, Homo sapiens
MKNKKEAIKKNILGSSSLNLFTMWVGGVESNTSETEEESTQKTHGTRNEHNRTSENRAYCKSGKASWMWQNFSCAPDKKEDLDEGRRSGLEEHGVQRWRERGESGLPALSVLVERNGNSLSAHWSYKTDLAKVSNPLQQLKRPEVICIHWSTYRLPICGFQAWEKLGYF

SEQ ID NO: 925781 - protein, 151 aa, Homo sapiens
MKPSSHCLGLGAAGAGVAEYGRENSEGSFLICKVGLELVAPVRTQRDDAYEVPSTGQHVDVVAVHVCPAWVTTKFSKAPGEQTDHWLQAAGDLLLALALELTVCVILNALHFLLCLGIFIFQMREVDEFTLANFNSHVGGWLFEDSMELNF

SEQ ID NO: 925782 - protein, 182 aa, Homo sapiens
MPVAEFWIAKWCGGWRRRAATGASRVQKARPISLQAFSEGWNEAINTKMFMEIYVTVPNVINHILTRKVHDPGLALVHLYIGNGGVDSCKVAGDIKSAGHREDDGQNLRGLEFWLQLSHVLTFPLFTHLSNGNKIPGKFQVHTQRYRHLKKDFLSGPDPLTPTASPHGHLQPGLTMKESISY

SEQ ID NO: 925783 - protein, 171 aa, Homo sapiens
MEFSLKDAIYAVVNAWNTVTKDTVVDAWHNLWPATVFSADGEQGGDSEEFCMSSEEKKCFIFLLLNQGYYDNSDDDDGINAAEKVPVDDMVICDRCIEGLKQNVFGTEQGIMSDYKIKERLLRQNTLSMKQMTAGNISKSHAAERFLIPRGSTSQSLNCFPCFFSLKSINN

SEQ ID NO: 925784 - protein, 141 aa, Homo sapiens
MVRFLWVDSKATRLLLLPFAQEAVPPCGKGLGDGASAATSVSEGGVEGLRSGLSSLPLRNFIAGSPGLPRPPQDCTGLPWAGGAALTFHTSPPSCAQAAFWTRDVQASPVPAVSHDNQLTIVLMPKRHVWRCHILVSYNIQ

SEQ ID NO: 925785 - protein, 148 aa, Homo sapiens
MCSYLGKETLIANSQVGKGDGKGHEHSQTFVAFWILNKLLPGDHLPMGQPDPTCLTGPAERYTLQGLCDPWCHCTKTQQGSGAGQVGSGGKPAVTGLSQLPHKLKGRVSLPPHPTRQPKVCFQEEVDKYLALNPNTVPGTKKTSSMEL

SEQ ID NO: 925786 - protein, 146 aa, Homo sapiens
MTLYCSCLGFCSLKLVLWRILRTASLLLMSYSMGLTGSKDSVDCYGCWRRNGAYNWNALETEEYLSSRCVRGEKSQSPRSDSEAEMRRWTLEGCRRNIETQGEAASADGEAAANYPEDLAKSIDEGRYTEQGHVKDLVFITGQYVM

SEQ ID NO: 925787 - protein, 188 aa, Homo sapiens
MRQAPAVWPAVAVWPGPGGVAWPRRCGRPRRCGLALAIRTPTLLFASWVTARATSNPQRRRAQRLETSGPRTLRTQERKALVVAIGGTDLWAPGTQCGPQGLAVTELESDETMESTIPGRGQDREGHASTCKPRNTGPARHWTLPMTRRSEEWAPAHAAPPTPHMQNALPRLGALLKASGAVRPAQNF

SEQ ID NO: 925788 - protein, 138 aa, Homo sapiens
MLIQKDFNKHLPHSGLHPARVHGKSSCCFSGGILMYGALVLFESEFVHVVAISFTALILTELLMVALTVRTWHWLMVVAEFLSLGCYVSSLAFLNEYFDVAFITTVTFLWKVSAITVCGNVTPARQAQGTDAAMASSS

SEQ ID NO: 925789 - protein, 151 aa, Homo sapiens
MIQPLRKTVWAFLTKRKRLLNQRAHRYLHLHRVYAEKVPPQPESTHIFTSTVWDTCLLNKSSPVVSSVEDIRQVEIKGIPKRHVRSFEEQPEQRGVLCGALGRKSTFEKNQDLHTISLPRCVSVSPWSVALGGLEGAMAPGELDGAVAPDH

SEQ ID NO: 925790 - protein, 204 aa, Homo sapiens
MAPSSPPRATLHGDTDTHPHSVVLRFMGRCLHSSSLSSMLVPDHGRVSSLQFCTSQVSGKKNQYQLSSLASAAQQNAQCMIHHVMLSLSTEMSFHHTQAVPVHGDVLPSTHKLSPSTEMSFHHTRAVPVHGVVLHPRMDCPCPRRCPSITHGLSPSTEMSFHHAGAVPVHGDVLPSTHGLSLSTETSFCPLAEGHKVVSSFWQL

SEQ ID NO: 925791 - protein, 176 aa, Homo sapiens
MNPFPISNLVISRMLCKWNAMQMELYSRAFCFQLNLAEGAGRNPSTSPPTVLEVELGRKLTPGYSLWVVSALCEWVSSGQRCQDSPTLPSVSSAFSVLQASVSHYGHNAALPPPGGWPLVFSQSVEITAEAVRVLLLVCVEAPSLWRSQLKRSATLLPACQNATWPFGLASVVAEP

SEQ ID NO: 925792 - protein, 191 aa, Homo sapiens
MVSVLSMDSVLSVVSVLSVGSVLSLVSVLSVVSVLSVVSVLSLVSVLSVVSVLSVVSVLSVVSVLSLVSVLSVVSVLSVVSVLSVVSVLSVDSVLSVVSVLSVVALVQWTESVGLTLVSRDLTSMQLKTPSGQVLSFCILQLFPFTSESKRMGVIVRDESTAEITFYMKGADVAMSPIVQYNDWLEEEVCE

SEQ ID NO: 925793 - protein, 213 aa, Homo sapiens
MLISSASAWPASTPRQGAAAVLHQEAKWLLCPALSVILQGSFESSSLSACVFDYLRVNLDMGKAVYGWMMMKDENIPGTVVRTSTIPEELGRLVYLLTDKTGMNGKGTQTVRSFIVARLDATLIEWCGSFTRTRWWCSSFTRDCTSTIRAAVLSFTFNTVFKKSHGIFFVLADFAQLSGIATASPNFSHHHPDQSAAVNIKTRPSTSKKIKSC

SEQ ID NO: 925794 - protein, 162 aa, Homo sapiens
MDTQGPVSQPFQQPEKPGRVRRRKTRREPRGHNPGRLSREHRGLFNHEVKSLDVARLLSSGTLVPGSPTLPAKPSPSPGRAQEPAPRSRDKENQVPGGSGPGPPSSPELSGVGQLLAELQCQLSLPQAFPRRNLIKDARDAIVHTLQACNGCVPDLALVLKG

SEQ ID NO: 925795 - protein, 140 aa, Homo sapiens
MCKRSNEETRSAVQRYCSSNPVNVWEGSGRWALHRPWLAPGDFQQSQLNSHRQAQDWSQDQQDKATPVACLQGEGATGPPFAPESDMRGGCKRSRFWMMLPPLPGLCLHTVHVFHLPHQRSPRGPLRDTHLANRCGPGSC

SEQ ID NO: 925796 - protein, 179 aa, Homo sapiens
MKRNEALEPWAGLLTAVEDRNDVFLWGTGQASSVPVIKGSGALSPGSSHALQQFAGPAWSSSHTPWELLQGAGVLAPAGGVSDNTKKPGQQPGLAWRVPPGAAVLSLVVPVNAYNSSPSNRGQLSLLFLSPEGLAPQWSVHSHQIAARLWIRLSFPLSNCSSMCSGGSSNVECFNYADI

SEQ ID NO: 925797 - protein, 393 aa, Homo sapiens
MGLGRYTYLVLRGEHLESSSHYLVPSGHYLVSSGHYLVSSRHYLVLSAHYLVSSGHYVVPRGHYLVPRGHYLVSSSHYLVSRGHYLVPSGHYLVSSSHYVVPRGHYLVSSGHYLIPGGHYLVSSGHYLVPRVVITWYPVVITWSLEVITWHPAVINWCPVVPSGHYLVSSGHYLVSSGHYLVPSGHYLASSSHYLAPSSHNLVPSGTQRSLPGVQHHYLLPSGHYLVPSGHYLVPSGHYLEPRGHYLTPSSHNLVPSGTQRSLPGTQWSLPGVQQSSLSVQRSLPGAQPSSLGVQKSLPDVQRSLPGVQWSLRGALQSSLSVQWSLPGALKSSLSVQRSLPGTQWSSPCTHGQFLVPGCHLLVPSGHQWPSGFTAMETFAWEYSSAWSFVSIY

SEQ ID NO: 925798 - protein, 320 aa, Homo sapiens
MDVQICFFLSYVPVRVHACVHMDVNIHTNLPHTPHVQEREGRRLRCHQSPTLLSRSWVFRCDPQPLHLRSPVPTLTLCTQGHLCQPSASAPEDTCANQKKKTQKKTSAPEDTCADPQPLHPRAPAPTLSLCTRGHLCRPSASAPEGTCADPQPLHPRAPVPTLSLCTRGHLCRPSASAPRASVPTLSLCTRGHLCRPSASAPEGTCADPQPLHPRAPVPTLSLCTEGIYADPQPLHPRAPVPTLSLCTEGIYADPQPLHPRTPAPTLSLCTRGHLCRPSASAPEGTCADPQPLHPRAPVPTLSLCTREHLCLLPLTKCVY

SEQ ID NO: 925799 - protein, 134 aa, Homo sapiens
MNDFQHIISRGTICLHASVFLKNGAWILKEVFAERDDSDHYAVQKQRTNDNLLLPIPVLKPGTAPYVLVEPDGSSSLVEWEWSYMCHFWAKAVKKLLAIPLSVSECRECQSQEGRGRVYSTDADRNSHDGLLGE

SEQ ID NO: 925800 - protein, 147 aa, Homo sapiens
MKFQLGICKLLVASISSVLPFTSSCTAESFEVFLTWSYFRKHFGSLMVLRAICFQLIDALFSLMSPDTSDGFQLLPSEEPPCPQSCLSSLFTVASLCVAEGSSLHLPVFAVCSHFRVYAPQTIPLFSLKLGYGWMEPNALIRHPVFN

SEQ ID NO: 925801 - protein, 164 aa, Homo sapiens
MTARLGWMSPLLTWSALTPPGQWGECLPTAGACGSPGFTHSLLFNVGIISLFVLVFPYLRGFICLWSLMLVTFRWSFCVDVLFVDVDAVPLFVSFTSNSQARLLQVCWSLLEIHSRSCLPGFHQRRLQNSKDCCLFLPLEASSQRGTCQMPAGALRYEVSVDPC

SEQ ID NO: 925802 - protein, 144 aa, Homo sapiens
MSQSLPGDCDPPPRHPGLPGDVTLHPGIVAPEAFLIAPISQSLPGDCQFPPRHPGSRSSLPLRHVSEPSRGCHSLCSFQCSLYGMKHPQSASAAFHNERRRKRLVHALIIVDSTICKGSCRKYCMLRFSWMVLYAEVLVDGTLC

SEQ ID NO: 925803 - protein, 141 aa, Homo sapiens [sequence omitted]

SEQ ID NO: 925804 - protein, 155 aa, Homo sapiens
MKLTLLVRVTLVEGSRVPGDSGIVNSRSHVPRWAHQITVELETPHCLVMLGPPHVAQRVTHMCVEMLVYTSRLHCRVYKVYSHVHTLTHNSPKAAPSPAGRVHGMFRCIILTIVLQLPAVLSSGSACLQPWAMGHACSLGVYRLHCPGLGKDTLC

SEQ ID NO: 925805 - protein, 476 aa, Homo sapiens
MRTSWLYVDKILFYMDTALISTGPALIYVGPALISTGPALISMGPALISMDTALIYVGPALISMGPALISMGPALISMGPALIYVGPALISTGPALISTDTALISTGPALISTGPALISMGPALIYVGPALISTVTLCDTQAVNMLMKSCDRGLPQTAGGHAMHPPPQYVLDMGWEVENCGAREVQTRGVGHGLGRWRPTVSVIGSGGADPRCRSWAREVETRSVGHGLWRCRPSVSVMGPGGGDPGYRSWAWEVETHGVSHRLGRWRPTVSVMGSGGADPRCQSWAREVETHGVSHGLWRCRPAVSVMGSGGGDLRCRSWAREVQTRGVGHGLGRQRPTWCWSWAQEVETRGVGHGLGKWRPMVSVMGIALPGCPGQWSWRSRLGPDRPTRSRVLTKATVVKCTSTRGPARAGRKSRHSPPCSVLQEVLSESSKTSKKSGAGSIQRTEEKEKSSPAAQAELAKAAPNPAPRRHPV

SEQ ID NO: 925806 - protein, 144 aa, Homo sapiens
MLLEDPRPAPELPSWVQMPPRPQLPTCSKHLHTGPPHTLWPCSPILRVVHTGAPTHPLALQSYPQGCAHKCPVRTLWPCNPVLSVVHTGAPARNLWPCSPVLRVVHTGAPARALWPCSPVLRVVHTGAPTHPLALQSCPQCCAF

SEQ ID NO: 925807 - protein, 136 aa, Homo sapiens
MAGASGMSSGACPIHERGAACSDQDAGGRDWEVQVPRAWTSMAPGHRQHDAERAAVYKVTTTSWPKCTPVPGPTLGPWGQLGAGAQVCIILVSTRGKLYPLCRNHWAATGPWAQSASGMVDTGTRRLQLKLFLLIS

SEQ ID NO: 925808 - protein, 232 aa, Homo sapiens
MHILPAAKGLGLGSALVLLALGEATPASAGCHHKVQKTQSPELHEHSPLRGSCSFRPKPSKAEGYEENSKGIRDGAHGRDRCLHGTQAILPRYQQRAPSDYSGSDPVTVHRTLFGVTDSRIMTMSGCPTCLPDTVFPSTLGSGNPLQQRRSGAGFWTQGILDDRETSKLKVAQLLDVMTYMGNVAGLTSDGLMNGLTSDGLMNSFMSDGLMNGLTSDGIMNNLMSDGLTSNI

SEQ ID NO: 925809 - protein, 142 aa, Homo sapiens
MQRRGQPIKRNKVSLLGNQNLSRKGDRGDIREDCNPTVLDQWGTGGGTCVLGDKLPAVAAAVLEAGSPRSRCQQAGFFGGLSVGESRLPTMAAHGVSPVYVRSSHEDTSQTGKLGFQARFRNLGFQNFDSNASGHVLCSDPV

SEQ ID NO: 925810 - protein, 131 aa, Homo sapiens
MTFEKGQIPRSKLPLRSWVKARGFIKSLPVELSHKWSQMDSSFTPCPGLRRQEPACTSGRHEGELESKLGSYHLRASDCDMQVTCGSSGDPVSQVHNYLAVGPEDEAGEAAGRCSCCYGNKGPIYLLFIDF

SEQ ID NO: 925811 - protein, 147 aa, Homo sapiens
MCAKAACTHEAGRPRGCSWRLLVGSQEQAGQLAVWDPWAMGPSPSKERGAVASRLLTRSILKKEGISFPLVLVVHNLLFKAQPKVPCLQVVPLASPALGPASNACSGPFEVQVVIIFCSLVLNLLIQTVYGSRAETKSQSGGYLISN

SEQ ID NO: 925812 - protein, 146 aa, Homo sapiens
MNFFPICGFWVIWEEDAKMKLGTESFPDGGPCEQGRAPAHDGTLFRLSSRLLVWGKVEFAHMQALEGLRTAVAARQERKRGNVETRVSGRPAFAGPVFFPSVKIRLYMRLLPSPENCKFRVLCFWPLRRARKGLLQPKTMKRHGEF

SEQ ID NO: 925813 - protein, 136 aa, Homo sapiens
MLESVLDSSFRIFTSRVTWCKTQWVPTWERGLLSGGPRCPCPLAVMANRRRKRRFKAIESMPGGFSKQGSYLGGCELRILAKTETSEDLTETHNRDDSAKGMVLNHKKPPHGPVTSQQAPPPALGVTAEHGIVESW

SEQ ID NO: 925814 - protein, 119 aa, Homo sapiens
MKLIQMRSCFLRMSKESSFLKWNPLLEKMLRTSWKWQQRIQNVENRLHLEANGGRHEGSGNEDQVHGRSGCLSATSNCWTPRRILHPATDDRVGRLVWLEPLGGCRPCVCSGRIHSNIN

SEQ ID NO: 925815 - protein, 141 aa, Homo sapiens
MTGEKAPCLFSTSSPVDGGHGVSPLLVMIMELAHWLVSPSSPVHVDEGVSPVISTFSPVGDDVGAPVIQVDPILFSWSSEFGDDKGPEMKTCTLCYLDLHFQCPLHGEKREYKPSVEKEDPLKQEFPRQCIEEVQGGKDGE

SEQ ID NO: 925816 - protein, 245 aa, Homo sapiens
MVKTEAASGPPAPAPLSLPLISLSKAGPLKSRKSTQILILLGAMLFLASFTATALITLAYKLPVVAPSETRTSRGGLLNARLFTLCPLVHGKSGYETFGLDGKADCLLASKLLNLSTCTGVCANVTFSEQPLPIFQNKMARTVPGIEEAIVLYFVEYYTKPYCRFGPVLVGLFLSIYMHQNHQENILRTKEVFPYPSRPGCVLLFGSSVHCIFLGPGFVGTLPRCSREEALVLGKPCVAHGRKKR

SEQ ID NO: 925817 - protein, 142 aa, Homo sapiens
MLLGGGLHAYGGLFMVFRVFDFLDGTIQWARYRNNVKDYLSNEEEAFGTSLNSQRSQMTLGTLRIKSNGLQALHWHFNASEHDCLAQQQDVKKSIYSSRPGILLLLLSVFVEALEGTLRVRSESYNKSEKGIVIFHKLYFKD

SEQ ID NO: 925818 - protein, 163 aa, Homo sapiens
MAEAGESKPREAECLKKGVEFLILSKWTQSSLDQWKVPAISSEATTAFANASSGPEAYTSPWIPMTAWGKGVLGTQDKEWEGTEEMWKRLQRCGRAPVNPTADLDRSQSMNMGLAVAAMGEGRLPTVHVQVCCCPAAGEGGVVASNLCFCPGAAASSRSDDYE

SEQ ID NO: 925819 - protein, 244 aa, Homo sapiens
MNSCTKDENSVLRDELLFLGGPASSAYALSPFSASGGWGRAGHLHPKGRELDAAAQPEGQLLREVRVLGVPFIPRARVDAWLVHTVAVGSADEAHGLLGAAAASSTGGAGASVDGGSQAVQGGGGDPRAARSGPLDAGEEEKAPAEPTAQVADAGGCASEENEVLREKHEAVDHSSQREENEERVSALKENSLQQNNDDENKIAEKPDWEAEKTSESRNERHLNGADTSFFLSGRLIPVAFITA

SEQ ID NO: 925820 - protein, 150 aa, Homo sapiens
MLVRTLPIIDNLKRKFWKSFYRFLPRNPVVSLVGQCSYYFFLVENKTISLVSRNHGMHTGVTVKVGHKPRKLVMESKSGSLSYVFSCGLRTSIQPFHKYARTPSGVAAFAPGLGDSAENAPGKFPTLEVLTLGLILLGPHCSSIFSFIRS

SEQ ID NO: 925821 - protein, 144 aa, Homo sapiens
MVVHPTGGVWEVQSRTTLSSQAGAQHPEPSQAACFRCFSDFHILSPTPELPWNDTKLYEGFTVSLNGAGTVGAGKSVPWDRGPGQDAKISQAPEWLDFPRTLRPTELRPSDLRWGPVRKQARLTKTCSCKAQLFTPSNKARFQE

SEQ ID NO: 925822 - protein, 165 aa, Homo sapiens
MQIIDLRNHFANDTVQQVKESAGMDWESERHPRLKATQGSKYSQTQSVHSVSSVNHQDSVLGIMLSGGLRGEILNKPFMSPCPSFSIQFQLHAFPYFQLPFLPRATCAGNHQFPCSTGHLKTMVVIENESHQKGPSLVKMRKGNQPFPKNSVNEPRFSRNRSALQ

SEQ ID NO: 925823 - protein, 164 aa, Homo sapiens
MTVDTETFLHVDPHQDLLQGLLEAVVFQIRHQHGIVTWQRPPPPANRRQLLQNQRQTSNAENVNFIQFNTFICVAKKEIPRSKNVKIIFGDRAIQWNGSSRGKGKPENSRAGFPSPEEGAPELRYDPAVPLLDIYPKEFKAETQTDIYAPMFTAALFTIAKRWK

SEQ ID NO: 925824 - protein, 166 aa, Homo sapiens
MVGRTRGPQRYPHPNPRNLEWFCTGWSHDELGFGVPAASCIPVGRPSLHRHRETFVPGVHFPNSIDFSPPGSAAWSPVTLGPLISQSSSLVQSGAVKMHTFLFAVHGCLAEAALGLEPRSLSSKPTFSPTTTPWQAAGGQRLLSFQQSLLPTTGCSWKNLEQSCAS

SEQ ID NO: 925825 - protein, 180 aa, Homo sapiens
MTFCSQKEQRRTPEGSWNKHCMLTCCPQFYGDSDSSWGDPGKPPKIASQPPTQGGILPGREEQRWMAFQLGESNQGVMWAGAGTLGSDGARMEAGLNERGISPQVTELQFYLICNKRLTESFQEMIRFAVYLHHSLLAYSMLALRAKDNNQRDLLRNYHYNQDRTYQKPMLGQWKEGKKV

SEQ ID NO: 925826 - protein, 157 aa, Homo sapiens
MLSGDLLNGFAQNADSNMDNKVQAEVVLDGDGELVGNWSKGDSCYVLAKRLAAFCPCPRDFWNFQLERDDLGYLAEEISKQRSIQEVTWVLLKAFGFIREAEHKSLENLQSGNVIEKKIPFSEEKSKLAAEICISNVEPNVHTPTQYLPGTLNGVWK

SEQ ID NO: 925827 - protein, 195 aa, Homo sapiens
MISRKHLSKPMGHPQSRLSFPFFCDCVHSTAYLTFLLPFLPTANCPGNPSHSLFGTQLTHHPSSVCLLATLPQNLLLPRELRNLLDMELGTAKSPPPAQMEEKPGAPIKEYRYPVCKVCSALTGVVECGSLLLACDPERFPPLVSCTFFSSHPPAGPAELPLSLQPARSPALAATTGAGGPGLLSPWKTLRQPRL

SEQ ID NO: 925828 - protein, 135 aa, Homo sapiens
MVCPNKAQLRNPRAVCDIDQGPFLETSLWPGPEIGWQEKPPDLLGMGSLSESSKLAQQTPQPEELGPFAPSWCSQPLITRSPGRPAEMQMPSPPPGHHPELTLPPQTLLRPGCPGEGRPGPARPGSLCGPRHLQF

SEQ ID NO: 925829 - protein, 143 aa, Homo sapiens
MGRTNSSILLNTKSLFLAYTFPLTPSGSIDSNSWRAQNGRSTDSLHRVPGKATDTQHQPMKAASRGRCILQSHSGRAAQDYGNLPLESVSPGSLKGISHSRCPFNLRSFIVPLPPIGEFIFNISSSFFSPSCILLSLSWIPII

SEQ ID NO: 925830 - protein, 136 aa, Homo sapiens
MRVVLKSSQRVLLVHELFCAFTIVIYAQSYKGSPVRVFRGRRSDPSFPLSQFGHSQYLGRLLGPTGGIHFLQRDGEHPDHQRNQKEGILIMEQKAEMKGKTLNTRKSYKQKISGIAKNTDCALALHITLVHSEFCY

SEQ ID NO: 925831 - protein, 149 aa, Homo sapiens
MLLPGRPSTGTRYMPFAFHCECEALPATWNCESIKPLFLINYPVSEEDRKMWESLKLPRDLLNGFNQNADNDMDNEIQTQVVSDGNEELVRNWSKGDTCYILAKRLLDVTEKKDTFSEEKFNPAAEICMSNEDPNVNCQDNREEVSRAS

SEQ ID NO: 925832 - protein, 141 aa, Homo sapiens
MLKVSSHPPVYFSLSVAQDEEDKKGVTVLAGVTDPDYQDENSLLLYNRCKDEYVQNTADPLVHLLVLPCPVIKVSGKLQQPNPHMTTNGPDPSGMKLWVTQPDGLSRDFTQDIPRSIMGLFPRQTICKMRSKEKEVYLLND

SEQ ID NO: 925833 - protein, 186 aa, Homo sapiens
MLVLLQALGITKVGTGTCPARGTRRCLGGATYHMDSEPGDDLEDKEASRGGWIQKVNIKRLDFHVSGRDSLLTEVTTSKGSKDAYHAQRQMKHTAWSLNPEVLLKKCISVSVIVWKFKVPLWLKNPHCPDMWSLLTAPESTDPRLPPGMKGADVSPSQQARFSVSVSRCSKLVHPKCLLQARSCSS

SEQ ID NO: 925834 - protein, 209 aa, Homo sapiens
MSSHHTGPHDVPETSWFSGPLLAQATLPPGCTFQIPKATISSRACLKAHLLHDSALWTQAGIGFLSETLRVATGKRVEVGTSQQGEQLLLPGVILEAFQLIPLLCQGGLQIQVGAIVRELQSTVIQLQEKEPVIPNLLLRWRLHMEKSHHVALLYAEEPEETLKPRKKQSPKCKELGFLSHCMEESTLLPRSTDPSWTVTASRNEPLLC

SEQ ID NO: 925835 - protein, 180 aa, Homo sapiens
MQVVWDLIQLPLAQNPMLFLLVLSLPRLPAIDFPALHKPSREGLSSVHSRNMCMERGGESTKGMVLAYRHEAPTTQGRPGGPGSSAAPHVPISHAARHQQPSPLHFSQEEEEEEEEEEEEEEEGEGEKRREEENKEEGGGGGGGSVKHISMSMSVILKQMSSTVEAFAESEKHFFIINGY

SEQ ID NO: 925836 - protein, 143 aa, Homo sapiens
MDPNQEEIFELPDYSGIKLEIHCKGNPQNYANTRKLNNLLLNDLWVKNEIKMEILKFFELNNNSDTTYQNLQDTAKVVLRRKLITLNAYIKKSERAQIDDLRSHLKALEKQEQTKPKPSRRKEVTKIRAEQNTVERNKQLKIN

SEQ ID NO: 925837 - protein, 135 aa, Homo sapiens
MVAPENLETSVTTEPQRVLQLLPGESQVLPPRNVTALSHSCCPQLDEWGLVTACSVLLLAAWQVPGSCPVTKRNKNGGVHADWSIGGLEKAPFDRLKCIKKVLTPVTDSIHSWQLGFQASGCLWLEGWVSPGTCP

SEQ ID NO: 925838 - protein, 151 aa, Homo sapiens
MSRHRTMPAKLMKIITTLTLKHLYLPLTPQAPVDLLGQMAQVAQQLAQPPGPVAEPSPVQDCTQNWQPFRSLDKWARVTHPNKPYPKAFGNGFVHFIGESTEGSIYIYSSIEEIFSYLQLVSHNSQGVGRWLIDPRFGICRRKRKCLRLWQ

SEQ ID NO: 925839 - protein, 170 aa, Homo sapiens
MGGPAALEAVGDWVGMALPGSWYNEWVGGRLGPSTKLMQLSQKARRMQALQARGSPGHRPTGRAEYPGQSLEDPPLGLAWRAARENSVRKHSLPLPNRRPAGLSAGLITGQLLPIQPLWQVAGAGGAPVLESQLGIGSRGQSLNLLRILSLWSLLGIFLFAAGVPRARLE

SEQ ID NO: 925840 - protein, 156 aa, Homo sapiens
MRATCIPDYQGESSDLSGTSSGQGFPGRPSGLIIARKTGGTHRKPSEPQRFSLPSAKRRQVLDRAGTQGHAGKDEGRDHDDASMSQGRPGCQQPPEAGREAWNSFSLLPSEGTSPADTLSSTAFSEVSVGSQEQSIEKVQFGWCGLSYNKAHVVEI

SEQ ID NO: 925841 - protein, 115 aa, Homo sapiens
MPLSQLGLMQIVPSAQSGTGMPRTTTRSRASWEAFREGSVPGTILEAESSSHQTLNCSPLALDFPASRMGLLFREVAPKKLLVDCWCSEGEEVKEEDKKEQPQLSVHYSVISQSS

SEQ ID NO: 925842 - protein, 152 aa, Homo sapiens
MTRSASSGKPHASVLGYSNHTSRARAPLGGTNAAGLLRCRGCCPHGLLHGCFPWWPDRTPQTPNLLTRLLTCPAPLHPRSPGTWLDLQKRWQKPGPALVAGVQGPPWHLNSHSKSGWKDVGSLCTPPRQPFPEFSSVPLSFQGERRERSWYD

SEQ ID NO: 925843 - protein, 159 aa, Homo sapiens
MTSSSSPHPCSEWGDLLAGPARLFPVPSRKGTLPASTLHAHTLAPLAQPRQELLPAESPVFSRSFASPCGLSLPSRSVAGRRPVLPAARGQGGRKPSCPPRVDVDGAVRAGPGSGVPAACWASQAVEGRLSQCPWQHLHEVPASWKLSPGTALARGKQG

SEQ ID NO: 925844 - protein, 197 aa, Homo sapiens
MLAKRFSIVEKAGEQNHGRAAVSTIRYNSEVAAKYVPSVLINWTAIEELLISANRHVLPGVVRVQGRHTWGSSTPTQMVSGFPELPQKSTTSWWLKQQQWTLTQRWRPTVQGQGVDHIGCQSKALTKAFQARVTRTFAFSLAPPPPTLSSQQCQPPSVSRVCLVWSSLMASALAVPAVCTSLLQAPAPPAALPDSSA

SEQ ID NO: 925845 - protein, 135 aa, Homo sapiens
MQTRVLQQVHVFPQGVQPGELNESIRISLTVHVYLYLRIEVAGFCSLLFDTRPLACPYSDCSHTRNGTRGQKQCLLKYIVKVQRNASVFWLKSHTGIKATENSTLSCTWPAPVDPGDRHSAHLLPGSFAKPMMVL

SEQ ID NO: 925846 - protein, 134 aa, Homo sapiens
MLKDEDSRGPTGPAEVAHFPWSEGVLEHFEMNSRDPFFVSPKFSGAGRPGPSPLLIRGVPNRRSPKTVPSGGGLDLDLQKILKPAPVFTFTASLFGGGAASASRRKKLPKRPNKEPQRPNSFSHLEQLKNWINK

SEQ ID NO: 925847 - protein, 528 aa, Homo sapiens
MMTMVVLLFLHASPLFGSTLSTAMAQADIVLIRLAVMGQNLILTMKDHGFVVCAFNRTVSEVDDFLANEAKGTKVVGAQSLKEMVSKLKKPQRIILLVKAGQAVDYFIKKLIPLLDIGDIIIDGGNSEYRDTTRRCQDLKAKGILFVGSGVSGGEEGAWIEYGDMQLICEAYHLMKDVLGMAQDKMAQAFEDWNKTELDSFLIEITANILKFQGADGKHLLPKIRDSAGQKGMGKWTTISALEYGIPVTLIGEAVFAWCLSSLKDGRIQASKKLKGPQKFQFDGDKKSFLEDIQNDSWWWAVSTGVQAGIPMPCFVTALSFYDKYRHEMLPANLIQAQRDSFGAHTYELLAKPGQFIHTNWTGHGGNVAAAAPLALVAPTSPALAAYPRQPGGAEDIAKDTDEEMHRPEAEIKVQEATSNDPWGPSSSLMTEIADLTYNMVAFSGIMSMMWKRLNDHSKNWQHVYKELLLLDYPIKTGSECMAQQCREIIFAIQTLKDFQYIDQDGKDQGINVHEKSKQLVALLKDEE

SEQ ID NO: 925848 - protein, 149 aa, Homo sapiens
MRKSKKYLKDQSILGLTIVMSSIGATGEVTYLVTSSFMTPEQKKKFKQAAWKQSLLVLEGQSQSCFQFAGGDAIARQVFFRVCLPRIAAVLKDVYKAIFTSCRKDTLASSFATRVHRTKETGSFNLMRPPYCCVWFPLAVTGPHILYLS

SEQ ID NO: 925849 - protein, 165 aa, Homo sapiens
MGASCSQCFQSVQMVLRVTGSESVVTLPPGIKLGPSRMTRTSSPTHFLLQSCLGTLKCSKDQPTGNGVAGPEHFWYSCVIRYLRPPLLPAAPMFLGSKDELSCTLAPAPPLPYSPFTSVTHPILHRQWQRSLRGEGSTPQPQPEQICLVLRYMCSISLGGRKGFR

SEQ ID NO: 925850 - protein, 177 aa, Homo sapiens
MEVPSWASLPEGAITAGRRCGWGCWPAAPVGDPRAWGNPAAPPGTGDPLLFRVGENLLHLPCMLCSLDHTTQQQRSPFSLPLQHHLYFHTVFKEALQSLINTPMKPEGTRPRAEQGATLVPAGPTTRRIAFREKPLWKEGRSPSLSQRSPHSIKASFIGPCPHPPAHYSLHVLCPSL

SEQ ID NO: 925851 - protein, 192 aa, Homo sapiens
MIVSFLRPPQPGGTDHEKHKSFLEEQRIQPWMPLQAGDGRQTHHASAQCLRPPAYGLASSKHRPSTLHQTPTPKQKTRENVLKAKFSGQNPWMAEPHPVSLVIHSQVHGCEQGSGMCQRGAQNRPQSPAGCPVGCSIKARVPGQRWGLDDRQCRQCPGGAFTVTGDISEDGRGCSLEAVAKKATLSLRVAEP

SEQ ID NO: 925852 - protein, 137 aa, Homo sapiens
MAELSSEQTVEPSPQAVSQVLSAPGKRIAEPDSTGEHESASSCGASRQSTKERGQGSSLVLTCVGSTCGHPLCKAAAVLVRLGCGLGRSSILGGVGLQMLPCSWSPMGAAKGDPNFSWESAHPWACGPLRRWVSATL

SEQ ID NO: 925853 - protein, 152 aa, Homo sapiens
MCENAQTQDTRGDCEMGLKRSRGSRPLGGFRVACTCEDAGRLGARVAPGSTPRALPPPSLPQCLSPTALPTAGVRAPQAPPGAAQSSRRVNPPSTAWRGQRPGAAVLAQGKRPLRKPQEDGTPHAPGRQDPTCPGKTGPHVLQEDGTPCAPP

SEQ ID NO: 925854 - protein, 136 aa, Homo sapiens
MGHGALSPYLRDFSILCKQQVLPGVSAANTDSSDSTVASVKPGEGGTEVLPWLQHGELPAWFRGSQWGASRSPVDGTQLRRLQPSQDAQNHHQAVSTPVGVEQLMPAGGLRVQGTGTAAETPSPAPTYTRVIPRGF

SEQ ID NO: 925855 - protein, 327 aa, Homo sapiens
MVTTSHKWVSYTKKVKFDKPDGQTDKPSMGLARSTVNYSKVAERQGPTKRQCFALIRRFHLILKDRGSRLWFPHSRGLSGHLPPLPDPSIPSSKTLQEQNDQSYPSTLPVFPEVALHTLLWGEDANNSKAVFTLTLSGLVEVKELQREPLTPEEIQSVREHLGHESDSLLFVQITGKKQNFEVGSSSQLKFSITKKSSPSVKPAVDPAAAKLWTLSANDMEDDSMDLIDSDELLDPEDLKKPDPASLQAASCGEGKKRKACKNCTCGLAKELEKEKSREQMSSQPKSACGNCYLGDAFRCASCPYLGMPAFKPGEKALLSNSNLHDA

SEQ ID NO: 925856 - protein, 179 aa, Homo sapiens
MCSSREGSCCYETNGTADLTGGKAQASVAVPTSVVTVTPGKPLNTVTTLKPSSLGASSTPSNEPNLKAENSAAVQINLSPTMLENVKKCKNFLAMLIKLACSGSQSPEMGQNVKKLVEQLLMRMLNMMIVDVYMSAKMLCLLATKLYAFGFLHPLSDHGGYSLESTGLSCMLNGSFTHV

SEQ ID NO: 925857 - protein, 135 aa, Homo sapiens
MDSFPVQGVSRNVIQELEPGIGASQLCPMTYPTVTELASKMQDTVLLLFLLLSSNEGKVFLVAMNVQVEMRGGKQAEGVKVIGIGGMMLETGTGVKCFEDGGRWPQAKEHRQPLEDEKGKEMDSVLGASRRNQLC

SEQ ID NO: 925858 - protein, 238 aa, Homo sapiens
MPTEDRVTWKSNYFLKIIQLLDGYPKCFMVGADNLGSKQMQQILKSLRGKAMAIQGHLENSRALEKLLPRIQGNVGFVFTKEDLTEIRDMLASSLKPLGTTEILSDVQLIKTGVKVGASEATLLNMRNISPFSFGLVIQQVFDNGSIYNTEVLDITEEILNPHFLEGVRNIANVCLQIDYPAVASFKVFLVDPYAFAAATPVATATTAAPSAAAASAKIEAKEELEELDEDTGFGLFD

SEQ ID NO: 925859 - protein, 147 aa, Homo sapiens
MPGLLVAPLTRLLHPHVALPSTEFLHWPLAVRLEGGSEPQLLKVSLLEFGRDNEHFPEHSTNMVKGAGDSQDQKRDLSQDHYVQNCWAQGCAVSYVTVRGSEPSWAILWEVGGGGNLHPFLGPCIYRKSSLHIIDGFLEMTTLSETT

SEQ ID NO: 925860 - protein, 178 aa, Homo sapiens
MPVRFAWTWDVLPTLRAIQGASGHNDGKGLQRQLLKWTLESGARDSGQPPLKCQCLHSALLLPHRGAEGNQDAATQQEIALLPNNAADLGKYITGDKVLASNTYLPGPPGLPGGQGPPGECGRGHRRVITNRKSLPKAHICWGLDNVLQLPSRRNKAGVHGTATHPCNERAWEIGPQA

SEQ ID NO: 925861 - protein, 167 aa, Homo sapiens
MPKGLFPISFHDKVWMYDWQSAKREEDGEAAFDRIKFKMPVGQPDGDVRRQRQREYKEKWLQGSWTLVSQGPLSFSCAGPPGAPGRDGSKGPPGSFDFLLLMLADIRNDITELQEKVFGHRTHSSAEEFPLPQEFPSYPEAMDLGSGDDHPRRTETRDLRAPRDFYP

SEQ ID NO: 925862 - protein, 236 aa, Homo sapiens
MTGSATFCLLLPRGLSPGNGTFLEGGMRKGFQTSSEQPTVLTSLKDITVPPGWRLEVESSFPRNGPGCQMIIHNPTSPVRFRVWGAHAVAMSHSLMAATTVQTWENYGYSQRFAQSPLAEAFQGRTGWKLARPEEESAGGAGAAGDGEVEAEMLRKLNIVVKSEMWISDPFRRKRMWLSVALGHVNAHMQRGCLTIKPPIKQGIINGCPLRLCSPSRIRTSALSGDLLDGPHRRVI

SEQ ID NO: 925863 - protein, 146 aa, Homo sapiens
MVLDYSDSDNCDNEDDVVNIAEKGSIDDMVKICDGLMERLEQCVFITGPEIMTQKLTTCKGDMGAGDSALEITNAATNEEAELQRQQGTETGLQWNSGLRIEIRCLRLVWHSEDKEQETRSCQGKSENCADREKSSQALNSEEDNC

SEQ ID NO: 925864 - protein, 171 aa, Homo sapiens
MFLAEKKNSAIFLPFAFERREIWLCSTQLTGGYTYINTLKAFCCFETQDWFPDNDLCTNISSILPLFHNNKPVQVGILEEHKSETLPTLCFFSLLQAWRRRKEEKDKERCQDTTSKIKFKKIVTCSYLYSLVLFRGFSEESQLSYCKLQYEETHMGRRKIEETSRKKSVRR

SEQ ID NO: 925865 - protein, 143 aa, Homo sapiens
MSAQCKLQVDLPFQGLEDGGLLLTAPLGSASVEQIPIHNCRRRIKYLGIQQTKEVKDLWKENYKTLLREIRDDTNKCTGRLNTVKMAMLPKAIFRFNAICIKLPLTFFTEQDKMFKIHLESKKSLNNQGGYGQKEQNWKHNTT

SEQ ID NO: 925866 - protein, 127 aa, Homo sapiens
MVSSGLPSGEEVYLKLGKPSPDSSKQMGTPQMSAIGDYTFSLKFGLKEKTEARFLDITGKVRELDIESSLLFPPQREAKSWEFPPDHVAPSSERNYGERMTQIFIVTSIQQFSGVRTHFNWFLDISP

SEQ ID NO: 925867 - protein, 353 aa, Homo sapiens
MWLLLGHMGNKQKIHKLKIPVKMHLISEVKTVEKVYPMLLLTVWEAQWSKTCFCGETQRSPNIPNSIEDLKGSGDRKMWESLELPRHLLNGFDQNAGGDMDNEGMSATFTAASFLTSQRLRREKWFHGLGPEPSGSMQPRDLVPCAPVALAPALAKRGQHIFQSVASECASPKPWHLTCDVGPAGEQKSRIETWEPSSRFQRMYGNTRMSRQKFAAGVEHSWRTSARAVPKRNVGSEPPHRVHTGALPSGAVIREPLPPDSRMVDPPTACTVCLEKLHITPAYESSQWLGCLLQSHRGRASHGYGSPPLASDTVKDNQTLDSHKKHATWIPHTHSSQYGLHFYENRMLLLIWQ

SEQ ID NO: 925868 - protein, 132 aa, Homo sapiens
MTSRICKWLVSCKCLCEYLVLFALEDKFDFHLQNPVFPVNFYAMVQCGKQTGKGRGDTEGLVRDISIVQGRYGGGNKYEVKVYTGDVIGAGTDADVFINIFGEYGDTGLFCRWGSHNPGRGRQLEPHFGLLY

SEQ ID NO: 925869 - protein, 130 aa, Homo sapiens
MALHKGRLFTEEGRKMDNKHMKKAIHFSSSNTFFSHRAACQLNYVIFSSSGDSLEAEVDDEVITDCGLARKQIMKTKCTNTREALTTVPSTQQEPSDAVVVAVVAFQSFGEPEEQGQGGTCGNDMGVFTL

SEQ ID NO: 925870 - protein, 165 aa, Homo sapiens
MEVHGRLNRKFPRKAKWLPGLGGTDPEWSFHLSSASPQPDAPVLATPVIPALSSLQTPPSGPCLKLRPAQSSLAFPQQNLSLPQGVPAVFCSCPCYVAELCCPILSRAPKPPDPVAAEHLNHGQSRSTLKAILGGSTQLCSREQDQIGTWMNAKKNLVVIYKIIF

SEQ ID NO: 925871 - protein, 145 aa, Homo sapiens
MQEGSRIISSSSSSSSSSRVLNDQPSQHSETLSLQKIKKLAMHSGMCLLSQLLGKLRNWTLNLKKRRRHVMMVFHHDTMIPIKKRDSHYFLKSQREFNRGPFGRSYWERELGSVYEDPSADYIVLNGNPKSQQMNPRTGGLKTRT

SEQ ID NO: 925872 - protein, 161 aa, Homo sapiens
MSSSISDKGNEIHILLSEAELGLIHFNKHLLNALLVRLCTCRQDETWPSLSARRASTESDEELSLQDVVIVFVYDNWAPEAVWDSQESFHLESKAHVDVLQRNRGFQVGKGGPGPEPQVCCWSSLTVTSHLDFIPDNSPPQTQAYAVTKDGKNYSLAQKPQ

SEQ ID NO: 925873 - protein, 221 aa, Homo sapiens
MSTILHEVPQQGTEHSQVAARTCRGKQDHRVSVGKVKSEAQDSERKESWPRGCVRKASGLSSSLVTLPAGGGGPGSKHLSCWLSGSPRVRGRVASWPAGPEPRVLRLAARSRQSCTVASGHRPQATGGSSRMPEETQNPCQQRRSGPATCLWVLPVGFMKCATLISYPLEFLVKDPECLTSQEGTFMGKNRQECFQSQFLNFSRFQKAARPYSPLQGLHIP

SEQ ID NO: 925874 - protein, 139 aa, Homo sapiens
MSTDKTGENFHLICDTKAPFAVHRIAPEEAKYRLCKVRKIFVDTKGIPHLLTHDAHTICYPDPLIKVNDTIQVDLENGKITGFIKFNTENLCMVTGGANLGRIGVITNRERHPGSFDVVHGKDANSNINKPWISLPQGK

SEQ ID NO: 925875 - protein, 154 aa, Homo sapiens
MGTEAAVLGNLATLPYVHLHLAVHVSFVQYSKLPLLQNISNADLRPSAQKGLESMLSSGYFHGWRFHKLMPDPCGLENFLGLGFWFAPAFPVRQQQFRPSRFPLQYSLFSSCQSHCISTNSTCPPLTEKARYTPMEKIAWMYLELTQLMMYKNT

SEQ ID NO: 925876 - protein, 137 aa, Homo sapiens
MPSYSTTFYPVGIVIKKQCFPVIARCNKTKQVDSIPHRAYAKPSPFFPAVVGYKSSKRSNGSWNLMPYEDQRVQKNPGGGSCLLGSEMNNSRGCMAPGHLSLLPARSAIFFTLLVAHCLSLPNKVQTHRVGTLWFAH

SEQ ID NO: 925877 - protein, 192 aa, Homo sapiens
MVDSVATAVSVCVWSHSENALSIHYVRSTLHNCPLRNGKGDTHPNQAFPPTLGITIRHEIWVGTQSQTISTSKPMSDQGLGNSCKGSIKCIQLRQEEGAKGSDQVGWRVKGESASRCQSGLILWVTCSCCKLKVPEANTCFLFQRDGGQGACAQLKFTNEVLRSCGFICISWTEVTWGKNSCHDSAADLNMT

SEQ ID NO: 925878 - protein, 719 aa, Homo sapiens
MLILLWSHPQHLFASRPITRLKSQSVPRGEVESVTHEERDLQPFTSVTVHCRKGNDQTFGGPLDAGSELTLIPGDPKHHCGPPVKVGAYGGQVINGVLAQCHHQGLERRRGGDSHNIPIQPSYLACAEDRWILRMTVDYCKLNQVVIPIAAAVSDVVSLLEQINTSPGTWYAAIDLANAFFSIPVHKAQQKQFAFSWQGQQYTFTVLPQWYINSPALCHNLIRRDLDCFSLPLDITLVHYIDDIMLIGSSEQEVANTLDLFTALGLLLALVETEHLTISHQVTMRPELPIMNWVLFDPSSHKVGCAQQHSIIKWKWYVHDWARAGPEGTTTPVISQWPHEQCGHGGRDGGYAWAQQCRLPLTKADLNTATAKRPICQQQRPTLSPQYGTIPQGDQPATWWWVDYMGSLPSWKGQRFVLTGIDTYSGYGFAYPACNASAKTAICGLTECLIHHHDIPHSIASDQGTHFMAKEVRQWAHDHGIHWSYHVSHHPEAAGLIEWWNGLLKSQLQCQLGDNTWQGWGKVLQKVVYALNQHPIYGTVSPIAKIHRSRNQGLEVAPLTITPRDPLAKFLLPFPATLQSAGLEVLVPEEGTLPPGDTMIPLNWKLRLPPRHFGLLLPLNQQAKKGVTVLAGVTDLDYKDEITLLLHNGGRPPGTLCLRLTCQRPCVTETLLPDQCSQEMTIFSLPCPTPGPGQSEDRIVILSLGQACDPSLSASRPNE

SEQ ID NO: 925879 - protein, 161 aa, Homo sapiens
MAVIFLRGKCFRKTLTYRKNSHMKMEAEIIELCGHKPRNSCGHQKLEETRKDSPLKTLEEAWLCQDMDEAGNHHSQQTNTGTENQTLHVLTHKCELNNENTWTQGEEHHTPGPEDRDTPGHQGCTHSEKRPGEGTMRRSSASQGAQGVIWGLRNATIKPMI

SEQ ID NO: 925880 - protein, 139 aa, Homo sapiens
MRLRPTGLHSQKVRPSRSQGEIECRHKMQVTKTLLIKQVVVKRPAKTRQNQGGPPPSYAHYTVINKYIETVGFAAEKDFNDCRKAEQEDRRSPQIHLSEEFWAGDFKSIIERTVSQVEVSILFCYLETNHCSKTILLAS

SEQ ID NO: 925881 - protein, 127 aa, Homo sapiens
MLSCLRSSHVKSMTAYFGGLMIVQGKTMDKRNKNLKGRENKRRYMQFAPSIDGFRMALILLNIQCLSRNYKRFIECLKKWEQKKSEAQNTQWVQLTEKKAEKQTSSFAVRPYDIWKLSGNIVLVEFS

SEQ ID NO: 925882 - protein, 159 aa, Homo sapiens
MLNILVSEESVLCPVFFGVQHTSSLHLTFRGLWDLSPVIVLEEKRHGGGGFPGEPALSYLSTASADAIIVSSGNAWLIPPDRGRKMKTTVRAVATATGSREATSPGKKGSSEFRSSLSPSFIGVLPYILIPMYSILFFSNQCPHFNSSHTTRLRVHLLL

SEQ ID NO: 925883 - protein, 147 aa, Homo sapiens
MAVPPGLIATQQQRQAMLQYLPHLSLSDSKYAFHILHHHAVIQAERGFLTTQGSSIINASLIKALLKATLLPKEAGVIHCKGHQKASDPIALDNAYADKVARQAGSFPTSVPHSQFFSFTSVTPTYPPAPPLKLLPINLFPHKANGS

SEQ ID NO: 925884 - protein, 135 aa, Homo sapiens
MILINPTYKGNQVYLHRCLQGLPVSEQRSKVITMVHKTLVMWMLSSFPSPLLPFPLPLTSTYTESSFLCNTASPSWSPKLIALLPVICMAYSLTFPDLCLNFSTRFFPKILFKKEWPYFWALPVLLSPFLLFCFT

SEQ ID NO: 925885 - protein, 138 aa, Homo sapiens
MPIKHSGLVVGSKLQGDTKQSIHPSISKNVMPLDCASYGDVFLLLNGCTARESMTGFISLDSRLEETAGNLKRQRLCAALSSGPARARKADILKNKCVIQDKCVHFRTRNNWDFTDSQVNSSILHPVFCFQTCTKAAN

SEQ ID NO: 925886 - protein, 157 aa, Homo sapiens
MSPSSKTKATEQSWIENDFEELREGFGRPVITKFSELNEYVRTHCKEAKNLEKRLDEWITRINSVEKTLNDLMELKTMALELCDTCTSFSSRFDQVEERVSVIEDQLNEMKEKRVKRNEQSLQEIWDYVKRPNLHLTGVPESDGENGTKLENTLQDI

SEQ ID NO: 925887 - protein, 161 aa, Homo sapiens
MNKSHKTWWFYKGKPLSLGSHTLLLSLCEKSLSPSTMIVRPPQPRGTVSPLNLFYFINYPVLVHSKSVHHSLLAPLSPISVEAASVSAGFICLEYADLVAGMSTVPALVTAMLLPLCEALQCCDSEKECVSMCRNVDFLLHQCNQKRGQQTEAIKRFLLFT

SEQ ID NO: 925888 - protein, 161 aa, Homo sapiens
MGATSCISMTWMLFGGTDGAWLHENPCMAIQTKVLLYSVIILIEGYHREESNLKISKCILLRVLMRLKEEEAAEEEGGGGGGGGEGGEGGEEGGEGGGEEGGAEEEGGGGGRGRRRRRRRRRKRKKKKKRKRKKMKKKKKKRKKKKKEKKGEEEEENPVKC

SEQ ID NO: 925889 - protein, 163 aa, Homo sapiens
MSVPLPCLSSCSVVFPLPTTISPHRTLATWKGHAGIQNHWVLRVHSVIFPGCHLLTEDLGAVLLSPAPQPPQSLPLWPALPRVTTSRRASFPTEYLTPWAPLSPPLYLKSPLQTASGHIAAVNQKKKAASFQGHGSKQSVPTFWMESISLQHMGLRTHDLYWH

SEQ ID NO: 925890 - protein, 152 aa, Homo sapiens
MCARPLLAASRGPACPLGVFRWFVLAPPAAAGSIDPIFTDHPPGVSKEICKKGKLSGPTPDPLNWELCGRGPESVNERTRGFRCISEQSTIWQFHQAHGLVSIQPTLISFQSWICRITHPVEGAQRKKKITITVKIYRAQTTAGSCSNYVYV

SEQ ID NO: 925891 - protein, 151 aa, Homo sapiens
MKSQEQRDSLRSPGGGKPAPPARTCPAWGARAAGLSTRMLFTDLVGLKQIPTPQKGGLERKEALDGKNRQKAGRAADQATASSHWPTPTWGFPPSGYGDPLPPALSCWGHQKAGPQSGKPLPAASPSLGQVWARKSIPRHYFTNPYINPVK

SEQ ID NO: 925892 - protein, 136 aa, Homo sapiens
MDIPTALGSRRQKELSRDLHRKSGFITEELNAELAGSPTAFLESSPCTTLTNLPIAAKELRTQRARTHLNLPAGEGLLCLLNPGQLEVEPQLYILPPPAQNKSEEGGEGGYGRPNNACHPEEIYTLIPGTCESITL

SEQ ID NO: 925893 - protein, 162 aa, Homo sapiens
MNDTLHRYHCCPGNSTELQRCSYHREFSVALGSLAYDTALPTPHPPVLLAPGLPTPPSKTMDKFFCFNASLKPWPEIGTPPMSSLAEGRGGNVAKPSGSHSCIARAWILALLLTGWGTLGKMLKFSTRPPPPPFPWLQNGDSTVLTMQNHCKDARSECMKPH

SEQ ID NO: 925894 - protein, 219 aa, Homo sapiens
MVFLIIVFVLPWIFWYMSPVTIARVSLCTRLGMKLLDQGLCTCSALQGAAKPDSQVVVLLPVIGELLIAPHVHQHWIMSFPSSYPLATGCTGYLERVDHGNRPTQNLEVGLGHSGRDSGVLSWKVVALAGAGAVILDCCGIWKYSPCMVDQQIEGTWVKYCTKSHIISRSHLELVQAIPKKASWKNPGISMEARASRLSPGIEAQELERHWEPGSISAF

SEQ ID NO: 925895 - protein, 144 aa, Homo sapiens
MQKSPAFCVGLTGSCRRELISDSVDLGLGLKISIRNKLTGDMMLLVHRKYFEYPFFRFLVFQVSSEIKNGKTETSNVITQNKQNILIVLKTFNFLKKYPTKTFVWKSPYLDIRKLPSLRSQPSPDTESAVALMLDFQFPELHRR

SEQ ID NO: 925896 - protein, 138 aa, Homo sapiens
MKKILLPNPQKGTNSASTLILDFWPPEFEKDPPMTSGPQTNQPKEHSSNFKLDKSQPHLQHTRTSKRLNCSGQAFLLNLLPQELATSARNLTTRPRNACSPGFLLSRVPSVREPTGNRTVQLTWQPLPEPLELWPKAL

SEQ ID NO: 925897 - protein, 140 aa, Homo sapiens
MTVYKCHGNITKNVVRLEESGCSGDSRQVMLQPLHLVKDGSKNDLQGAADTVWIKKGKEVYKLLDDKHIEGNQIMDMFPTGVGRKLNHNRNSIACNLFREYQVTGVPFLKMNKQNTYSFLLKESELIKSKMDVKVALYLR

SEQ ID NO: 925898 - protein, 133 aa, Homo sapiens [sequence omitted]

SEQ ID NO: 925899 - protein, 135 aa, Homo sapiens
MDRGALGLAQKTIFPSYASGPVPKSGLQRLGLASTLFRNQRGFQELREAREREQALLSLWGKWDFLDPENARMPGPEPRLATVAALRSTGLPLPPTWETKYLYHHLVFSRVNNIFDEVLQQRASADRGIDNTQGK

SEQ ID NO: 925900 - protein, 183 aa, Homo sapiens
MQISAAAALVQRTVWGGAKPPSVSSENSDVSVLSPSSSTESSIENPSYPPPYISSPTVYPSLPEELSPMNTTRSGASYPPPKENLCPLRKVANREEGTGAIGSRTNDGRNSQAIPKVMEPESFRHSSQTTSHISREDLGNHDVPDAVLLPMEVVVIHCRGHQKGDSSVAKENFFADAVAKEVG

SEQ ID NO: 925901 - protein, 441 aa, Homo sapiens
MDPNSILLSPQPQICSHLAEACTEGERSSSPPELDRDSPFPWSQVPSSSPTDPEWFGDEHIQAKRARVETIVRGMCLSPNPLVPGNAQAGVSPRCPKKARERKRKQNLPTPQGLLMPAPAWDQGNRKGGPRVREQLHLLKQQLRHLQEHILQAAKPRDTAQGPGGCGTGKGPLSAKQGNGCGPRPWVVDGDHQQGTSKDLSGAEKHQESEKPSFLPSGAPASLEILRKELTRAVSQAVDSVLQKVLLDPPGHLTQLGRSFQGQVAEGRSEPSPPVGGACKDPLALAALPRRVQLQAGVPVGNLSLAKRLDSPRYPIPPRMTPKPCQDPPANFPLTAPSHIQENQILSQLLGHRYNNGHWSSSPPQDSSSQRHPSSEPALRPWRTTKPQPLVLSQQQCPLPFTSAHLESLPLLPSVKMEQRGLHAVMEALPFSLVHISFNSN

SEQ ID NO: 925902 - protein, 170 aa, Homo sapiens [sequence omitted]

SEQ ID NO: 925903 - protein, 136 aa, Homo sapiens
MVDRVMVAIVHHSHGKEFAHRARRRSCLQFYGQLAVLRSTTVADGTDTRGGVNEFSPAPDFYDPWAPGHVPGNVELMHIYTDHTSHGLNSHLSESWRNSVIIPELERRRGLKFCYKAARDPHSCPILLVFEGRESK

SEQ ID NO: 925904 - protein, 146 aa, Homo sapiens
MVVLRNPGSPNDNCAVLRRLTQSMTLPNLKGVNREIKRLSYLCLCAFLERKNKQVGIFNISSASTTDLVGIKSEYGYSRFRGDQAFRDDKSDDETVGADAVRVSKSHISETFLNKLIPLKFLSHDLLLKELKHHNVLERNANANAH

SEQ ID NO: 925905 - protein, 140 aa, Homo sapiens
MPTTSMRFKVDSSPKPPGLYVTVTSSNSVSLTIVLKLVTIATVANHFIIVFSFLYKKSVSAESEEVPGCFTDESGHTHNSELKTIRDKVENMRVKSDLYMDHKILKAFHLLEEVEYSGSKDEGKIELQLGKISQRLNVFV

SEQ ID NO: 925906 - protein, 176 aa, Homo sapiens
MTQKSQNDSIIAVSRLTKIQQENIFSSLTGNYSHIGKIIEPPRGPRGRKKPTEYVQQSWNQPPCAPQEYFTIWALPFFRVLTLQGPSSELLEYQHQSESQNLKSREANSVAFSLWAKAREPLANHWCLLRSPKAEELGVRCSRAGSIQHGRKMEDRFSQDPCLDIPRFKYMLNSTC

SEQ ID NO: 925907 - protein, 156 aa, Homo sapiens
MQWPILAHCNLRLAIYNDSIKMEVKIASWTLWGPPTKKGVIVLAGVIDPNYHDEICQLLHNGGKERVCMEYRRSIKTSQYYHDLDLVHLYYYNKIPQSRRFIKDKNLILTVLEGGKFKFKAPAVELHLLTEKIHFESRSKMLVNLTGFPCEELMPL

SEQ ID NO: 925908 - protein, 144 aa, Homo sapiens
MFKIMERCAVENKQVVAAGNGPEYPLSSHDWMPNGTKKNFEYDITLPPALWFLIRNQPFILLRLLLLGSTALFHDPRLQIELEHSPHGRRFHSLESMRPRTPGQRPKACRHLGSSLPPSWELQEQRSTCNNKIYCPEEECHKVD

SEQ ID NO: 925909 - protein, 153 aa, Homo sapiens
MPIMLVNKYSHLLTAVWICCTRCKCVSAKNITWDPALHEDSRANFHAEMDGKGFRKAIEFSYGSSNETLKPLLQLSEAQNVETMKKESIRVTELSRYHENNENSLTILRTAWSPLTLTDSSVYRSSNVCGPHTKDLQYLTWFPTPHKSDSFKL

SEQ ID NO: 925910 - protein, 145 aa, Homo sapiens
MAFLIAPVFSSFMISSTSYLPLKTLPKSRILLCKTLMTVWIREVVTTGKLFKADIWIDYTGELRVGVGLETVSRVTKLYFWYKKSISPNRASDQSPQQPQAPNFKIFCGKLRLLFETKRLKPSKVNNKKITGETKDVLASTKLGL

SEQ ID NO: 925911 - protein, 147 aa, Homo sapiens
MWILWFPSTHIGTIVLLLCLQVLRRNRLNPGEGYPASNFLEFNSSGGAQQHSIRALPFWLPKKVTPRFPKGNGEIPLNSRGNVSAENPGASSRVDNSTTVKKPRATKTVSPPQGSSSVATCPLAWLHHLPGKMTALKRAFESPLDKL

SEQ ID NO: 925912 - protein, 143 aa, Homo sapiens
MINNSCILNLIVKVESFFWRTLKIVFIFCYSTCGSCTSYIGISWQLVGNAESQIPFYIQSFNDIKIVMYQLLENEKILNGGKYFINNSFNRRFWNELTHLTVIKCEEAEKKATSGEVKRTTIIWIIWLTIHVRNQQSFIKKKN

SEQ ID NO: 925913 - protein, 135 aa, Homo sapiens
MGSHSSLVCTPFKCILNPQDYFKKCLRIFPFFSLVLSSLRVGVPGKTPTGLHTGVEPWEVHVPFAAERSLAPPLLVWDQGFKLLGGMQSSGGTLALRESLCHLCFLFIERNPVLLTIQIVCEPEFSRSWDKEPLS

SEQ ID NO: 925914 - protein, 138 aa, Homo sapiens
MSQKQEEENPAEEAGEEKQDTQEKEGILPERAEEAKLKAKYPSLGQKPGGSDFLMKRLQKGQKYFDSGDYNMAKAKMKNKQLPSAGPDKNLVTGDHIPPHRICPRESPRSSPASLRGNLRPPLLPFLNHWTFIYYRQG

SEQ ID NO: 925915 - protein, 145 aa, Homo sapiens
MPKPMAYKMLTSCFLSPNIASLIKAVLDNPTMLTFSSQGLRTSLPVARQKGVSHHPKNTGSLDSEPLKYPSSLLHFIACTGSEKQISLFISYQRYFGVILCQLAGECFLLHSGLIYALAFVTILFLSRNGNWLNPSARSRSPFNS

SEQ ID NO: 925916 - protein, 170 aa, Homo sapiens
MELMGHRYAFIYVSFKMGHKAMETTHNINSSFGQGIANECTVQWCFRKFCKGDKSLEDERSDWPSEVDNDHGFYTATGDDLLSGWTEKKLRRPDLHQKKVVVSVWWSAAGLIHYNFLNPGETITSEKYVQQIKEMYQKLHHLPPPLVNRKGPVLLHDNTPLHIAQPTLKS

SEQ ID NO: 925917 - protein, 413 aa, Homo sapiens
MRMQRHKNDTMNFEDSGKGPHGLALHWEDLEPASVGIDLTLGLAQSLGLQDLAWHSHGHGGLVHSCWPGAWGLRCLESVSEEARTTGAGLMTRVVGVCLVLGQYLRKTVSDLTDQKVYELQASCVSSDVIDQKVYRIQDIYENSWTKLTERFFKTTPWPEAEAIAPQDIIDEFIYQFQSFSQYCCKTAKKSEEEIDFLCSNPKIWNVHSVLNVLHSWVDKSNINRQLEDAIQVFTNILFYIQRTKSMFQRTTCKYEMINKQNDQMHALLAIALMMYPMHIDESIHLQLQEKYGDKLLRKQKGHPQVYEELFSYSCPKFLSPVVPSYDNVYPNYHREPFLQQLEVFSDEAWQQAQLSSICSFLKLYTTMPVAKLAGSLDLTEQEFRIQLLVFKHKMKNLVWTSSISALDGKQIE

SEQ ID NO: 925918 - protein, 151 aa, Homo sapiens
MEATARFWPWPSLSSCFLVVPWKLRAIGWGHSLVLPEGLGMNGNNCPGPKGEGSFLRMVPNPYGGSRAHSWEQIRTGFRELKTYLMLNSSFIDGRLVLPESLKILLLRVLHSTTHHGKDKMIQVEYIGVVTYKLFKMVYNQFLIPYSWENN

SEQ ID NO: 925919 - protein, 142 aa, Homo sapiens [sequence omitted]

SEQ ID NO: 925920 - protein, 275 aa, Homo sapiens
MVLVLGSFVGLSFSVFVHSLPTQESHLELIKYDHKILIFGPTSRLNGTLEKSTLGKGKGISIFLGRLGDLASSSRLLVPCFDDIHSNCLSYITNNKTTQRSIVREALNTHRLARNYTKNSSITRLQEFRIIFQLLTKMVIHLFLQFNKVASNVSCVLIHYRGITNTDLAWMVQDSYLGSEASFFHWWVIFAVTSSVATMNIFDRHLFDIEAYIVPRKSFTQSFMVHFNTSLVAMLTGAKVTTMPGLRNPGFARPTKIVSVPPTLPTKIVSVPPSL

SEQ ID NO: 925921 - protein, 136 aa, Homo sapiens
MAKGLQCNTRLQQQKAGILVFRLEQVPAPAMDVPVVGKGELRVMEYPQEPADITSLQNRGLSPGCIFLQREGFRNAVPELHPRPTKSDSPGCGQGISMWKAFRKTEQNESQFKEEGIKYIIVQMIHGNGKNGDNGT

SEQ ID NO: 925922 - protein, 136 aa, Homo sapiens
MWPKFTVSPWIQGRIHVLANIVPGRRSPLDGQAATVLLPHVGPATLTGSADLPKKGILSERRKDADLGLKTEEGGNDPWSCRAQGLDPGPQWFLRKDQTFKDIKEHKSRKPNPRTAIRKIKGTSVHTYEREQVQEL

SEQ ID NO: 925923 - protein, 169 aa, Homo sapiens
MLEAPRPHPTTNAIGVSGIEEEPAFYRTHCGKGRTKGTFSRFMCLFTLLRCIESDLLRAQAEGSSKFRVLRGGEEPGSWNELDYWIFCPDWPVRTNSSAKRKGLKLSIVFKPAPENDNGELASYVKDWAICYDAKNLERGEVTARGQNIRQFVPSLIKSAFAIAKPQGQ

SEQ ID NO: 925924 - protein, 140 aa, Homo sapiens
MLEANVLIKWAFSGVQVVLLVLNRICQCSWQLMGSLLEFAGGPLQTLFAWVSSAEAAEQQTLLPVPSSEGFVPEGHLPDASWSSPVGGVCRPLLGGVSQSGGMGKEDLKCEAVRSLVKTSEKSKAVSCKVTQMDKKSCHP

SEQ ID NO: 925925 - protein, 161 aa, Homo sapiens
MADAPPPTKLECPRSTSDCCAGSGVNGSVSLAFQAPLGYGKELLQLAQFLLKWPPSFVIETQGPGGVAIRGNLLVEGNRCMSAVCYVEQQVDKDEDRVKVGGLEVKLWEVSYTEFSYLYLYEDRKIHVFSAPFLVIVAPGLLVSSFAFIVLNIQGEASKDL

SEQ ID NO: 925926 - protein, 135 aa, Homo sapiens
MSSLILNIEAMRLELFVPSSELVVLLASGVKLQTFPVSVTAHKGGVDRKSEHQDLLRRAKEESFHDLEGDPSGSPAAFTSQWHFLRDFAAPSPGTLAAQRELDTRSSPAGVCLLHRVQGPQSPHPPGTCAGPPEA

SEQ ID NO: 925927 - protein, 142 aa, Homo sapiens
MAIPYLYGSTASSILAPHTPQKKEFEGHKAEGETEASFRAGEKVEMFLFKLALQGQGYFRRSLALLRACYGLNASPEVAVSDRIKHIQDHGTWGVFPPQRGKLEADGCLNFSVSLPKSGYLKVAARTFQCHCNGCLQLLTIE

SEQ ID NO: 925928 - protein, 212 aa, Homo sapiens
MAKRGQGTAQAVASEDTSPKPWQLPCGVEPVGAQKSRFDVWEPLPRFQRMYENTCMSRQNFAAEEEPSWRTSARAVWKGNVGLEPSHKVPIEALPSGTVKRGPLSSRPQNGRSTDSLHQVPGKATNTQCQPMTTSTMGAVPCKATRTELPKAVGAHLLQHCALGVRYGVKGDHFGTLRFNECFIGFWTCMGTIVLISYPDEEVHSSCKGTIT

SEQ ID NO: 925929 - protein, 168 aa, Homo sapiens
MSPKGRCSTFCHHLANLCFGRSQFFTHKLLETGWYQCELPPICCNFWLSKMKTTLRTSHWTLVFKCGRKVFLILTKAGSHTLEREEDIERFKEGCVEMEAKIGVMLPQAKECQEPPEAGKSMEEFFSTRALRGGSFRIEKWVSGFSKHSRKGCISPFSHCHKELRETR

SEQ ID NO: 925930 - protein, 143 aa, Homo sapiens [sequence omitted]

SEQ ID NO: 925931 - protein, 140 aa, Homo sapiens
MVGSGQILDLSLKVDSIDVADGLDVCFERKRGVKDGTRTSGETEFSFLRRDLQVLDMASQRSRPVYCANEDLDAQQNFRMHKRNHQRWNSQLLLECSHGLLPVSVLTTMKYNQWIPPSPLTSRGVISDPDFKPAILTSSP

SEQ ID NO: 925932 - protein, 136 aa, Homo sapiens
MKPVHGLQVSYLKKSLKKPLRKGCGFKAQRWSTSQSGDTCGDTPVIGDTWSFKLRLFLHFQCAPCLHVQSLWLHPLFLNRQTKCILRLLVRLNGEKSVIRNGDFALDIPNLLPHLKYILSCCVVLYINNTYKASKS

SEQ ID NO: 925933 - protein, 145 aa, Homo sapiens
MTTQNFHLKVTNSKDQRKNQHKKAENSKIHNASSPKGHNSSPAREQDWMENEYDKLTEVGFRRWVITNSSKLKEHVLTQCKEAKNLDKRQLRKKHPSSLHLFTFATSLLILSEPFSHQIIIKGFKLQVESLENKQEGFDIITHAH

SEQ ID NO: 925934 - protein, 136 aa, Homo sapiens
MLSAVDPSCWSYKAELTLTSSLKGRAPLGFTGSKATPKFLFKHIKVWKPNRESVVLEAVLARCPELGPQLSSLGPPFKAERVTVLKSMGLTGSLKWDSRPEITSFPWNLIPKEDKLLCYFHPNGNSEGHKTYLENT

SEQ ID NO: 925935 - protein, 174 aa, Homo sapiens [sequence omitted]

SEQ ID NO: 925936 - protein, 176 aa, Homo sapiens
MGNLHLGTHFSLSKASRQEHLSLLKLCPQLPLPQGALSQGDGSFIYKPLTGAAAFLSEMPCPDRRILKRQSGYSGFAKLQCSLFELSGVFVYTVRRKPPTQASVMVDTPPPTKLEHPRSTSHCCAGSKNFKPMGLSFLGSMGMGSTEQNCLAPWLQPPFQGSEWFCLTGIPGVTGV

SEQ ID NO: 925937 - protein, 161 aa, Homo sapiens
MWQPPGLGWFFHVKGHPIQLQACWLGTQHSTVFKFVLLEGDRGGSAPRQAAEASSGPGLSIWDLFDDSRPPLLNPMLWPVPGFPGLCPGTCFHTPIALHPRAQANSMPFPPVLVSYDYITNHLQISWPKTTEPFICLRFGGLTRSQGAELTSVHVRSAGTA

SEQ ID NO: 925938 - protein, 136 aa, Homo sapiens
MWSLQRPYLQGQDCVLRPLGSWCNAGDSSSSDGALKPKWSILVKMLPDLSKTIKAVTLQVCKNPSVTGLRMPPKADTVYITTRKSFQVSGKTSQEGLLKMSPDSKDYNKYLTLECPDTEEHLSISTIQEKMTSPKN

SEQ ID NO: 925939 - protein, 118 aa, Homo sapiens
MMKFEGISSTQHPFTLFVALISDSIKQPIGSQPPLLPSPGLIRMQVTAPEFKLLPLKKAYFDTVITVLERCFTLEYKTLIKLKFFHEIMKINSLSKLASTNSQGASAFSQPGLAKGCM

SEQ ID NO: 925940 - protein, 130 aa, Homo sapiens
MKQACVLESGWHWPESCTDGAHDSIGAKDVLWLTRPFMQQSGSANPEESFVEGENPFTTQVFFQCSRILFSKFQCLHFTVLGFLQLGLSIKSVLLPGQSDRTTGIQMPFGTRNKDESPNMFHFCHRVAPD

SEQ ID NO: 925941 - protein, 160 aa, Homo sapiens
MCDGVSNIEQPLHKHVSNGKPLDKYTQGLFKPHLVKTTTWFTENGRHLYYKRVLHTVREPSSKIPYRTGATGAATRISSFLFTKAPQPPASCAVSKGRDRAADRNLESSMQHSKGSGQTWGRLGGVVPSILDTPFSWEAFDMPRYPASKDRAPVLRGKDS

SEQ ID NO: 925942 - protein, 153 aa, Homo sapiens
MCSDSNAGNLVQEEMLMPAPLWTVSGQPWGHLLHLGTFLVVTTREGDRGWCAPGTLWVEARGTAKPPTVRRTAPPQIMTQAKIPTVQSLRALAYMNVDSEAHSLLYQNQPRIACVRCRPPQSLSWKQVPEMGLGKYEPKRLNLRDEDGQCLLT

SEQ ID NO: 925943 - protein, 135 aa, Homo sapiens
MEIFGLGDIWNNGVAQRTLRHTCTDIFNPCHHQAPLDFVCCGTIKLLKLEDRINSDNNSGCYSLIIYFVPVPQSGVGVGGGGDCQAEGWRGGTLQAQNPCLGRKTSRNAYFHMLGGVYPQDRPEGQQQLPVDPFM

SEQ ID NO: 925944 - protein, 157 aa, Homo sapiens
MSRDLPVPSAFGLCQPVVLGHSIPPGASVQSPFPRDPKPAPLVEAKLVGAQLRASDHSQWKDRSSPVQPFFLLDTSAEANTLEAERGVWLLCSLRYPQLLGNSCFAVGAHQRPKSKEMYAIPSPIDFQLSCVTSLSGRRIPSSPTCLLSDVPGVDSR

SEQ ID NO: 925945 - protein, 237 aa, Homo sapiens
MGDTDAKPGLKKHASCFRVESHHQEGPTELSAQSGWEVKVWARPRGELNAGGCSSFRAPLIQLTLGDSALEMTVPWGDNAFEVTVPWGHFTVAEGEGEARPPRGSAVCRLPGPEQTVPLNQCFRQQGIFQLPHLAPVGEDEEGGGVPSVVHPQHRALQLTVVQEAVAGLLLHHGHPHSAVLIYKELLWAGGTATRTSSSQRTENGLGVTLLAACGSGESTLDAGILESTLRKPNPTH

SEQ ID NO: 925946 - protein, 239 aa, Homo sapiens
MARAQVLSRKKLDQGPQRMEASRWWLLVTVLMAGAHCVALVDQEASDLIHSGPQDSSPGPALPCHKISVSNIDFAFKLYRQLALNAPGENILFSPVSISLALAMLSWGAPVASRTQLLEGLGFTLTVVPEEEIQEGFWDLLIRLRGQGPRLLLTMDQRRFSGLGARANQSLEEAQKHIDEYTEQQTQGKLGAWEKDLGSETTAVLVNHMLLRESQNPGSNHSLAPPITASGKCPLLTWI

SEQ ID NO: 925947 - protein, 174 aa, Homo sapiens
MYIIRAWGCVHMVQMLLESLLEGPWVLYLRQLSPKALWLKDGKSQCPWSQGTFLLFRELLLCRSPGLLSLTASLGPCHALNPTKGNPPVCPEFPPWIRQQLAQFFQGSSGSACELVVLLLSPFQSLPFSGPCAVSFCICSILSVFLYSLPVTYDENHRMPAPEPPLYSNVVIIK

SEQ ID NO: 925948 - protein, 486 aa, Homo sapiens
MFSPLRCQPDIRQGAGEGDGASSGGNISSGGEGGGGGESGGGCNGDISSGGDGGGGSGESGDSCNDDNSSGGDGGAGVGGGNEGGGDGAARGGDGGNNSCDGDGGGESGGGGGDDGDDGTVVVMKVVVVMEVVVVVMVMLVEVVVVVMVLAGVVVLVIMEVVVVMVMMELEVVMQVVVMVVVVVTVVIIIGEVMVVVVVVTVVIIVMVVTVGDGEDGGGGDGGSGGDSGDNICGGDGGGGDGGGAGDGVDGAGGGDDGDDGGDGDGGGDGDDNSCDGGGDGSDGGGGGDGDDNSCGDGGGDGGGGDGGDGDGGGDGDDNSCGDGGGDGGDGGGGDGGGGDGIDNNWGGGSHGGDYSYGDDSGGDGEAGDGGAGDGDDRAGGGDSGDNSCGGDGGSGYGGGGDGGGGDGVNNNWGSGSDGGNYSYGDDSGGDGEAGDGGAGDGDDGGSGGDSGDNSCGGDGVDGGGGCDDGAVTEQIFTLIILNNYS

SEQ ID NO: 925949 - protein, 151 aa, Homo sapiens
MSYMVAGKRACAGELPFIKPSDLMRLIHNHENGIGNTCPHDSITSHWVPPMTCRDYGSYNSKWDLSEDTAKPYQGGTQAMYLAFILLVDATESWGRLKAPRHCLWAQGHVVAERATDVHDRKVSSGISLQLILSPNRFPSPPPDFTSVINS

SEQ ID NO: 925950 - protein, 130 aa, Homo sapiens
MGGFVRIADSAFFYFILSALGTNVATVALGYLVLTEHILAPGSGKLHMKAKHVAMTLGSNQSRKVLIKIVSGNVMTHKEAIERNYTLQEGRLRTLLCTVTDLTRHFQDATTFYTWPLNNMGVRGTNPPCS

SEQ ID NO: 925951 - protein, 124 aa, Homo sapiens
MILAVDLSLIALILLRYVPSIPSLLRVFFFLHLLRQSCGFVIGSVYVVDYVYCFVYVEPALHPRDEVDLILVDKLFDVLLDLVCQYFIEDFRIDVHQRYRPEIFFFRCVSARFWYQVFPSFQPW

SEQ ID NO: 925952 - protein, 131 aa, Homo sapiens
MATPSVCLKRVQTHCGTKMKLAADKPHTRPEAQRFLRQPCTGSQLQPNPTLHMALDDLLRASFTCEEPLKEAASPSGCDGRTHRQEGRQNTSPPSSLFAGSLSEVAFLTPTPCLSTYWTYWLLGDDWELYL

SEQ ID NO: 925953 - protein, 138 aa, Homo sapiens
MATQHTTGQVTKGPLPRSCPQWKETDLCYIRLYGLSLWRAKGPSPCLNVERPSGNPSSRALVGSAGLSVAAASEFNFAFCPILLQDNGGGIMKASPQGELKPEPAVQRQKLHFILMSKKQAGGQKWGQAKRVGSQGTG

SEQ ID NO: 925954 - protein, 120 aa, Homo sapiens
MVVVMVRLTMVVMVILVMEVMVVLKVKMLVVIVMVVIWWWRCGGDGGDDGGDDGDSGNEDGVAMIVMVMAAVVAMMVVNIYTKNARGKPTIPPTVHHALCKALSVTEISLSLLSVVTLRS

SEQ ID NO: 925955 - protein, 249 aa, Homo sapiens
MAFQTKGIAAGGNTESQHSWSCRQKGPKEFIECVSHIRLLSWLLLGSLTHNAVCPNASSPCLPIPLDAGSHVADHLIVILIGFPEQSKEEDLRCCCYDYELLGTSVLHMCSLFHAFIFAQLWTVYCEQSAVATNLQNQNEFSFTAILTALEFWSRVTPSILQLMAHNKVASKPEKSLTFSSWLIGTYAPQSSNPVLLNVDGYQERGCSRAHWKMSGMVEMVCLHVISLMEALQECNSTIFVKVGKPYDF

SEQ ID NO: 925956 - protein, 143 aa, Homo sapiens
MEIRSHLLTPKEFIECVSHIRLLSWLLLGSLTHNAVCPNASSPCLPIPLDAGSHVADHLIVILIGFPEQSKLWTVYCEQSAVATNLQNQNEFSFTAILTALEFWSRVTPSILQLMAHNKVISVVRLYKWIGDMLPYKLDVLLA

SEQ ID NO: 925957 - protein, 148 aa, Homo sapiens
MEFRHRRKRSLLGQVDEDEDTRSVPGLNWVQQHISRIQNRDRNTAGAQDMLVECLPFPDPKQLCVRYQVCTVDKVRTVNKVCAVNKLRAVNIVRAVNKVYAVNKVHTVNKVHAVNKVCSVSEVCAVKVCAVKVRAVDKVCTVNSVCCQ

SEQ ID NO: 925958 - protein, 118 aa, Homo sapiens
MLHHHQTWWSMFLRKMEEEIPGRSWWLMPAIPAVLEAKARELLEPVLPDQPEQHAAQMEKNINDFLFVSSNTEDNEFPIFAMMNFHIISCKTNQDILILGRQGQAIGTVRGHFRRCKA

SEQ ID NO: 925959 - protein, 165 aa, Homo sapiens
MILNVAVAAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQQPTTGLCWQVVRLTWWAVCRDSVYYTISVIVLIVFIYDEQIVW

SEQ ID NO: 925960 - protein, 153 aa, Homo sapiens
MMMTMMMMMMTMMMMMMMAATTGSGSLQRPTPEGTCLVISSPPSPATVSAPVPRVPPPPDSTTLSPRTPQPPLHWHGKACEGGDDKQEPILEDLDRNRLRTALLATKEVALKGRHPTMKLHRRTPGQRILLCAPAVPPAGLLTGEPLESLNVT

SEQ ID NO: 925961 - protein, 154 aa, Homo sapiens
MRCRVYPGPGFSAFGFGISPLQFEADGCWSRGHTLRSTGPRDAMMTVTALKQQKFVSGSGFWSTKRCTSSCPQLENSVSFGHYPDNIRNCESSNRAIANRFSPSDSVLKADSLANSYYRMKIFQAKTVLLWVMHVSSHRVIQAERILIPQAAGK

SEQ ID NO: 925962 - protein, 314 aa, Homo sapiens
MNSLEIKLQNPMEIGRAPVSAVNHLGGIRMGLGEVPCTTAFFDLNSKCVLQLSPFSGAGLDIPIQIGRFGPPDMPSLIDFAPEKVLYPKVSLSKPSLSMLVSLAPFGSPAHVATQVFLPEGEALGDQGARIEPGLKNLGNIKFPVSRSVTTHIRFFGFSRQKPGSHPSSSIFCCPKPSSNQPVTPVNSISYISSRFGLQLVEPLKENEKGHICVLGKICSGSPVKNGLENNESGKKMVRDLNGKHQGKGPINEGMSAIREATRGAEAPGDPQQQEAITILRPEGQGEGVVLVEPRWKTGCGKDPAATIPKRIAQ

SEQ ID NO: 925963 - protein, 257 aa, Homo sapiens
MRMKFSERCLAASDRICHRFFLHKRERINARDCLSPGYPQRSSACQSTLWRFLPFLSHIPTPCQALNGLDDASHVGEGESSLLSLLIQIIISSGNTLTEGHRKLEAASESVVYTNLRRAPKGMKERTVEFPDKKKKGRTNLQVPTVVVTGVDARYIQLSAFCDISPVGLGPTSMTSLDLNYLFKDSISKYSHIVRPPSEKSQTQSHAPSLPTHCLTPTAALQLLWRASSMICGSACQNADFQVLLINSGGAALESEF

SEQ ID NO: 925964 - protein, 139 aa, Homo sapiens
MTGEPLWAGALGSPLGSLSFTENSKQLRSPVSSPWKPAAGSRHTDGNKQHLAGTEKAESCESQHRNSSHASAPPILNACLGDLRGLPCIPVLGSGTWAISEEDPESLQKGPLGLLALSLCSRKYPVESILAVFSTHEQP

SEQ ID NO: 925965 - protein, 140 aa, Homo sapiens
MACKMLKATRLPGLLLPWQSDKSVEFKILLKKAIWRGHGMFRRLCEVRGQQEKGENALPTSRCLQLQGRSGSCQRTRGRHGPETRNRSEQTREEKGGREGHCLLSPRGVIFLQVAVARAGAEGSSVSQDLSVDWTGDLIF

SEQ ID NO: 925966 - protein, 199 aa, Homo sapiens [sequence omitted]

SEQ ID NO: 925967 - protein, 236 aa, Homo sapiens
MLAKVVSAKEAAHPGGRYPVPCHVCPQVTHNQENVFDLQWLELPDVAPEELEALSRSMVLHLRRLIDQRDECTEVRPRLIVDLTQERDYLQAQHPPSPIKSSSADSTPSPTSSLSSEDKQHLAVELADTKARLRRVRQELEDKTEQLVDTRHEVDQLVLELQKVKQENIQLAADARSARAYRDELDSLREKANRVERLELELTRCKEKLHDVDFYKARMEVGSLAVRPLDGAAGNS

SEQ ID NO: 925968 - protein, 145 aa, Homo sapiens
MGEGQAGIGVFPGRLLPVPGVIGSASTCPRVESLIKQCWGVGSGLMGLYLKRKLVGELFTISRNWLSLGSAVLLRAEGLRCPSTIVKKIKDMANTGRKEKRAREIKNLSMTSMGPIFEDTELTKSVCVTLGRVENKAGLELKDLR

SEQ ID NO: 925969 - protein, 169 aa, Homo sapiens
MEDILIINFKTSMVKIQLMKTSESEHKQEYILNIYNYPLGIKIPQCFTSIILEGGFHSASHLSQTFIEILRMQRDACGCIKQLENLAGDIEGKTEKDIKIDPWKLYALTSEIRLKKLIKGRNPEKQSNKQTNKLISVFTGPEKLGCVLKDSQGLVEKSIQGLCKVGIEQ

SEQ ID NO: 925970 - protein, 166 aa, Homo sapiens
MRTHTICTTKLTFLTLPCKSIEGKLTNRKHIHTKTPSVRHHHQRPKVDKTTKMGKEHSRKAENCKNQRAFPPPEECSSSPAREQSWMENDFDELREEGFRRSNFSQLKEEVQTHDKQAKNLEKRLDEWLTRITSVEKSLHDLMELKTMARDLRDKCISFKFHIQPK

SEQ ID NO: 925971 - protein, 148 aa, Homo sapiens
MDDSAALERSCVFYEAGYEPEARENFANRDAVLSRIPEHKSDRLISLQSASVVYDLLTIALGRRGQYEMLSEVQLLSLVDIQVVGGSCTVTPGKRWALIKARDTARSKVWPLLTSCPQPGAARQLERAFTNCVVSDHPTKTVDVVGER

SEQ ID NO: 925972 - protein, 192 aa, Homo sapiens
MQNAVRSRYRKEVTKRSQVTPSETGNKAQSGHAIGNRNNHQKQVTKRSQVTPSETGNKTQSGHTIRNNHQKQKQPSKQVTKCSRVMPSETGNEAHSGHTVGNREKDVEIGKIVTLPQRNLAGHHLHQSMKVSIPSDESCEYQVPPDMMGQTQTDELSTKYLTNTPQNYQEHEKEKSKKLTKTREAHEDIAKY

SEQ ID NO: 925973 - protein, 148 aa, Homo sapiens
METDCVSCDDECVGVLLNDLDEIGDAVLSLNLTGIIPVPYGIVSNLENTTKYLQESLLKENMQKDLGKIKLEGVAEETDNLQKKLTRMLASTQKVNRATERIFKESQDLAIAIERLQMSITEHATEWYIFARNHADKRLHTVAPKCHP

SEQ ID NO: 925974 - protein, 235 aa, Homo sapiens
MGPSLVAVKQTSSGPADIVVVPESVTSFGENVKGLCLRPLVCKKAPVTGPAQGSRQPGLLRPRKHGDNIGDSAVSGDGPGATVCPIPGSCLSEGSREPHVAIHRPHDIKHRPEVVVMVGEFSQVSWRQLGIKDKTVPQFPPLGGGGGSRSPEWATVSRTASIEDWCIRWHWLRQGKEDFAQDRHDSKSCWTVPEPETYRGAVAYTGMRSQQVDSREQPPRPLGLQGREVELSGDS

SEQ ID NO: 925975 - protein, 125 aa, Homo sapiens
MRSLGQLQSLQDAAPWTALTLDTKCKLEGFSAIILQFDNSLEKLTESCYRGIPEEGIITIGDDSSISVAAPEEFSVGEKVEVEEDTAFQSFKAQARDPQVRKRGSSSDTHENIRTSALSPLPLTI

SEQ ID NO: 925976 - protein, 155 aa, Homo sapiens
MKYDLGSNIWDTFTVGICARKEALLHTQPGSVSVYPVELSTNFSPSSVDSAPPRVCNGNTEEGYKPRDAEDIRENTCKHPISRKPHCVSSSQNTNTKLSFRNGQGILLRPASGEKGKEKNNISWLDLAKWPNRNSSSLQLPARPMQKAGDFCISN

SEQ ID NO: 925977 - protein, 200 aa, Homo sapiens
MDAEIGFTTWGPTVCMHLQPGVPPFRISQVAVTDTEFQPLPQRVPLGKLDAARPQRPLPGRSVLIVNRRAGERSGTRQELRVPAFVDSPFLPLWLRPTLRPLKGRGWCLSSPGVLRHSVLDTGSVSCQFSDIPTKLYLRHGASGRELTDTILENEGKGPKAESITLASPCSERRCNDHFILVSSFGPHNDPERVGAPQCP

SEQ ID NO: 925978 - protein, 137 aa, Homo sapiens
MVNNWPCVLIQSVIGFGLSPSPFPFSSWVRWLLIIGNYLEKWAISNSPSSWNGYISPDDLESGKSKIKNPEDAVSGGERAHEADWSLVFGAGPTITTPDRQESHRSNRAPPSNTVVLKVKLPTHELLRDTFKPHQPL

SEQ ID NO: 925979 - protein, 126 aa, Homo sapiens
MALYINVLLFLLETAGFDVSLSPLPNMSFCKMQMSKSVDFPEYPPSSNYIRGYNHPCGFVCSPMEENPAYSKLVMFVQTEMRGKLSPSIIEKTMPSNLVNFILNAKDGIKAHRTPSRRGFHHNSHS

SEQ ID NO: 925980 - protein, 137 aa, Homo sapiens
MELVKSDLFHCLSYNFEIAVSERTRSRHWHWQIWEQEEGGEGEGGEREGEGEEEGGEEGGGGGGGEEEEEEEEEEEEEEEEEEEEEEERRRRRKEKEKMQKFSTKFSNTNEISKAKRYVYSHAHHSTIHNRQGMELT

SEQ ID NO: 925981 - protein, 228 aa, Homo sapiens
MGATLLELSTHQAWYNSAEAMMWATGHLRLSYKQAWPDCGPGRGQQTKRCSEENLGKTLLDIGLGNTFTTKTSKAQATKTKRDKWHLIKLKSFCTAKEIINSEQSAEWEKIFSNYASNKGLISRNYKELKQLNNNDKSSSLKNSLLTLIPPSSTIPFLNFLLSQSLPEDFLYRLPLKLFPVTLKFILIRSLLTHHHYSDTITFKVIYDVCITKSYHFCFYLTGPISCI

SEQ ID NO: 925982 - protein, 141 aa, Homo sapiens
MQPFNRKVRLRKRSLQRIFIFASGSVYGDIGLRKDPLHGAISEMWEICLNPTDVLQVCPETMHYQFQNGLNNVLFFGLRGPIKEHLPTSTTHSAHLVNDFLCGGFPKNLAGTGQKTDKSFQRCPSELPPVPYLLGHNQCNL

SEQ ID NO: 925983 - protein, 151 aa, Homo sapiens
MVYTDNSGIKSPSNRNDKIKDLKNCSSEMLGVTDSKWQGGDLSLGHSRPVLGPLYCLYYENIPQIIQPGKPEYQSFLVFYPGMQTMKPWLISERRRKREDVDSGSCLGPCNEALQPPLLPKVIPQFTVPIELQRAQDIGNYQSKFCKTVTF

SEQ ID NO: 925984 - protein, 130 aa, Homo sapiens
MPFIAEGSRIERCDFACALHDSPVKHTEETAGGQRLAEVAAGPGIQGCMCHPWAPCMGSCRFRGKLQFPSCAPKGMLHLLQFAFDRKTLPPSAPHTHTLSLVFQRCLDKEAWALQLGLVLLSVSLASKPQ

SEQ ID NO: 925985 - protein, 118 aa, Homo sapiens
MRRPSFQIVLLMMGGAFMTSSHYPSGTSRPLRMRTARRKATTRGEGMQDCKTPEGQILSSEEARTEVAADQYGFTTTNSKHQSYWSKGPLYVGINPPNLTNYVCNDPISNKRIDTRIG

SEQ ID NO: 925986 - protein, 136 aa, Homo sapiens
MPRLFSITWSIRSICHGVLLKPGLCPVKSSNPRGKSRSLLLQYREFPGPILIGPAWVTFPYFDLSSGVRLVLGFCRAVSRVFRNMIGIPTTNPESTGAGANQQELGQISRNWGKAVFQRKGLLMMQTPTVYHDGLF

SEQ ID NO: 925987 - protein, 301 aa, Homo sapiens
MGARQSRASSKDKGPKRMLFTGRRQKFSPWDDALLSGRDPRSLLKRGMHHVSFSLVTRGMTDIPDFLWGLSEVQKLNLSHNQLRVLPPEVGKLTRIVVLNLCGNRLKSLPREVSLLQCLKVLFVNMNCLTEVPAELSLCRKLEVLSLSHNCLSQLPACFADLSRLRKLNLSNNFFAHIPMCVFSLKELIFLHVGSNRLENIAESIQHLASLQIFIAEGNNIHSFPRSLCLVTSLELLNLNNNDIQTLPSELHLLCRLVRIAWNPMDKGLHISHNPLSKPLPELVEGGLEMLFGYLKDKKHT

SEQ ID NO: 925988 - protein, 149 aa, Homo sapiens
MFNGINFSLTGTGHIIGNRTMPQHSWSLEVYQGDEHTDGYGSVLRAVWEHRRRRCRLSIPVLQQIDGWCHFPAEQMGFDGTEEALKVVPRESDHRAIVLKAGTMNKDLDPVVALICIHGQPESAHSGALIGFAVAPIPSLNQALDRAVA

SEQ ID NO: 925989 - protein, 143 aa, Homo sapiens
MLQNINPLPEPLIPGETRGITCIGSNGSLYTLQTLLLLPAYGAQWKLHAFNILTRMSLIKDWANGSTQSAKLQAVISALDSSEFLPNWEDVKASKSAPKYAEGEKNSLMCYFSQMLKNQVKYVGIKVGEGCINFSGSFSHHHL

SEQ ID NO: 925990 - protein, 225 aa, Homo sapiens
MRAGNAQKPAASPRTPLSSFATESTKETPFCEWLFLDAHLWLYSKVLRLSTSLWTASSTCTALQQRISVPSAGEQGTDVSTSKQHCLTVHQTQLHLPGPLRKELAESHLTRVSPFLGNLQSVTQQGEGIKAQPFGHFGPTQDNTEGDLCSRPPLLAWCPSAKPILSSKLQSSFYFQRTRPPSSRGASKDNEVSEWRQALREPLGARSSDLVISASTAIAWECLQT

SEQ ID NO: 925991 - protein, 154 aa, Homo sapiens
MNSHILMKITEPFPVTASLAAILSLQRTDTRISQRKSHNVLLNYLVEDMSSCQTAQPHSFPEWEREASDSVFMKNTCQTRWYCAGSPLTVSSACYAMPLMGVWGTWGLSPGGEVVLSLADGCHILLIGFSCQFFQTHLVVMARFLFNQEKNEPA

SEQ ID NO: 925992 - protein, 136 aa, Homo sapiens
METEHILSKQIVLKLSDIRGPVLRQEGSRTPFMGLRQLPPRPLSERRPAEKTTKIRVGEGALEGALLGRKFKGSMCSNHLPVTPLTTLERVTNPSFSLWQQDACLHKSLAGVEITGQAQSYLEIRKLSSHPALLLF

SEQ ID NO: 925993 - protein, 138 aa, Homo sapiens
MIGVHSKMKIKKIFSSHEEQEGRKRRRRIGGGRRGERRRRRKRRRKRRKEEEEEEEKEEEEEEEEKEEEEEEEKEEEEEEKKEEREEEEEEEQEEEEEEKKEEEKEEGGGGRGGEGGRGGRGGGRGGEGDDGGISQIS

SEQ ID NO: 925994 - protein, 134 aa, Homo sapiens
MQKAVYAVYQCPICGTVSPIARIHGSGNQGVEVEVAPLTITPSDPLAKFLLPVPVTLHSAGLEVLVSEGGMLPPGDITMIPLNWQTKPHQQAARGKMRQADVLFLGRKSTYGELEGKRTLCSWLQRCGVEFPHY

SEQ ID NO: 925995 - protein, 150 aa, Homo sapiens
MAMMIFWCNWPEAKTAAYDGEQATCEPVLKAMFLADTHLLREFLGHWLDKLRREWQVERAFQTALWLLQPEVVFILEDVFDEGKWSTSEAWVDDVEQFRKMFRHPSHVQLKVVAGNHDTGFHYETNTYEVERFEKVFISESLFSWKGLTS

SEQ ID NO: 925996 - protein, 123 aa, Homo sapiens
MGGACYYPPSEDYFCQFIKLILRPVLFPCWQGVVILWRRRGILVFGIFSVFALVFPHLRGCIYLWSLMLVTFGWGFCVDVLFVDVDAIPFCFMLSHTDFKNTFGRCDPRVTQKSICGIHSSLW

SEQ ID NO: 925997 - protein, 155 aa, Homo sapiens
MLVTLSPRRVIDRFIRYKWRWFSRVGKGRGDSKDSISVLQSWHSSDLRGKPILKRLLWKFWSQLQLFWQVGLWKTNSNDPEKSVKNIDPSRAWTSRNEISRALVSEMLLGCRAQQFEDTETQTQTRRGTQNDRGGNWSDAATNQGMPRIDNNHQK

SEQ ID NO: 925998 - protein, 167 aa, Homo sapiens [sequence omitted]

SEQ ID NO: 925999 - protein, 146 aa, Homo sapiens
MLLFQMYVNFSGGGVGAFLFLFCFSKTFGESWPPTGPDYSGWNGLLRSCGNPCAFDWACRCWVEEPGSTARVGQGRGVCEGFVLRTSAKSESLRAELHISIFTKLPSGSNVQPGCILGSKLVGSNERFILQLLVQLSCLLKFPLVT

SEQ ID NO: 926000 - protein, 143 aa, Homo sapiens [sequence omitted]

SEQ ID NO: 926001 - protein, 147 aa, Homo sapiens
MVLVVLFLLVRFLSSPKRDWHSAPFAYLGSPGGVYLGSWKEEKEQGKQMKKKHLVRLECVVPRSRMKKIANILNTAEKSRKFAVKATGARKDKRLGQKCSSFWADQEYFELNDKDEEQHKKIRWNKSLLETFLCKCNKRHVNNRMIV

SEQ ID NO: 926002 - protein, 126 aa, Homo sapiens
MSFIGQNRYEISLFFFTWRRQLAAKRVTRKRGILEVEGDFPSHYFDGETILDYLMGLIIDKGSYIRKSQCDNGSRFEDAVQLALKMEDGATSQGLLAASKLEENNKPRKRNKRYNTWNQRRKTDIH

SEQ ID NO: 926003 - protein, 134 aa, Homo sapiens
MLLMKTRHPEPLSRFSGVQREQRCTLKETPFLQPLYHSPQFVELGDFLHTVQEKEKRNLKNPFERHPIWESLLPVPPSGVHTTWHIRVFALLPSPPLQVDDCSEAEPSQCSFVFPAPGIAPDELGTSNLFRNES

SEQ ID NO: 926004 - protein, 185 aa, Homo sapiens
MPLYGLFLLSGCQNPTYSSRDLLKGFDLKADNDMDNEVQAKVVLDGNEELVGNWNKGHSCYALAKRLAAFYPCPRDLWNFELERGDLGYLVEEISKQQSIQEEAEHKSLENLQPDNVIENKNPYSEEKFKPAAEIGIKGASPNPWQLPHGVGLQVCRRQKLRFRNLHLDFRGCMEKCGRLVTVTT

SEQ ID NO: 926005 - protein, 141 aa, Homo sapiens
MGETALVIQLSPTSSLPQHMGIMGATIQDEMWAHCCLIELRAPNSLINILPIAFDVSLEQKLANFFSEEIQAEITKLVNGIGTETEDFKSQIMCSFSCSLEDANKRGIIAEVNLQHSCSKQTKACDVSTLPRMACILELIY

SEQ ID NO: 926006 - protein, 136 aa, Homo sapiens
MCVFKQSSPDAFPKGSTVLPACSNVRRALSSHLAQQWMLRSFNVFLIYQGKLEKEKEKDVPRYLLVFGFLVKVLYEHSEMWKWSLINVGAVTRAIKFSPHDDVFSIKEAAEIICWSQDCTASKLQSWDSSSVGQIL

SEQ ID NO: 926007 - protein, 167 aa, Homo sapiens
MANADTLEDLVSFHHRKDMISDIRFSPGKLLQVNTGAKEQLFFEAPRGKKQTIPSVEGKFGKFKRYVAHSTHVTNVRWTYDDSMLVTLGGTDMSLMVWTNEMEGYREKRPCDSEESDIDSEEDGGYDSDVTRENEISYTIRALSTNIRPMLGIKPHLQQKEPSIDER

SEQ ID NO: 926008 - protein, 248 aa, Homo sapiens
MTQRGECHRMKQVETGLTRLQARATGNHEKLGEKQPGSSPSPDTRSSGALILDLPDSRTVLHTSTPETVQLLSFSVRPQMAWSSEERPYEDGSKKAAVCKPQKETSPETSPGTLIWDFQLPDLCENGCPATSLTQGCFLDPGIVIAGLEGEERDKKTKMMPGYPAPGDLGLSSLQQTLQQSSQAEEVSLSLEGDSGWRSSCPGNHTLQEAGLILGDGEQEVMVVVVFEVVLHSTPGVTVTVMVTVKQG

SEQ ID NO: 926009 - protein, 136 aa, Homo sapiens
MKEYCANFQENVNDDWLNWNKYRKTPKCLHPSWRQVFHSQSGTGQKEILLYSSKSKLGKHSRWQIECVFLPLPAVPGKKNWGRKSGFFPTTSPMLECWYPPRKKTIPTATKRAPLIAYQTLIQVLSLIHLILQSTL

SEQ ID NO: 926010 - protein, 171 aa, Homo sapiens
MLMGQFIPGVTTPYANSSAGWQDDPQHDMDTRCITRWAGQAAVAVKKASARCGEEERSSHDLTRRNVGGHAQPSAHGVLHTEPRNRLWLLPDHMVHGLTGDLEQGPLYQGSPSPGPQTGTGPWAVRTGCTAGGEQRVSEHYHPSSISRQISDGTRLSQQCEPYCELDMRGI

SEQ ID NO: 926011 - protein, 190 aa, Homo sapiens
MWSEGDLHLMSNLLSFLGLGQFLMLWSYAGEILLLATRIPGSRPTQVTGRMQGESSNNVATGKKDEEWKKKKKEERKKKEERRKKKEEGRKKKEEGRRRWKKKKKEEEGRRKKMEEEEEEEEKEEEGEETKHASSRGAECSIKGKIHQKPARMLPKTIIINKNNMAEMQKKEAKCAHLRKSPSLFRSFQI

SEQ ID NO: 926012 - protein, 158 aa, Homo sapiens
MCECPNPESSRLSPMSLDKSLIGEVFQEQSLFTHRPIPSVRKSAAAAKREHVSSYCHLSVGVICSIGAEFPEIEERRGHRTQLFPQSTQHKDREDKDLYDDPLPLNDYKNRPSLDTCLSRESQYLWDSGLFANSHLIFSKVFVFKERFAFDGLLILRC

SEQ ID NO: 926013 - protein, 157 aa, Homo sapiens
MAGGYIIFPAGSFLCTCLLLGVHGKTMMADGRLSAGGQQCTAKRSAVTFRDSNPMGKSGDKWNLLHRRTVLMAYSQVAKCGHLNVTSTTGIFFMKPPVFLDSCPLSPSSRSVAAISASYVTSPLPLSHLAPSYKNPCDYIVSTQIIQDNLSASSFLV

SEQ ID NO: 926014 - protein, 140 aa, Homo sapiens
MTVFVDQAAFTFKVGSRVLNGKQHKSLENLQPDNVIENKIPFSEEKFRPAAEICVSHEELNVNHPDNRENVSRSRNLVPCMSPAPAVTKRVQGTAQSVALEGTSLKPWQVPCGVEPASKQKSRIGVWAPPPRFHRMYGKA

SEQ ID NO: 926015 - protein, 180 aa, Homo sapiens
MSEPDPIVLIYGTFMETWSFQLIVQPPVTAKGLGKWEIKPDIEKHKEENTHPMKWESFLTPPAGRATEVWLVLFGRHVRSNPLCDREYADGQVQELGQYPGVGVCNFQSLNGCMLQCALLALPSMDVLSVRQFSGPSAFSQGQRASMTAFCILSSCPAHWGQLYNLISPEMAPEESTEQT

SEQ ID NO: 926016 - protein, 138 aa, Homo sapiens
MDKLFSGDFCDFSVPVTRAVYAVPKRNPLLLGKLKEILDSLMLQQTDRAAPRGMELVIPGEESQYELLGWWDRRVTGRENGTSVQTIPAPLTLAAVPAKTQFMHLYRSTQSLLSCGSKFPDPPVSSSDTSNCRNLLRG

SEQ ID NO: 926017 - protein, 160 aa, Homo sapiens
MVNIECQLDWIEGCKVLFLDLSAGFTGEVGFRLNPRSFPDEVIENGNHGSIENGAKSIFKTVSYERSRGAISLPDTPKAPWQCRETFVVVTRVGGVTGILQVEAMGAARALNQYFLYRNSENERYGKTGEWLKSKTVTAANAGKDVEQQKHSYVAGGNAK

SEQ ID NO: 926018 - protein, 157 aa, Homo sapiens
MSREKSAVVAEPSWGTSARAVQKGNVRLEPPHEVPTGVLPRRAVRTGPPSSSPQNDVPSVVGGGGDKLLYLSQRLEENKTTAGAEKFLGFYDGEMENGQKKEQSVEGELKGLARCVLNQLKQERAEGRTKSFSAKVGGSNWGECDEEQEGLVEGREA

SEQ ID NO: 926019 - protein, 259 aa, Homo sapiens
MLMEDSEHIPWEKATFKSSPIPESGVVFGLTSSNPNHDPSSPNTKGSRNEKMALLTLQLLAPPRQLVQEGNEGYSLLFNHAGFFVALVHAKCKLKKYLSAHHLAKKAEQDFLHSDNLIGRFPERHSDFSRGISTATRHRPPACFTSDFRDNDRVVSSLATVGPKSLKAGTPGRQQGPGLAAQPVNSVSLSVQVGVRPPENSAYNNCFGLDDTDCRRTTQAAPPTHRLRIFHLAQGCLLIHDLGEKSIQHGRYKYGMHFS

SEQ ID NO: 926020 - protein, 172 aa, Homo sapiens
MCSVGNGNSSGGIICSQTVHTDVGGGCDGLGGELTGLQVVHVRVLCKDFRSTVSLILTISPRDQGIATPLIGESNAVFTTESSALPNTVPVHIKTIDIFKHVEHELLNKPPLLFVIGGCFRNGYEEKEVSLFPVSAGANYYKFSGLKNYCLKFLEVRSLKLVSWDKSQGVSR

SEQ ID NO: 926021 - protein, 144 aa, Homo sapiens
MPKIMLFVYCLCQSTWTSLFTSLSAFWSKSFNKYLGSSKHSHIFLSSSELSKLFQSLPVTQFQCCFHIFKCLYSSALLSVVKFLKIELLNSYEAICHRDLSRCNCVSWLSSLGRAIVLMSDAGAWSLKDKQSGRENVYDANGVT

SEQ ID NO: 926022 - protein, 158 aa, Homo sapiens
MSIDLQVVMALEKMLLWKPCCPWKDVLTSSAASQGDSLLHPALLVPGFLSGVRKESGHADVKDGNADVNKDRKNIYTRENNPYKDPMLKDCTEKISMESNGNKRGGAKCGWRHRRNHTAKAFGPSEVLLYGKCSRASVKGQSHYHCCFGPKPALTSLT

SEQ ID NO: 926023 - protein, 152 aa, Homo sapiens
MIANHGCLSLLNLLEGIPGLIQQSVQQQCNSEVSNGAVLQYNLDVISVVQPRNSVSVLMSLKIPSILLEFCEYSKIANQEGDGLKVTALYEVLQVRQITNGVPGTARLPLPDVLACCFQVCSSSEKHQKHTGGFKNVRAYIKPSNLEVQWEN

SEQ ID NO: 926024 - protein, 182 aa, Homo sapiens
MVQLSQDVLILGLVSDPAEGSYTLSADPRRGILKTNSASPEVEELGPGSATAMHQLCDLEKIKGFESQLSSLQNWDNNILYTYMVYSKGSQQRKAAQASHSWTCDHRRKDQGQCSGGLFRSSTEIEFELWRSSTLKMKKTKRQGTIVEHLLKGEHCALHTQLHLILSITLEGDILMLRELKS

SEQ ID NO: 926025 - protein, 166 aa, Homo sapiens
MICWGHSHLVTAFSKRWTEVKTKLGDVKSQSQNIQEPKQVESCTKKQNPKKVTRDVSGTSRVGKLKRNYQRHFESKHQTIGLRTHPLLCVQQLHGLGGPTKKLPVASNGIMCFPWGEKPLRPWRSGNLDCHKPLGMGMRAHSSRMDEPEEELICTSKVSSGCNHQE

SEQ ID NO: 926026 - protein, 149 aa, Homo sapiens
MSSYANADCFWVLLTSTLLLVPHILNVWSHLDSVHVVTKGYIWEMKSSCSQTSRSRKSRALIWALSEQENQDISSVRNRIEEEEERKDCEEERKKDCEEEEERRKKKKKKKKKKKKKKKKKKKKKKKKRKERRTAKPKSWCPHLFEFTF

SEQ ID NO: 926027 - protein, 186 aa, Homo sapiens
MNSGPKVGSVPRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMHGGCRTVVHCESIVYNMRCLMLSLFDHLLETSEMLRTWSQGLEIGCSAVAPFFFQFLPLLL

SEQ ID NO: 926028 - protein, 147 aa, Homo sapiens
MIEGRVNEDVVVKKLGFAGGSVLGPSSAKTWMRLLHEDPHVRSSRIPFTTVSSEPRQASDGKKSCSRRPLDTWSHLITFGSGQASDLYFLCMLETCEGEAALMILTHHSLEEEEREALRPDPYLFSGAPAYHAVKKCSRECNMYSWN

SEQ ID NO: 926029 - protein, 336 aa, Homo sapiens
MLGCPLEPEPTHDPHDSTGTGPSAALGTCKEWVSAWGQSTGPFKWGALQGTLAGPKGLAAPHFPICQEKRLDASAQLQSSWAFCHCLLSGHIPPTTHDGVPEDVHVQIPDTRDEDYDRDLNSAKSRSRLDSNRKCGGSGGRGGRVPAEAAWTATGSAVALVGVVAEYQQKPRGQQPEVPWLWTLGCRSQTRLLGRVVAFCLPPVGIIEILLPSFRSAPFCDGKEGHHFYHQEIPAVGHSAAPAMQKLTQACSSYSSVHSCHWPAEPVTGPSQECDTAKPEHREDTTLAQACWVLTSACRGAGGGWQTLLTNGKAQLPMAFPLCPCNTFCGECVDTA

SEQ ID NO: 926030 - protein, 147 aa, Homo sapiens
MEEGLSLPVPLIGSWSLLLWHASYCSIHLIITFTSSLIASPQHTKVLTWLTLNNAHFPYLHFGSQDKKAEMVKTKTHKRNETFISGIKDPSRKGDLVVCSLAVLLWWLQPSLLATCSESTAPMGSFTLSCVWVAVWGPPGSPGALSY

SEQ ID NO: 926031 - protein, 233 aa, Homo sapiens
MVWISEAHVRELSAGGNRCPYPICFSRTWEPQAKSEHLHIIATSSFTRFTVSHQMLEIQGTRSDMGGLSKALALFNSVKAEKGEQDAEEKLETSRGLFITKVQDKAASADVEAAASYPDLTKILDEVGHTKPQIFSMESTGEDAVNVVEMTKKNLEYYINLLDKAAAGLRGLTPISKEVPLGIKCHQIASHATEKSFMKGRVNRCLAAINIKTRSSTGKDYNLLKAQMIISIF

SEQ ID NO: 926032 - protein, 145 aa, Homo sapiens
MNIEDFRWKLGFIPVVQRTTAVLLENAGTGHQLRYKFRKRDFQENPSYSTEVHISNMTPQECLPRTGQQCSVCACVRVCVCVPVCACITLKKDYGLFMTPGISSFPENSVWLTLADVFVLRARLDCCAVRLGSASSIEVCLHVMG

SEQ ID NO: 926033 - protein, 133 aa, Homo sapiens
MVLLYTTSLNPDSTGSVMRVKLSSGHSPSVGTIGFDAFYEGVEFLVSPASRMGLEKEQEVGNRELERREGKSCHIGERVKKEEKTYVLIKRKNSHEYVRTVERSCFLDVWFRHLIFREMTLLANINFRYEAFI

SEQ ID NO: 926034 - protein, 208 aa, Homo sapiens
MSNVCLIFIQRGIANASFMLKVLLVAAANCYIGIWTKKTPVDVTECKCHKAGTVSGTGECRQGDGDCHCKSHVGGDSCDTCEDGYFALEKSNYFGCQGITAAVSWLSGCQCDIGGALSSMCSGPSGVCQCREHVVGKVCQRPENNYYFPDLHHMKYEIEDGSTPNGRDLRFGFDPLAFPEFSWRGYAQMTSVQVCLFPSFTSYSVLVD

SEQ ID NO: 926035 - protein, 145 aa, Homo sapiens
MEACLYHTEGAQGSHLHDLCRPSSPVILASSSNLSDDASLAISLASFFSFCLQTKKMCGVSCVLSLPLTLWVTSGPVSAVKHVHIKTDLFYFVPSLPCPLTKECDAAHPNTSGPDSLRHGKHPPMPRCCYKTFGQEPHCHGDKFS

SEQ ID NO: 926036 - protein, 137 aa, Homo sapiens
MSLLAPSTPSAKPDPSTTVIHDHPQWPLVNDLHSGGSVTDVLPGFTAFLSVFPAIATEMGLSQECVTQGPGLASARCQLQVPGLQYFSSALLQVGGSHSPLLMFIICYNGSQNSGHTFLPIAVYYKEYDKGYRATAR

SEQ ID NO: 926037 - protein, 139 aa, Homo sapiens
MDPVMVNTECQLDWIEGRKLLTRGVSARRKRERESMRDTAETRPECLTRATKVGKAGGRRFPLWHIFNDLAKYHVVPKEAASHKFANPFPGKSASNDWSLDKFKGPDISVGEFRKTIPLQSSRQVAFVTTVIVLTGSIQ

SEQ ID NO: 926038 - protein, 148 aa, Homo sapiens
MLPHHRASRAKSEARASSELKLQVQAPTNRWGANALPAGGTILLTLGTSWNSTRCTAATSLSHGSSREQVQYITSAARWSPTTGANGCSPRRIAFQTWVGGEHSPYVTPSLARGKANREPAGRAPCQAGLSRASQVDLENTAPSGGKS

SEQ ID NO: 926039 - protein, 147 aa, Homo sapiens [sequence omitted]

SEQ ID NO: 926040 - protein, 141 aa, Homo sapiens
MGSVTTVLSPARVRGSLQNRLGSTKRHATRRALADGGHAACREAPLARLLIEPWAPGKHDLHLDGTGQTFMCRAGDGKCDFPHTHLPPAYLPGVSLAVYPGGKQNGFGEQVESTLHLKIKFQVEIMSFQNLEDIVSSFSSI

SEQ ID NO: 926041 - protein, 151 aa, Homo sapiens
MLPEDGLAFTRASPTQLPWSPYWCPPRIPMVGSLESHESFKVETPSQMRLRELCPQNCQEMQRGWLCRWRKGLQAEAGGGLWKPEKERNGFSLRDFNCWYRERHSFPARHCSLGHEEQSTQWGEFRFLCMWRAAIRMSPVSCMVLPLPTNG

SEQ ID NO: 926042 - protein, 278 aa, Homo sapiens
MDPMRKPRRDRGERQPQAWLGREHGALQGQLWALRGRSGPGGARGWLGSQVCWQPWQPSLTLGASSAWAPTLAALEEPFSPLLHCGSPFLGWPRPQPAVSACGEVWRERCGQEPGLRTALVGQREFRVGVGSVGPVLRAASQPRCPWTDLQPTMPEPPPPRHGLLRGQSFPDECHPLVHGPQSHDPPRAEEYGCMVWDWQAAPPVALVRDPLRLLQGGRTFPKAEETGERRSRLIAGAALARLLTGLQDPWVGSRLRHPGGAGPGDERVMRKGNKKKM

SEQ ID NO: 926043 - protein, 127 aa, Homo sapiens
MRCDLPLRDICQCLQTVWLSTQGAAGPGEAAEKLPYWAPLSMWPQSLPRWTPLWGTQTAHLLTQEATVEVAGPHQVLFDLFESKFEIAKVHDKCNRIPPYALRYDIQISILCPLPPEANSPLRPARA

SEQ ID NO: 926044 - protein, 142 aa, Homo sapiens
MLIAASEKNVRIGEMMSLKPKGVPLSRTCLVSSKAEAEQIVQLGPSAAGMLEFAGGPLHTLFAWVTPAEAAERQRLLPVSSSGSFVPEGHPPDAKMPCQERRNLERESGHSGIAELWWALPSLNFLAAFTLDMDEIGNHHSQ

SEQ ID NO: 926045 - protein, 138 aa, Homo sapiens
MKVRQGLNDDLGLTLRNKGSHSDKRNPHAVKSSKMLQTPTSQYPEGTESMAEASSSVSATTTGLQVVLPGYCQCSLKAQGLFSQLMANVVRPETHPSGMWVPIWPRAGLEMLSKSLAWYSKIQKWARALPHGVYERRK

SEQ ID NO: 926046 - protein, 345 aa, Homo sapiens
MAVAHPDAKRLIPCGSPGVLLRRPLPGPRDYAERRSLPFIDPPGPTSSSIQRTPRLPGQLCGQSRSNLRRLLPQALSVGGAPRAQSKSTPAGHRQRHYSCSWDNILAPGVPRPVGPCETSGAVRSYENLLGREVRERERIPRSLVPPVVVNLSTSPRRYAPLSLSETSLRRRAARVRAERNWYVMPEITITDNDLHATERAPGPGTLPGACTRPLPHAAPDGPTSGRQRTPRAAGRAHHGPGHRLATPRRPPQSRSPLPGPPTAPTAGLAARAPGPRAGAATLAPSLHRHHPGARAPGEAADMSPEPSADEDDLMTCSSARCWHTETMFNACLYVNFCHSCYTYY

SEQ ID NO: 926047 - protein, 141 aa, Homo sapiens
MRHHSDVLTALHWACANGHAEVVTLLVDRKCQLDVLDGENRTTLMKALQCQREACANILIDSGADPNIVDVYGNTAVHYAVNSENLSVVAKLLSCGTDIKVKNKGADPPMQLKICFIGKSVSFDSSKTLQHSTVDLEPEKR

SEQ ID NO: 926048 - protein, 139 aa, Homo sapiens
MKPECAVQQDRCQSWAELDWWGLRGAFALCQHWVFRRGASAARDGACWNELGILREDLKQRVCSRRLSESTASLSAFLAWEEDLCCAYATCEERLAQGLCNTPQSCELPLNSFVTMAVSLRAVFFKVCGGVKYVSYSGS

SEQ ID NO: 926049 - protein, 159 aa, Homo sapiens
MENESDELTEVGFRRWVITNSSELKEHALTQCKEAKNLEKRLDKLLTRIISLEKNINELMELKSTARELQIEDQLNEIKCEDKIREKRIKRNEQSLQEIWDYVKRANPCLIVVPESDGDNGTKLENTLRILSRRTSPIQQDRPTFKFRKYREDQKDTPQ

SEQ ID NO: 926050 - protein, 159 aa, Homo sapiens
MDYQQLLETFGTPTILAHLGNMYVHVLDQVAVQLRDVRELPPDAWATLISTCQVTSVILSLFSLEFLVTIRAICACEFSVSPVAVYKAHGGGYPVRKLGHSRCQPRGNIPEWGRTQTKICKTASRQGPRQADPVANWGVPRHGDRIAPHRLSSATIRPC

SEQ ID NO: 926051 - protein, 158 aa, Homo sapiens
MFNMEAPSSLFVNHVCNKEAGKMVLARCTLPTSYICTRQRAERSKLSKHSFKGTSQIHETGALMTSSNPNHLPEAPPPNTITLLQPTGFISGRFYGANVQLPTPELPVLTLGNLYWAQTLFSGSLKLRIHCSGGCKVLAERWSLHSNGWCQPKSFIVQ

SEQ ID NO: 926052 - protein, 143 aa, Homo sapiens
MRCKSSDLAYLATTQDGPGCGFSLNEWSFPNIEKVTFLLPVAVCTSDLWSADRTEALSRQSSEDSTQSRRKVQCPALHPPHVTTSRLHDLVGQFPHPVQEELYYHPVRKFVRITALLMLSFESKRGPFTYPKNLPAFAHIVSI

SEQ ID NO: 926053 - protein, 141 aa, Homo sapiens
MSLPHQKVQKLPDERKELPVPVIQKDASVNVHDQEGKVTGRTLRRLLPSVVQGRIGVALDLRQWRHQWKVEKGWIGCKLHRGALRSRYESELKRRGLHLRIKIVYQCGDPEEECSRQREEHACFWHTISFIQKNHSAVQHP

SEQ ID NO: 926054 - protein, 284 aa, Homo sapiens
MAGPCRVLNGVRSLPVPIKLWCLAADLKGADAGNGIRVFVPDIGMFIASLTIWLLCRNIVQKPVTDEAAQRSHGSIYCLLESFGIYHRLVNFESMTDFIPPESSSHIPGHQPQGQIEVLFRCRDSLQLQQARLPVSKHARSFLARNADRQGDGIDLERQSGLRGSSTSRRAISVFPPGGGQSACVAGQLQAEGEKIDSEEALIYEEDFNGGDGVEGELEESTKLKMFRRLASVASKLKEFIGNMITTAGKVVVTILLGSSGECLPHWLHVAKGTSSALVNERNG

SEQ ID NO: 926055 - protein, 230 aa, Homo sapiens
MPSHRCHQDQAIIAMPPQQCHQDQAITAMPPQRCHQDQAITAMPPHQCHEDHDTTAMPPQRCHQDHDTTAMPPQQCHQDHDTTAMPPHQCHQDHDTTATPPQQCHQDHDTTAMPPHQCHQDHDTTAMPPQRCHQDQAITAMPPQRCHQDHDTTAMPPQRCHQDHDTTAPLPHPHDHIIITRDREIAQPIREHKYQGESENSTFRDRLDRRRQELSVDAVSEDSNSKDVLN

SEQ ID NO: 926056 - protein, 187 aa, Homo sapiens
MRLRERRKEGEQRGPGRRGTQKKCVEGWVGGGKKHRGALGTMDRTWAFTLRAASTFQWGQQKAGSMVSRGAFEECRFGSWMNNQGWKVNQTGQCEESLGSAGGPAHVCGQEMCHSSDGLKEWLQWDGPTSPSLAFQPLNRRAPPLPPPLSPPHRIPLPPPPTPLIFPLLQLPFHTQQQPVIFQKIGT

SEQ ID NO: 926057 - protein, 205 aa, Homo sapiens
MGLPPAVPHFSDLLPQSENNPISFPSSSDYVFRLNTSTSFPVSPVHGQQVGETLPENQALKCSFPDSVMSTDSSKDRSDALNDSMGIKCIFKKYKFTIIALKYSKTPSTGGRGEEEHEVCSRFWNVPKATVITFLPAHHGEGPADQCKTLYMSFIVSSEVLNIFGVVCGFSHSAQTLPLSPTGSKLKSLSRRYYYSKIDTLMGRR

SEQ ID NO: 926058 - protein, 221 aa, Homo sapiens
MQEWHRGEFLDSPQGRGLQQYRNANRHKESPGRRKEQPTQTENLDSTHSTPATTHAKHCCPSPSTQARWGPRLSPPPGSNKPSVTSKPEQYQRNQLQQKVPEKSVITDLLKPTSVNLSKSFSLQLCSVAGEELRSFGGEEVLWFLEFFSFSALVYWILMEVHSRPCLPEYHQQRLQNSKYCCLILPLEALSQRGTQLYEVSSRPLLGDASQLGYTGGQGPT

SEQ ID NO: 926059 - protein, 153 aa, Homo sapiens
MVLEAKPWLQVSFILYRPEIYDGVFPLQKFPGISPGPKADRTQAQTVQPGPHDRNSPPEGGRESLDKAVCVQGEERLKDSDRRSTHPEALTTFHHDRHKPGTAALGFSEGALKSKSAPRIRAALCPSLRCSGITPTLRGNPNFPGDFQRAGKM

SEQ ID NO: 926060 - protein, 143 aa, Homo sapiens
MSCSSGPQRAGSFSPAPPNAPPIPHCSLQVEVDSLPELQHKPPAGPVGNVRQVDENSQDPESAKWPMPMERDARTYCSPPQWRKVTPLLDLTSGFSLEHHPLDSLIMKLLSPPAPRLWEVRSIHHKSFSHFSACKMSVISYEI

SEQ ID NO: 926061 - protein, 142 aa, Homo sapiens
MSPTFKFLPLPRRQPAETHPYLNSAFNTFHLNLVHSTKLLSPPKCGSTYNVPEGSVEEENRQSYQNPASCQSNGPPLSTPWNVAPPSGSLQPDSAASEISAQQVFTDYQPYTRHYARPLQWGTEPNTVQQKQYSMMLVGTDF

SEQ ID NO: 926062 - protein, 142 aa, Homo sapiens
MYCQVVMALWRNTGQGKGRGSEGEWSGKASMAKGRWSRDLKEVREWSLPQCPRARGGDMPVCVPQHSSMTGTALGPVVHSIVTIVVTPICFPWPLEPRGGKDVSCYSRNLRSGAKRSIRHLQAIGTCLWIKRMNECLNMGKK

SEQ ID NO: 926063 - protein, 134 aa, Homo sapiens
MHWQYLVLSDFQHQRSRTMWMPGDEERQVKIRGGKTLKTNSVTPREKPGNEPEEVKLQNASKQIVQNAILQAVQQVSQESQRREERISDNRDHIQLGVGELTKKHEKNIGRISKMLPVKQTEVSPAPSCRMNSH

SEQ ID NO: 926064 - protein, 257 aa, Homo sapiens
MVPDPYMRSSSGQITHVSGDLNLVFKQQLHSLRRRAGPMGAFRGSGSLARPTSPLPVQQGPWDSLALLWLAQGTASKKARPQKSWMWIEHLDQEELSLEEYGRNTATENLEHAEYSSISVLKAAEYESVITRETMAPGQEMCMKYNAAESSISPKCSNGFRTSPGAKVGSGRRRCFLDERGEAGRCPARGLGPSWKTMKSSAAIGTQHQKPREERNTNATHVTLDHLTCTSKMLTFGPTPKSVGYGPVVLHFQQAVQ

SEQ ID NO: 926065 - protein, 150 aa, Homo sapiens
MKILRLIEGRVLDNVTQLVLKFKCSMAAYKSVKFKSSKLGNGERKITARQRELIQEDLSMKHNSRWVTQNKEPQIALTTFVELQKEVKGQERCPPGSKMMGTGPAHTSIQVYIQQEIQSTPPTAQTNTINNDVLFLKNAKQADKCSQPKK

SEQ ID NO: 926066 - protein, 154 aa, Homo sapiens
MSESLKTREADSAALSLQPKAQGPQGRCWHKFQSQRLKILESDVQGQEEWKEANILHVKKKEPEDSACKFISSSPAFFVPAALVANWMMPTHIEEEKFIKHGAQCQCLNIYVLITLSGKEGEKKGERKKQEKARATGQGVVQSSFYLEFYLASY

SEQ ID NO: 926067 - protein, 140 aa, Homo sapiens
MNSETDALSFLDHPSLLVRPEVLMEPLAPATSLELEKASVSNTLDGSSKLDWLPQDHLGELYKETGFQVHPWKFSAKAVLMMLSLTSLGNNCFFQSFTFTAKNMKAPEEVTCPSFFGKPLLVMFDSVIQCCEHLASELIE

SEQ ID NO: 926068 - protein, 167 aa, Homo sapiens
MGVCCTHQRVIYIRVLPAEAVEQQRFLPVSSSGSFVPEGHQPDASQSSPVCGVCQPLLEGVSQSGGTGSQQARMLNLLKLHPQLPIPPGALSQGDGSFINKLLTGAPAFISELPCPERRNLEGQSGYSSFAILQWALSSLNFLVALFTLWGKTAYSSPSNGGRLSSH

SEQ ID NO: 926069 - protein, 151 aa, Homo sapiens
MYALNQHPMYDTVSPIARIHGSRNQGVEVEVAPLTITPSDPRTKFLLLVSVTLHSAGLDVLVPEGGMLPPGDITTIPLNWKLRLPPGHFGLLLPLVLPYPVIKVNGKLQQPNPGRTTNGLNSSGMKVYVTLPGKNQDLLKCLLKAKRIQNA

SEQ ID NO: 926070 - protein, 137 aa, Homo sapiens
MSPSAGSAWKCVMKKNKLKNTGNSKTWSVLLLPKKSTRSPVMVLNQFEMTDIKFRIWMAMKLIKIQKEVETQSKELKESSKIIQELKDKIPISRKKKPKIQKQHHTEWAKAETNPLEKWKKTRMTTVTTFSQHSAGK

SEQ ID NO: 926071 - protein, 174 aa, Homo sapiens
MAIIIKTIGMLKTLFMTLLKAISSSYSTPSSLLFPSSSSHCSTTAMQVTVAEKCVITNLLKPTSVNSSKLFSIQLCSIAGEELRSFEGEEALCQDPQLQFCWSLLEVHSRPYLPWYHQRRLQNSKYCRTANIAEQQILLNSKYCCLILPLEASSQRGAQPYQVSFCPYWEVSPS

SEQ ID NO: 926072 - protein, 136 aa, Homo sapiens
MVITEGGLICIAAGWTNPERVETSCSGVRLGKEVQRQMDHRMRMARKGKGPGGPSWVPSKGQHGKHSAPTQLAALGTNCHHFLSPGSLRVIFQKPNIETHTQIRTRPIYPIAQSKAVLSKLFQVMIHTENDGAIFV

SEQ ID NO: 926073 - protein, 157 aa, Homo sapiens
MHTSVTALFTVSLCWQYPEQIFLGVDPPVLSNRVATGHEMWQDKLRCAARIKYRLDFEDWGNKSQSLIQSRALTVFNSMKAERGEVAVEEKFEASRGCWFMRFKERNHLRNMKVQGKGASADGEAAASYPEDLAKIYFFSKGGYTKQIFNADKTAFY

SEQ ID NO: 926074 - protein, 169 aa, Homo sapiens [sequence omitted]

SEQ ID NO: 926075 - protein, 151 aa, Homo sapiens
MTPTLRALSMGEMGVSKIPGSCCNVRSPERHRVPACSGRRAILAVMFLREHNHHSHNKNNNQTVFLYDFVGTNQQPDRHEIDRWALCNHKHKLPPLLTNLTIASLFTAVLAHFNLPPSWTNYLDTPNRSRRFSSHGCGHAKRAGARPELSS

SEQ ID NO: 926076 - protein, 149 aa, Homo sapiens
MDFGSLPCKRQSTTDFSRTYLEREELKPAMNRRKPGFLETSPKPSNFSEFSEAPGGCLHFNGKSSESSGNYSQFYFLIERQKPWLSGVRVQDVQMTIGSKSNNWCPYKKATYRGTELNREEHHVITEAELGGMQLQSKEHQGLPATTIN

SEQ ID NO: 926077 - protein, 251 aa, Homo sapiens
MYLVTVLRNLLSILAVSSDSPLHTPMYFFLSNLCWPDIGFTSAMVPKMIVDTQSHSRVISHAGCLTQMSFLLLVACIEGMLLTVMAYDCFVAICRPLHYPIIVNPHLCVFFVLVSFFLSLLDSQLHSWIVLQLTIIKNVEISNLVCDPSQLLKLACSDSVINNIFIYFDSTMFGFLPISGIFLSYYKIVPSILRISSSDGKYKAFSTCGCHLAVVCWFYGTGIGLYLTSAGSPPPRNGVVASVMYAVVTPC

SEQ ID NO: 926078 - protein, 143 aa, Homo sapiens
MLPCIFLYYYALIIPGFRPFKSETASPEVEAAASYLEDLAKIIDEDGYAKQRIFNVDETAFYWKKMPSKTFTATEKKCENKALITAHLLMAWYTKYFKPSLHTYCSEKKIAFKILLLINNVSGHPRALVEMYKETNVFYVSDS

SEQ ID NO: 926079 - protein, 151 aa, Homo sapiens
MTSEGASPKPWQLTGGVGPMGVQNTRIEVWEPPSRFQRMYGNIWMSRQKFAAGVEFSQIAPARTLWKGNVGLETPQRVPTGALSSGAMRRGPPSSRPQNGRSTDSLHSVPGKATDTQHIPNIYFLVNALTLVLQTIDNGFSESATPGHTAP

SEQ ID NO: 926080 - protein, 138 aa, Homo sapiens
MKVTSTIGRPRDKRKHCQSHHVAQDGPGKWKCGDPWGAENRSSCCQIGIRPVLFFRKQFGDSCEDWLNGCDQNADRDVDSEVQADVLSDGNEEFIGNGSSVYPYRPRGLGRTNDLQGHAQGPAMSCSLRTLLPTSRML

SEQ ID NO: 926081 - protein, 139 aa, Homo sapiens
MFDLVTLQVMDAFQTSTTTHNNNVINCSQERVFYGNFQKEGSRSRRILQRVATEDETWLYGFNPEDKPQPNQWLPTGGSSPVKAKLNLPEQRTLNILSLSLLTCKVSAEKCADSPTEFSLYVFTCFSLAAFKILFVFNF

SEQ ID NO: 926082 - protein, 148 aa, Homo sapiens
MVVFTQEFQKNGEAPVCRISIHLVPGVVTSEKAGVNSVAAAEAGLHTVGDIFSDAQCTTQAQRSVPERWLDTHSELYSIEITFLGAKNRVTPMKTKTINKSYILHLKPVFMPTSSLKRPDTRLSEPPSHSNTQDLCDKLGRADISLTH

SEQ ID NO: 926083 - protein, 171 aa, Homo sapiens
MLVKVHLSLPTFLIIVAFCFSRSALVQEINYGVIPTLGAYPDSKGNFPCPNSSLFTWFLQLVLLISSRKALGSMRAKPGNRTAENVKIMSNFGVTDSTSEDIESAHVHIQKAGLLKTKILIGDAEITNNMFQRVCFSYGLLKTKTLTAVSSTSTQSEVTGALGNVGAFVLF

SEQ ID NO: 926084 - protein, 143 aa, Homo sapiens
MSERKTSILPSFKTEILQSKKRESIAKKYGSAELKPPSGDKNTAPALLTELELPVAFNLRKPQAKQTWHITFPTLISTLQFKGGKIITLLGELLELKPNSFGFCTQRLWGGGRWGGEQNTVLEREKRLFSGQLNSSFQKQAIV

SEQ ID NO: 926085 - protein, 144 aa, Homo sapiens
MFSSLIKDTTLEQGSLAPGPKTGPCPWSIRNQGAQQEPYECQQVYIGLCSWTYKPEDGAWNGLIHEVHCGQSSLFSPRGVGDKMVKAGLDRSICQSTNGRHKHQHQGRIQQATDPGEWVLQMSRICLSMKWRQPHCTMIYAQEE

SEQ ID NO: 926086 - protein, 135 aa, Homo sapiens
MQWRNLSSLQRSLFLWLPPSQTHGEYCQPIADVYLRPRGSSVSSWLMLLNLELTFQGKVVSQHNYYNWECVGSHMKPACLRVSPKAHGVLLLVLHGPRVLKLAGAKKIQDCTHLPLSLLWKVETTAFLALILFKW

SEQ ID NO: 926087 - protein, 157 aa, Homo sapiens
MRNSHNFQTLVFHKGTDTSISEQMYHCMSDGNERGRHRVQEETNAQKCKVTRPMAHNQATEGSKDKRWWEPESLTVNQGTAPPGILPADLVCICGLMSPREQDRIKETAAKKNTQLERKLTQPWKWHWSTDPRLKGLRRSLKESRLRAKWKVTLGLG

SEQ ID NO: 926088 - protein, 147 aa, Homo sapiens
MRGAQKATNVNKLSEVIQGKEESPAQFYERLYEAYHMYTPFDPDSPENQRMIHMALVHQSAEDMRRKLQKQTGLAGKNPSQLLEIASQVFVNRYAVSRKENGKEDGGQSRPHADLFVSCSNQRGPRKETRERGPWERNSAWLSEFAA

SEQ ID NO: 926089 - protein, 143 aa, Homo sapiens
MFVTLLANEFKGIDFSFKDSIFPNYTSLACSMAPTCLRPSTQNLGAVTLSDQGQSLYQWDKPTSCPSPVEKDERPRWPNREVREREMNLETAGWQGRFCRETLHPAAQLAQGQLALAHRANDVYNNQAAASSTPEELQALPVC

SEQ ID NO: 926090 - protein, 139 aa, Homo sapiens
MFALGFGSSVRHSLMDPLGFTPLTPQNREPCPVSPLETRFCLRGTQSPALSDDTTVPASYPDTASFLFPTAYPRGPQTQVGAPRAHPSGLVAGLAVFCPGEKTLYSALGCDVPDAVLSRATPLKVLGRCHMPYSLVPPP

SEQ ID NO: 926091 - protein, 258 aa, Homo sapiens
MKHTAAASHTPGGWEKALPGPPTTRSRGDRESQLLYSDLHHEFCSEAVVLTHCPQLVMEHDHVTRETLNGSQGSQGSHRIAKQKIELNHLTLSILPHQRLQNLPMEESGCSGRHSGCVVTKLTTAALECPSPLTENDRRQCLAESPFNLYLLKDPLHSEGCEIRYQLQRQRGEFGTCLEERGGTPAAAPTRCTDDWCALFHSPHSSKFPSGTGPTGHREIEKWIFEGWTAGQLCSEHVHHRIPAEPMLLPCGSQMLSD

SEQ ID NO: 926092 - protein, 159 aa, Homo sapiens
MSDANMGAPLRGEAARESGRAAGALEKELLAGSPARHLSHSHRCMEGNPISSAKDQVFVTLSVSSPPPPRTQGCGTPVGALHEEKEAGSRCSDGLEPLSGPLRRETPEAFPGPALRMNSSLFSDLGTRLVFGMLSCFVDIFVSPMGARHGASQISHVLP

SEQ ID NO: 926093 - protein, 154 aa, Homo sapiens
MGNLTAWHRCLWRAFVLYYNMVEGKDTWIQFNELVFNNDHLGGAWALALKRRRKQGFCPFGAIILLGIQDFHMVLAVNEWWLSNRGPCRSHLAALMLRGGDLQPQNWGALAKAACNHPECNLSETRRLTFFFTKTVFNGHQQSGPLISVSFESF

SEQ ID NO: 926094 - protein, 132 aa, Homo sapiens
MLLLLVPLNLTPFSLAYWCFLLAVYWDFSWGLSQTTYKWTLHVVWVSSQCGSWVPKKSTSKRTEWKHYPFFTSWPQNLHSITFAIGTGPLRCKDRDHKPCLFIGGVSMSAVRRVCGMRELVAAVLENTTCHG

SEQ ID NO: 926095 - protein, 246 aa, Homo sapiens
MITVITIIIIIIVITIITIITITIISITIITLITITIITITIIIITITIITIITVTIIIIIIIISIIITTIFTIITITIITIIITITITVITVIIITIIITITTITIIIITVSITTICTTIIIIIITITIITIIITIIIIITITSSPSITITITIIAMITIIITITIITIIPFSSSLSSLPLPLSPSPSSSPPSSPSLLPSSSSLPLSSYVIHTVLKLIGNIGQKIHGGGEIENKDSCLIRLMLTS

SEQ ID NO: 926096 - protein, 193 aa, Homo sapiens
MIDYITPSSMFYSLSSRCQGTQLADVSPNRNTSLRESSGNGTAYLVLSTLVTGILMFIFCLPGHNPGIFVLIASGGRHWFFTDSRGVVVDACEVLWMNDHLQDASTRMGDPWLQTPSFFRYGDSDQIHFAKVILLTHVRVSSCSLKGTYSEDRLLGALWCPGMVPWHPVCSSHLQVGAATTSKGKKTEKAETF

SEQ ID NO: 926097 - protein, 278 aa, Homo sapiens
MKFPPFWVIDKGVSPFMFRLRMPEPTGGVTCVPTFTRAHMSEPRLTLHFRTFILMHKARDEDWKTESDDDDTNDKRNKSAVQLWDSPHSNIAKGFTNGIEMSCNKPLVQTALVQIHRKDCSRKPAMKMALFRANTTELYTLPTKKEKCFTYVSIPRGPILLIFQIQAQCLEPMLGGNSECTVNLILGSGPCNAVLILWVGPPVPQELHSADIFADDQVKMRSIGWALIQYDCVLMERENVATGTDMRIGGRPCEDEGRDQGMLPHTKECPRVPAATRN

SEQ ID NO: 926098 - protein, 149 aa, Homo sapiens
MEGEVNQGFLLGLNPLLSNYRDCYQSSGSSHPASLPGSRLVLGVVCTESCDVNHLWVSQLWIPPPVRVDSKALSEKELSIQSVNQHKHISIKINTCGKSTADVCPRMRGKICESSRAYNIEVYGGQVALWAIWFLLQLFNSTAVAQKWL

SEQ ID NO: 926099 - protein, 126 aa, Homo sapiens
MAVLKFSSDNSNICIILVSVTIDYLFPFKLRFSWFLCSNTWSRIGRYFRSSGEVGSMAGYDQGMAGYDQGMPWEDRREGRATLSGSGKGVLEEETMLSDDKEQDCKLGMTCCAFLAFMQTLHSIYG

SEQ ID NO: 926100 - protein, 138 aa, Homo sapiens
MESPHRVPNRELPSGAVRRGPLSSRPQNVRSTESLHHAPGKATDTQCQPVKAARRGAVPCKATGAELPKAMQAHLLHQCALDVRHEVKGDHFRALRFDCSNGFQTCMGPVPPLFWPISPIWNRCIYPVPVSPSYPGSN

SEQ ID NO: 926101 - protein, 141 aa, Homo sapiens
MGSIFVSKNRIDTVEIQYERQKMTHLSWSWQDWKLLWMGQRRPCDEGSREWRMHFEDGGRSHRQKKVGAFWKLEKGIITNKFCTCSTQTQPSIRFLPSIFDSWLVESTDAEPRTHGYRWTAVYQFPTAAAPHKGPLGPADE

SEQ ID NO: 926102 - protein, 229 aa, Homo sapiens
MRLGRPRKGKGCGWRSGFLPHHSPRPKCPHKSFPNDLTPPSRLSPPRNRKDLQDSCDSQGDEAHEDLWLGEGALQRTSAQESWEGFRKECFTNEIISTVNCGHFCRGFTDLRRSASLKLPEEVSEAVFGHLSQFYQELDRTQWFKTKTMHSWSRCSDDQISGTSRQWSCKGPTLSYNQSFILVPTLNVPFLDSCTEDCETLFLPHEKKGSDQLAKPAMKRGSGKAASKP

SEQ ID NO: 926103 - protein, 134 aa, Homo sapiens
MLNVRENARGSRPHSGRWSVPESQQGCGEEDPAAERSAHGAGRLRRCLPGWPLSSARAPLEPRVPIAAPASPTGARRGRHGGIPNLECVQHTWVWTKDMFSTPESSLVPPPVGALPGGNHSSDLYALYSLGAPE

SEQ ID NO: 926104 - protein, 151 aa, Homo sapiens
MTLKGWALGRQEGLHAESTGLDGHQSKQQGLGRAQFWTLGEGGEMAAQGSAHGGSGIPAQERASLVDLSFPGLSFFTFVNAQWTKTSHMATPKLKESNKSPHLLLGEAASAVPEAFYAAVALRGFPADILVAPAEPHLLVEAPLQPVLSWT

SEQ ID NO: 926105 - protein, 170 aa, Homo sapiens
MRVGAAPVTLVKGGWAQGSGARVKESAEVKAPTTKGSRPKGTALPLPLCEDTGKVPSLNQKSGTSPDTESADAQPPERLYLLAATSILPHCRQQHCLQTLPDIPWEAKSPPVTVTGLVTPASFLRREPGWSPFRPSVVALLQSAVLPPRVLCQLLLCSDLSSDVASPQGN

SEQ ID NO: 926106 - protein, 137 aa, Homo sapiens
MTALLVHSTADGKCDENAPLYHGQFPVDPEEASVVDLGWADAVRIPSHFPIWLPLPWVWLGLPSLQGLCVVPGPGEPGYVAESCTHVLHQALLCIGVLSSYGLNHPNSPLPVIYINLVLFSTLSNIYIFLWPICSYR

SEQ ID NO: 926107 - protein, 137 aa, Homo sapiens [sequence omitted]

SEQ ID NO: 926108 - protein, 143 aa, Homo sapiens
MDSLFLLGYKPVQHVTVLNTAGNWAFPDFTLHLSLLPPVGGSNWGVLAGLVKKDVFASLSNMIEALAMIGGRDDGGWDPRVEMRNGKKKSNAGYKGGIFTFEILHNPENASPYFCYVPGKQIIQSRNNYGTTPQLPHFLLQRT

SEQ ID NO: 926109 - protein, 151 aa, Homo sapiens
MGPWAVPPMPTEGLSCGQARPWPIQHQPRSHEWNYIDDDSSSLNVQVTLMQELGSHGLGQLHPCGFAGYSPSPVCFHGLALSVCGFFRCTVQAVGGSTILGSGGQWPLTAPLGRKHAPEVDYVCAVGLGHTCTRFLTFTFEAYASCVPDGM

SEQ ID NO: 926110 - protein, 139 aa, Homo sapiens
MSQKFTGVVEFQMAVNKAGPVVTDNGNFILDWKFDQVHKWGEVNRAARMVPRVVDTGLFIHMAERAYFRMQDGSVNRREQPFWRAVSSSAGSEELRLKSPLPAGLMWTCAGCPRNLKGHMKEHWTFCRITAPLASTESQ

SEQ ID NO: 926111 - protein, 220 aa, Homo sapiens
MGAAVIQLENLNAMGVIGSQGDRDQVTALNRQRQVECSFQNGTWYAPTKLANTFFSICVHKAHLRHSAFSWQGRITPSLSYIRDISTRQLYVTIQFAGIFTAFPFHKISYCSIDNLMLIRPHDQEVETTVDLWWSPEQKALQQVPAAMQAALPLGPYDPADPMISKMSVADSDAVWSFWQGAVEESQQKFLGFWSKALPSSVDNYSFERALGQLLGLNRN

SEQ ID NO: 926112 - protein, 143 aa, Homo sapiens [sequence omitted]

SEQ ID NO: 926113 - protein, 200 aa, Homo sapiens
MSLGCCVHHFWRRGGESCNWHKKDTGHLSQSSGCQCGTGDYEVFQTAGEGGRVDYIVSESGPSAVGLLEFAGGPLQTLFAWMSPVEAAEQQILQNSKCCCLILPLEASSQRGTWLYEVSVGPYLEVPIGSGNGHLAGSGMQQTPCRIRRDGSQQRVCGGGGKQQWWMASESSARAVAIASSNAWVYIPIIVPPVVLSGDR

SEQ ID NO: 926114 - protein, 136 aa, Homo sapiens
MPMFVPTAAVWALLSFEKKEEVCYADSTILSQSDRHLWRQAKWLSFSAFVSHRHQMWAAQETCCFGRSHNDPLCQRHQANRNPRSRSDTNVLMALKQQTSSREWEKNLTDFMGPVVFMNLLVVVQESGACKNLLSK

SEQ ID NO: 926115 - protein, 153 aa, Homo sapiens
MDFGIFSQTTCLQALSRALFLGALLTWWWQEKMRKKQKRKPLINPSDLMRIIHYCENSMAEEQGSQSESQNLKSTKAESAAFSPWLKAQETLANHCCYGNNDRQYPNVNNFLIRVQNGSGDKSLEDKEHSGWPSEVDNDQLRAIIEADPLTTT

SEQ ID NO: 926116 - protein, 191 aa, Homo sapiens
MVCLYQSCENGLTQKVEHKSSENLQPDNAIEEKIPFSEEKFKSAAEICIYKEQPNVNLQDNGKNVSRACQKYSWQPFPSQAQRPKRKRWFNGPGPGSLCSLQPRDLVPCIPVTPYMGKKDQSKAWAVALESGSPRPLQLLYGVEPASAPKSKTEAWEPPPRFQRMYGNTWMSRQKFAARAGPSWKTSTWAV

SEQ ID NO: 926117 - protein, 196 aa, Homo sapiens
MLKHKEQTVRSSCDPGNRIGRCCLGQEPFNTIVCVKHIFSAQTIPKSPLAFISCLCTVSRSAKGEWLWIPSGLSQPGHSPAHAKSLKTFRKKSTALQSPLSQVKKLVQREGCHQPHQSSQQLSKSKSNNQPLDLPTPRPGSTFIKATPVEQWGQICKWIQGSHVGEAMGTVSAESFSSCSVKGSREMGSHHSGPAG

SEQ ID NO: 926118 - protein, 157 aa, Homo sapiens
MLVFLTPAAVNSDCLVKVVSARLFHWSFSKLDLTGLYNLNGCIKNIRDSWEEAKISTLTGVWKKLIPALMDDFVGFKILVEEVTADVVEVAGELKLKVKPGDVFELLQSHEYYINLAEKALAGYERIDFNFERSYLVKILKSIACIEKSFLKGRDNR

SEQ ID NO: 926119 - protein, 134 aa, Homo sapiens
MEVRSSGTDETLVSGECELKVTYQGVLGGSKDWDDLPTNQETPKSAGNYQKLGERCGADSPLQPLEGTLPVDSLSSAFWPPDLRVNQFLLFKPLSMWCSARAAPEMSTYVYILCEKIKYNVLHCTIFSEHIKMK

SEQ ID NO: 926120 - protein, 163 aa, Homo sapiens
MQPALCCTDISLTGCGVILLHTQQSGPWDLPLLTCHIVKLSLRRYLGYQLCSHLSADQRFLGKNDCCISPNRPIYSCTHITAKPKAFVGMSKDSTRCNVIKPKLACWKMRDPREQKGTAPAKAVLDQPAPADLQTGFRYVSQPRETNPAGTMIMDFQPTELRK

SEQ ID NO: 926121 - protein, 147 aa, Homo sapiens
MKRCYPSLAPKHPEEAVSPVEGTEVCAGKAEAGEAESPRSLAGWEGARRKQPRTQTPDRHSRKRGRYRSHGLHEWRRDALKSGGRGQEGQVDRQELVGKSDLLGASSRRRSREVLTTWEVTLVVCLVCGLGSLLVCWAQHRKQVRTS

SEQ ID NO: 926122 - protein, 136 aa, Homo sapiens
MTGFVDPAQPAGRDLHGSGKSPRAIRAEDQIRVLTRRLTGLKRESLLCNIIITIIINIRSSSINITTAASYGPLICAKLCAKHFACFILLNHDNNPVDTPFLYDVTFKQLVPEVQASGLPSNYFHCKISTDAQLLC

SEQ ID NO: 926123 - protein, 151 aa, Homo sapiens
MADSVDSYSFDLLSPSLQAELSLAVHHCCLPPSQTCCCLLSLQIQQGVHCADPVRQPLPLLIGLKACHCSYTAKCPGQRTQALPPSWKQPTTILEAAHHHLGSSGSKDPPVTVMLIKCGYLEILGLTCHYSCECFLLWEDASGFLVVLLIP

SEQ ID NO: 926124 - protein, 164 aa, Homo sapiens
MAVAVYKREKSGKCECFLYTHYHLKRTCSSGNQKKKPIRSQFGPQRGELKTSAGLLTLSPCGSSSPCANITMDWYHLWTRGRWSITSHCYGPYIVSSFQNTEGSMEKGNSPVQKPDRHHLSRVTRTISSVRIMRVFFANHKSNTSLVDSHHHCDSFDISLFESI

SEQ ID NO: 926125 - protein, 160 aa, Homo sapiens
MLKETGSQYLKVWGPFYYFQALPICFVLLKKRKHKTKLHGLETQKHRPLDSSLGQRAIIFFPMPQFPSLSQSKGPGRLPYPQQPLGPRHLPRRKSLLPLGSSLEVALEAALWLEAVSCGKHLHSVGQVTQGFHLITHGATCGPGALKFRALHSSAPMAVT

SEQ ID NO: 926126 - protein, 145 aa, Homo sapiens
MCLQAQSKALTLFDSVKPERGEDAAEETLETSRGWFMRSMEKSHLHNIKMQDEAASADGEAAASSPEDLTKNIDKDIATATLTFNNHYPDQSAAINIELPPSVREAFQEQRLQDILEAEVGSHSVSFLLHCVGQSWSQGQQRIKG

SEQ ID NO: 926127 - protein, 187 aa, Homo sapiens
MAQGEVLSSFLKQDPPLPGANCLCTVLRVMQPPLLKCSSVCIEIHLCDSHINYEAVQENPEINMNWDPQDPGGPCDEEGACHERDRRFHPLHHVARDPGNQLSLAAAPIENRATSGTVKCRSIGDPTDPPLAMDVRFASILGEAATCFPRLQGVLRDLLLRKSWRDCPPVRLASILSRFSSGHDRTK

SEQ ID NO: 926128 - protein, 190 aa, Homo sapiens
MYNDGAVLADTDAEKVEGKEISRHCKMQIEATIEFRATVMEEHEKYEEANHRDLKEAGLQTLGFLGKGVPITANVIKCKGPEELGRQIPEIARKPEDGMDEDEVYVGHGRKVGPSWGVTSPTVADGWLELRLLPDFSPTSALLPTCIPFLFSCRYILNLSQDLGMPYTDLGPTLDHVRVDAGSQPADEPA

SEQ ID NO: 926129 - protein, 148 aa, Homo sapiens
MRMDHNPANTLISDLFSAERRENRLLLFSATNFVVIGYDSPNPCSTLCLRKLSLLNHICKQLGVHQPAQFSQRGSPQDMGQMQHTGPYRNRTGEANMMHLRVICVIVCFSSWFLFTPRNIFFYGCSTVCLSIRQLKNIWIGSRWSDCE

SEQ ID NO: 926130 - protein, 192 aa, Homo sapiens
MVRCSKEKGQLGSSPGLTQHIGQGCKCHSKKLNPCYVKEAKCCNGEGPVYRNATEKSSYNKNEKISWRLRSSGVTQGRQFTQVLGQFTAARSRASTSLWAHNALLLTGKLLDMTPRFCDLLDHPYDTKTLNVKRQVQNKQMDTADSRRTQTLISYTKMKGYQEKKFLESAFMLKKISRFKWIQYVNLLKNFV

SEQ ID NO: 926131 - protein, 146 aa, Homo sapiens
MEEEVLKVCGGRKTVFLVMTKSFLTIMLNSNNDYSVWQNLLAQGHASIDAFSLTGNYENEVIIFQGAAAAPFPGVSPGPFTSGNVSSPTHGPIPLFSASFAGARLTIPLCRNEHRKGVMSPLYFLLDTLLSALDVCECRKTFLRRA

SEQ ID NO: 926132 - protein, 136 aa, Homo sapiens
MRNFPEGTRVNGFHEEPASTITFRNATCQPHLQSSKAWMAREDLGFPGISKRNEHSCPAQGILVTAFDVPDAGAQPVDAVLDRATPHVRPCPSKKQFDILSASSWPNDCSTAAKCTNEKSWQSVGVPHVPRAWEAH

SEQ ID NO: 926133 - protein, 142 aa, Homo sapiens
MICWAIEMYITIGLDWVIYKGKRFNWLTVSQGWGGLRTLTIVVEGEGEASTFFTRQQEREGQGKWPLIKLTDLHFVHGPTNAVLYHGTHTHQQVLPCSCMSVHTAGACCGSDFDPELSTHRRHDENSQGAIESCGFPMNEML

SEQ ID NO: 926134 - protein, 146 aa, Homo sapiens
MEDRDDKYTLRAVAEKQTMWFLDGWCSHHTQPAPGGELAGGSLLMVEGMTARDPLGRAASGQNSRLLLLLFLFLFEELLLAYLPKLKSKRGREQTVSNSLYCMRTKFKNVYTVAKISSTQHSKIQIYCIHQKGWPCNSRIIYPILR

SEQ ID NO: 926135 - protein, 145 aa, Homo sapiens
MACVDLVTTELGDSPGQPRKCLASWWPLQSPKKREQGSDVLLAQAPDPGWLGKPPLPGGSSIILLEKQNTKQNKEFNPGSPPLMAEGVEKWPNLRMCVTWASEHFLRALLPHTSSAAEPCCNELIAIVTLNTNSTGYFNGHIALN

SEQ ID NO: 926136 - protein, 188 aa, Homo sapiens
MLMLQVGRNCDSASRAGLNLEHGPPVGLHSIWTVPESLSIGASMLHSCGRSPSYIFTRVPEGNKDTFSKLCPLLLLLLLLYFAQLSKSISPPALYPGISQTVGILFCLLLGAIPTHCSFACCGQGLLVYGYSSNCSHESLAYSDFPSYGIWEALQIQEKRGSSDGRHCLVRTLISLGLKHEMFSVEIF

SEQ ID NO: 926137 - protein, 136 aa, Homo sapiens [sequence omitted]

SEQ ID NO: 926138 - protein, 147 aa, Homo sapiens
MFRKSQCNTAAHCYKQTEKTVMTWYLKKALPKREYESDRQTEPREFSFLQTAKLQKDAHQIIVRLENIQKSLSSAMCRIIKCNISMTSVVDNFQPCQKSDCVCSTSNKVKMNYASEGTAFESENLDFSIFKLQYDLRRNTFKEIAMD

SEQ ID NO: 926139 - protein, 191 aa, Homo sapiens
MVAIACILHRNSTVMRIRSGNSEGRTVMKSTRNTSSKCMHVDLQLEEPLPSKKVDSGEEMTSSPNRFWVTSAASFRNYSKVGSGGIGKNCFKVHMEPKRSLHRQVYPKLNCDLATALQPRQQREILCQEEGEEGEGGEEEEEEEEGEEGEGEGKEEEEEGEEEDEEKEKMKKRDLTDEDLRPTFPGFPRKQ

SEQ ID NO: 926140 - protein, 196 aa, Homo sapiens
MGRNQSRKAENSKNQSASSPPKERSSSPATEQSWTENDFDEWREEGFRRSVITNFSELKEDVRNHREEAKNLEERLDEWLTRINRIEKPLNDLMELKTMAQELRDTCTSFSSRFNQLKERVSVIEDQMNEMKQEEKFREERIKRNEQSLQEIWGYVKRPNLCLIGVPESDGENGTKLENTLQDIIQENFPNLIQPS

SEQ ID NO: 926141 - protein, 133 aa, Homo sapiens
MGLPCPLQCELHIVTSFQTIQNGKVEKPSNFTVEKPDKFHLRQVIKVNINSDKLCRYDIQLSWHPLLKRQDNFPIDLSWHLIFIFNATARGCKRKPKAKGNLGFINNHSQGVSASFLGQTCPLGTSTTPEHCH

SEQ ID NO: 926142 - protein, 136 aa, Homo sapiens
MYASGAGNCLFAGLAPTWGSLKTSTLRTCPLGAASPGKGPQYAQYDNNYVKVEYKTEICEFRTDISTIGNAYELSMGPLATTVLFSASRNVTALGISSILMDVRWYLIVASICISLAINDDCLTLKQFLEMPLNSC

SEQ ID NO: 926143 - protein, 245 aa, Homo sapiens
MEETYLISRKNLLLGPWFGVIIKIRAWDPRTGLSPGLEPTYHEGDDNTVTNVPVYTGLRGFPGRGPFGPQTRTFLEMAGHMTAASRGQGEYPWASGLAQVDNPCSTTQTTHKLPATPTSQSLFDCVVIGGTDVSSLNFSPLVKMELNIPTSSLSTRPCCPITIPENLQPFEICQEYSTDSTLQSPAKMPSIARGDKGMSINLVEDVKPGKGLEALHDTHFGSEEEVREKLGNGNKGKGEFERAYY

SEQ ID NO: 926144 - protein, 313 aa, Homo sapiens
MFFVECYQCKPLENDKSEIFKSSVELSTALPAHPIAIIWPIAGTTALIYTVVDETDVKTDAFRTVVWGSVFNGMLNDDNRRFETFEVNSFEQFCINYANEKLQQQFNSHVFKLEQEEYMKEQIPWTLIDFYDNQPCIDLIEAKLGILDLLDEECGPAGCDSAPVTLAFTLILPSTSSVCQPAGSAAPTGPKGASPHGMRARRGRILNIALPYLVVLQVPKGTDQNWAQKLYDRHSSSQHFQKPRMSNTAFIIVHFADKVEYLSDGFLEKNRDTVYEEQINILKASKGFQNLKRSGARKTLLYSLSSRLSFINS

SEQ ID NO: 926145 - protein, 138 aa, Homo sapiens
MREKTKLLKEKNEKERQDFVAEKLDQQFRERCEELRVELLSIHQKKVCEERKAQIAFNEELSRQKLVEEQMFSKLWEEDRLAKEKREAQEARRQKELMENTRLGLNAQITSIKAQRQATQLLKEEEARLVNLILIPGV

SEQ ID NO: 926146 - protein, 143 aa, Homo sapiens
MHQKRAQLQDLIERKQSSHTKGGDPKRVAIASLKAWVYIPIIVPLTVSGYCPWMNDVATHWDRGDCAWFWLGQRCGLFVLRGVSKVLYLLLNKLNLKCLWDIQKKISRRPFDIQIWIPALQAIWSLSQLSNSAVVAKVVIENM

SEQ ID NO: 926147 - protein, 143 aa, Homo sapiens
MHQKRAQLQDLIERKQSSHTKGGDPKRVAIAGLKAWVYIPIIVPLTVSGYCPWMNDVATHWDRGDCAWFWLGQRCGLFVLRGVSKILYLLLNKLNLKCLWDIQKKISRRPFDIQIWIPALQAIWSLSQLSNSAVVAKVVIENM

SEQ ID NO: 926148 - protein, 141 aa, Homo sapiens
MLLRLIQTVGLPRDFLQLSHGTHPPSSPSHALKLSDFPFYDPWKKTVCFQKAHVIREGFLRRWPLNLALKTGEMAFKPGLEDWGEFQQDELDVERGFQERHSQVWKPEEHFRKGKQPVCRAENGGSAAGKGWGWTGMKGKD

SEQ ID NO: 926149 - protein, 266 aa, Homo sapiens
MTKFILSICRPGVIGHVPDGQRHVLEECAVSFRLGQVISMHIQATRFCRKACCDTRFLDLPVLALEFQPPACILQGKGSKLYAAPQSSSVAYLCLVLLVGAGMGEPLSSLLFQHGSCTHLPLMWTVGLNGSSGCPKCSGCTDGPVGSCCLVDGLKKLLIPTAPDDHKSSEGSCGQEWITTTFYSDTKASCNLNCNHTLQWRQHMQQKQNLHLPMKPLKNLSPHPGTDLNEKAVSKSPRKMVHCEAGQFPLLTHLHSFVDCERMLCS

SEQ ID NO: 926150 - protein, 148 aa, Homo sapiens
MVRVCLHSFSRGLGPTRFPPIPPVSARMLSAAKPLNRFHRPELGHILTPQLQAELEKWVNGTVTSAEGNGLFSKEDSSLTGGPNTCCTLLVVSLKSCLPAVPVSKQLYSPSIECESYLQRGGTLRQPSLADFNRGLMGGDWVMGADPS

SEQ ID NO: 926151 - protein, 136 aa, Homo sapiens
MRAIPSKEAGPQSCNRMKLNPVNNLHEPEGSFSPRASSRNTAGNTLTLTQRALTSDLQNCLKPISQNNDGSPGLLSPLHTVIQEPGFLQSCPFAILYTLPFFPGGLFHSSQVEGEKAWQLLGCLKPSHTFQTLILS

SEQ ID NO: 926152 - protein, 159 aa, Homo sapiens
MGIPWPSGQISGTCSKLLGEEVLEEPLAAAIRAFGVLVCWRCGWGLSHSGGKELQLRNTLLLGCLYSIIVHLEGPTQEAKQGKLKLKGAPKCQGLSVATLPPGLSRSEEAIVLSNKYSLMPLEERMYKKHAPVSASSEGFRLLPLMVEGERETECVEII

SEQ ID NO: 926153 - protein, 165 aa, Homo sapiens
MLGPPWLLLASLTCCISAGEIGTGSKEEVFHADVETAKRPWIFGGYMCRFVTQVSCMMLGFGIQLIPSPAKNKPTNQNENLKNHISMLQVNFHPSHQGLAFYNSHPDGAVPTSLSLHGPIFSHNLTSFYVNMWFFFARHSCMSWTGTEHADMAHPAYLRLFFQLT

SEQ ID NO: 926154 - protein, 227 aa, Homo sapiens
MRMLELTRPTPESCRSTDTHTNKSRRQGNQDKHGCEEQWQRGIERSRGARVTEEGELAELVNGVDVGETEDGSQASGLVASAPRCNPGLPDSADAFPTDTHSFWLYKWQAANSSSSQRQGSRLNSMQLSQVWPLLRTSVPLPDLQPQGSCPVSGFSVVTVVRKICPFAKTLRQGLDLSRIFLSCSASTKANSLTGGHSVRKINAVSLIPSPRSLSEMAAARQKRFED

SEQ ID NO: 926155 - protein, 172 aa, Homo sapiens
MPLWDSNKGRTSNFCLLPLGPSCQTVGKPKQKGPHGGELRPLANSLIELLGNEDQLASHVKMQILRSHFKLIESETLEIHNLGYRECLGPAKVILLTDRETVLRTWVSKLLARLYDQQDMSKLFGKTLSKVTYFTYPSHSLVSIKGSFECLLGCTELLFTKASEGQKKGLTQ

SEQ ID NO: 926156 - protein, 175 aa, Homo sapiens
MFDSTRDAEDNDLALTKLMVYWHLLLLLLLLLLLLLLLLLLLSPRPLCKESYLGVVNTVLQAQRSDFIAIISTANVYKKPRNQETKHKDWSKVFQKGGCKQAGGEAEILICIAGPFKAQKLVPSGTFESEDILIVQFPPMTENIWTQEGEHHTLGHVVGWGDGGGIALRDIPNVK

SEQ ID NO: 926157 - protein, 134 aa, Homo sapiens
MVGAKGPFYRIPRQGDVGNLSDQYDPVIKVNGKLQQPNPQITTNGPDPSEMKSQFYNVLLLISIKLHVRAEETSPKSGVSLVAIAWLPCREQLSVHPLACCVKSCGMVSMMGLISLLQLHTLVPLLALEPCFEL

SEQ ID NO: 926158 - protein, 159 aa, Homo sapiens
MKRNETRKCKSKQCQVGEECAGVKTLSVHLLLIRRSLKYFLQLFIVEDLKKSSCKEWVFHPDLKDEKMQVHPKRTRKHWGTRNYGEDHESRTSRGYSRSRKEAGVWLDASSFLESYRRQAGGCRQGAAPQQRALNETSHSNSYEECEAPKVEKAKSAGY

SEQ ID NO: 926159 - protein, 134 aa, Homo sapiens
MWKCLKTCEVVSFYKWNVSARNVCQIQNEAEKQQVGYIQRTVRFQGYQGYRMEEAVSVNHPCGEATEEINMTVLWSLPQARHKAYRGHEKTSLEDMLFNFYTKRLKIASSRGSTATIRKSCHHSHPTTFMSFES

SEQ ID NO: 926160 - protein, 145 aa, Homo sapiens
MVNVPFRLLKVSEAQLIFSKSGQGKASAKAQLHQCKSSLRMPIYPRDKLTALSFGAFLLPIEDKGKEAGLPHRGWFLDLLGSLIPDVGFYDQQVGKPVMFVLLPSEWQLPSGPGKTIAAIITTDQMWPNESEPGFFHEWAVVEQW

SEQ ID NO: 926161 - protein, 140 aa, Homo sapiens
MLSHSPKCIHPAILSSSSREERGGNMRPSGCRKKIFENADVRSNRRQPWVGIRASSRCTLETLTSARPLLASSPEPRGPRGDGSGGSVLKMSVPAVAKLSSWLCFSCCSRPCRLQAWFLPPWRVRPYFSNSYPNKLLTLS

SEQ ID NO: 926162 - protein, 134 aa, Homo sapiens
MYVGLVHKGGTIGSGGLPGYKQFKDFLTGNRLKELLSKDLESIEKNVWVMIRVCEDQGFIMPMKPPEWSTLSSSETSHIVVRGSASMIAPSWLLSSSYDPPRCSSSSRLSSPWQNFSNHLCTVRSLAVPGPSVF

SEQ ID NO: 926163 - protein, 125 aa, Homo sapiens
MRLRIQIRPEFACKTQEVREPLMRHQNTELRPVGTRLHDCENRHHDVLLGYRFFSQIVLPGAPNGLLPQTWSNAIKAYSEAVSRPPGSKATALGYCQRHLQNSFPPPEGNLREFLLVVLKCLSVH

SEQ ID NO: 926164 - protein, 156 aa, Homo sapiens
MLFKASSASKSAILALTLTILKLVLKSHDCYFSHTRKQPSRCSPEVQLLTIIAYRSLMITMFLDERLPLGLSENHQGDVCRTRNVWLADLVFHGRYSLNRFGPPVSQLPGTVSGAQGAGGEHSGHPAISGGMEVSGGSAMTANSSGGRQVEAQLEP

SEQ ID NO: 926165 - protein, 150 aa, Homo sapiens [sequence omitted]

SEQ ID NO: 926166 - protein, 147 aa, Homo sapiens
MLPVSKVKSRARLCLYAFIFAHLRKLREEVKMSMLTGVWKKFISTHVDDFVGFNMSVKEVLADVVEITRELKLEVEPKDVPELLPSHEKTEMESTPGEDAVNIAEMATKGLEYYITLVNKAVVGFERIGSNHERNSTVQRYMSSFVT

SEQ ID NO: 926167 - protein, 135 aa, Homo sapiens
MQSPDNTWAPGFSKTLVTLENIYGVSIGLIATTLIVQVLYFVHFGKPTSDTAVIIHADRKSSHATCLSGSIPHLFPHHPFLDLRAPCILLLWPTKASLPRQQECVFCPSVPKLYFVLKNFNPIEMEISNIYLLLT

SEQ ID NO: 926168 - protein, 153 aa, Homo sapiens
MRSHCSALTYKCGHAVFGYLFLCQFAEDNGFQLLQCSCKGHDLLSVSDIKKKLEKQEGTLEMTPSQIVDIAFSVYSSSEAKKLRPGTIYLGMVGKIPHQRKDGNSGKALGHSVCTVMRKITGSSFAPKRKDSRSRRRRRCQGEGPLADGGRGL

SEQ ID NO: 926169 - protein, 156 aa, Homo sapiens
MAKRGQGRALAIVSESTRPKPWQLTRGLGPVGAQKSRIELWESLPRFQRICRRKFAAGVVPSWRMSARTVQRGNGGLKPPHRVSTGALPGGAVRRGPLSSRPQNGRSTNSLRHAPGKAKDASCQPLKAARGGALPCKVTGWSCSKPWEPASCISVA

SEQ ID NO: 926170 - protein, 202 aa, Homo sapiens
MEKTLNCIYLEIFELSYLDLLNGFDQNVNSDIDNKVQAEVVSDRDEELAGNWSKGHSCYAKTLMAFCPCPRELWNIELERHDLGYLMEEISKWQSIQEEAEHKILKNLQADYAIEKKTLFSGEKFKLAAEICISNEKPSVNQQDNGEISPGHVRDLHSSHTYHSPGDLRGKNGFLAGPRVPLFYEALGQRTLHPSCSSSSHG

SEQ ID NO: 926171 - protein, 141 aa, Homo sapiens
MGRNQCKKTENSKNQNTSSPPKDHNSSPAREQNWIENEFDELTEVGFRRWIINSSELKEHVLIQCKEAKNLEKRLDELLTRITSLEKNINDLMELKNIARELHDAYTSINSQIDQAEERISEVADQLCEIKKYREHHKDTP

SEQ ID NO: 926172 - protein, 160 aa, Homo sapiens
MWIQRGLWRYLHCAGLQACLTFALEGDTLSIFLDYKQTSSFLQRDTLSLYSKKIDARSWSLAEPTNGDPMGIHRQKMEFYNKRSTVLAVKSKWLEKSIQSIPSSEQAQEGGKPGTVVRLRREQDDHRDGCRPLYPSSCNLILGMGLEARQGDGANLVENQ

SEQ ID NO: 926173 - protein, 139 aa, Homo sapiens
MAEGEEASLRWKQARESGFVKVELSDTYKTIKSHRMSLTIMKTSWGILPPRSNYLPPGIGDTCEGFLHEYFHVTGVWCTNGCVIQVAESAGKRAMMAAAGKHFNWAAEAALQVGATRSLGQYERMSKKFMCETYVMISK

SEQ ID NO: 926174 - protein, 142 aa, Homo sapiens
MLSFPLPPTPRQALVCDVPLTVSMMMVLHKDIISHLPSPSNKQHMSWNLKNMVEMIGFRVSITVIGQRNDAMTEVEGVSQSQSRQDPRCCHIPCNTAPSTIFKLWSMKELGKIPRFMTSEKCTHTKMQANLKNIIQTESTHI

SEQ ID NO: 926175 - protein, 146 aa, Homo sapiens
MLPWLGLTGVPEGAGCRDARVLHRGGQPQLHPGAPTRPPWKMQGSHLSPAPACFLEQEAQIHSCNLGGCGPTQEGRAPACCIEKEAWVCSCSLGSCIGRGAPVPTQKGQGSQWLHGVCSPSRAFLLQLFPHIGVHCFLAFILWSRE

SEQ ID NO: 926176 - protein, 137 aa, Homo sapiens
MVHWRSNDESEQAPIRPEVQASVNKIQKHKMKELKEHSMGRNRKARWENISTMQARDDSTRVQNGNSRNGDIIDMYESLSAEGEAALPRASEFLETLKGTAEACLSYANQPIPNHCLIEFSHTKPMFPLLLSQDQCL

SEQ ID NO: 926177 - protein, 170 aa, Homo sapiens
MVLVEEGRLSEGHRSSLLTSFFCPSSAPRQPRNDFEESKSSVEKVTADVVKIARELELEMDPEDVTELLQSHDKPQMDEELLLMNEQRKWFLEMASTPGEDVVNIVEMTAKDVDYYVNLVDKAVTSFERTDSSFEGSSTVDKLLSNSTKCYREIFCERKRQLMQQTSLWS

SEQ ID NO: 926178 - protein, 221 aa, Homo sapiens
MRSEFLPSGGFMVSLASGVKLQTFVTFTVSVTAVKVARVELFVPSGGFVVSLASGVKLQTFTWILHQGRRWSCLPVPHPAPALLSPWVVDGTGRCGAGGGAGQGGLGLAGAHRVGEAQAWQAAGPEPCPAGRQLRPREKSSIAAAGPGAKPLTARAGGAHWLLERGARGHPRLPRTHAGPQAPRAARVPDHASPSTPSRKLREPAPALASPERGSHSAAVG

SEQ ID NO: 926179 - protein, 242 aa, Homo sapiens
MRTQSKRRLEAKKEQRQKNFVDLACECSAVICCRVTPKQKAMVVDLVKRYKKAITLAIGDGANDVNMIKTAHIGVGISGQEGMQAVMSSDYSFAQFRYLQRLLLVHGRWSYIRMCKFLRYFFYKNFAFTLVHFWYSFFNGYSAQTAYEDWFITLYNVLYTSLPVLLMGLLDQIQKHRKRLKAEEQWQRRQQVFRRGVSTRRSAYAFSHQRGYADLISSGRSIRKKRSPLDAIVADGTAEPSY

SEQ ID NO: 926180 - protein, 438 aa, Homo sapiens
MVSLASGVKLQTFVVSVTAVKVARLELFVPSGGFVVSLASGVKLQTFTVSVTAVKVARVELFVPSGGFVVSLASGVKLQTFTVSVTAVKVARLQLFVPSGGFVVSLASGVKLQTFTVSVTAVKVARVELFVPSGGFVVSLASGVKLQTFTVSVTAVKVARVELFVPSGGFVVSLASGVKLQTFTVSVTAVKVARLQLFVPSGGFVVSLASGVKLQTFTVSVTAVKVARVELFVPSGGFVVSLASGVKLQTFTVSVTAVKVARVELFVPSGGFVVSLASGVKLQTFTVSVTAVKVARVELFVPSGGFVVSLASGVKLQTFTVSVTAVKVARLQLFVPSGGFVVSLASGVKLQTFTVSVTAVKVARVELFVPSGGFVVSLASGVKLQTFTVSVTAVNVARLELFIPSGGFVVSLASGVKLQTFTVSVTAHRGSVDPKSEQ

SEQ ID NO: 926181 - protein, 124 aa, Homo sapiens
MLSTIHSETNELGETSGPLECLRRQLVSCHRKGLWKFAKEVREVCLLSFIYLRSVWSFRDDKLLSPYVPTPNFWEIFHLLQLGSHSLVVQSAVTCPSERKKTGKSLLPHGNDLCWTSWKVQLSG

SEQ ID NO: 926182 - protein, 221 aa, Homo sapiens
MTRRLSSLLCAPVLFRVTSAFTWQEDCLAFLVQTFYNSAGDKITGKYKKQGGNVHSNDKLAEGSKFYISKPSKNKGVIKTFTDEQKLREVIFSRLALQEILKGILQHKMREPYMLNPHEEIKSMVKNVQAISKEQETSQDSVKICPQIRNYDIGRYLLYLVTLKSLSSVNGVQENHEEIGSEAWYAEGRLKQVIKELTSHLLEDNASVSKRHPEFIADKDA

SEQ ID NO: 926183 - protein, 146 aa, Homo sapiens
METEVGESRTDQGEGMLRPEGEETKELHSVGRGRRRQWEERDVPKREYCAATKYAALISLQGNLPHREKLVHCVLHILICFSPHREPPAPPLHSSSCSQSITEQSECSFALKISICWASLRLLLPRPPSSPHSSHSCMVLFINKWI

SEQ ID NO: 926184 - protein, 143 aa, Homo sapiens
MRKERFGDTNTETHREGNGTTEAEIGVMCLQDKEVHGWFVPADIERGKEGSIPSVLRECLDWSRRFNIQSTHQGRLCRQPFTTYRRSSRNRCFLVFCQECQHQITPKYHSFPRELDRTVLSGLEPQLALNTASTHTLRRTTVD

SEQ ID NO: 926185 - protein, 166 aa, Homo sapiens
MQATTQGEDPRQAHTCPAGLLLPLPRAFPSAIALKAQIPQGRIRKLALQEVHYLPPIIPGRSELGMDNADNIESHAEKERNQKGSEGEAVGTQATILLHTIATGFTSCYPHFCDTGSTLKFLGESFQLAVAVRHEPGFMEKSLIAGLGYKMGQECSYPHMCGTPDK

SEQ ID NO: 926186 - protein, 140 aa, Homo sapiens
MPSLFKPCQKARADQCQEDKSHHQKLQKVKEIHQERQVKVEAGSPLSLRGAASNARIANFLFPPPHPKFAYEKNRKQRVELIDKDPSCSNIYDSFNYICPQFPDVHSLPKRRDFSLETKLDSYKYVLNFTGPVPYGNTYD

SEQ ID NO: 926187 - protein, 133 aa, Homo sapiens
MRKPSGVIYLCCQPLAACFPLHPSALEHEAVPYCVLLEQAWSPHPPGFDLSTINHTHTENPPTAPLFSIYVLFITVHYSKQNCANGAFSRNIVLISAWIKGKTDLQTWLGGCLVEERFQVESGSTVRASTASR

SEQ ID NO: 926188 - protein, 130 aa, Homo sapiens
MCTMCSSYSKRQESIGKLPVMNWGLVTLTLERIIFTRLSTFLAAFVVSYGGPGKHHSAKVILDDNFTNTFEYSYVEDIMLDSGDMKRSKIQHLLQSNSQCNEDDSKSRGRSPTGRIMEGHRRDLQSRHRP

SEQ ID NO: 926189 - protein, 141 aa, Homo sapiens
MIKLLRAKGGSSNPWQIKLHDECTSLSSRFDQLEERVSVMEDQMNEMKREEKFREKRIKRNEQSLQEIWDYVKRPNLRLIGVPESDGVNGTKLENTLQDIIQENFPNLARQANFQIQEIQRMPQRYSSRRATQFGKDVSTV

SEQ ID NO: 926190 - protein, 152 aa, Homo sapiens
MSDEDNKCQRQGRHLGQVGILLNQVQVLLNRQWESKVVFEQCSDEGVNSEDIGEIMEGGKQEQSPQEERSVAVQGKKDEDSHWGGSSGDEEEWTDMGSTLEVESTGLADGLELHKGKSAHRLLTTAGKKLGANVAKHVTDAPPYAAQGLHLV

SEQ ID NO: 926191 - protein, 172 aa, Homo sapiens
MDVTLLDEHGKPFWCFSSPVCLRSPATPSDSSSFLGQTYNVDYVDAEGRVHVELVWIRETEEYLIVNLVLYLMTWPLSLWRYVYDSEHVRVQNKEPEDSNQVKMGDRYYVLAPKNERVKGFLLLTPSSTLLSSMTLGQSPWEERNLKCGQMLWDPGSEDGTNGTTGEMRKGL

SEQ ID NO: 926192 - protein, 138 aa, Homo sapiens
MGCTHCLTSPNEMNPVPQLEMQKSPTFCISLTGSCRPELFLFGHLVRTSESEFPAGPWMVPLAVRPSAENPGVSHPPLTAQESPENLESKQRKGQKDVPALGNNSSSTYRVRGVRWGIVRTGVRGVVGSPVRNGPERA

SEQ ID NO: 926193 - protein, 151 aa, Homo sapiens
MAYLETKIWAPDVLIAIGVAPIPGRLSDVVLLKICAVLVNPRERMKTLQEAVESRGDAEEGMGNTEALASASQIGHMLPENEGEERGERGNVEKVQRVVSVQATKPAVPPGGQSPLRIHLPTETPSFLRAPFPPLPGSGSLVLGNGLVSRP

SEQ ID NO: 926194 - protein, 136 aa, Homo sapiens
MPIMSLTCVDEREPSLCPCPNRNKNQSHVALPLLKPFWAHMGAGPALSPMVTTTILDRSCWRAADQGVIYTLTEVSLVKDSITQLAGFSQRQSLSWPTPALFAHLQRLLKHWQWSGLVVSPVATTLLSYPRLPSVG

SEQ ID NO: 926195 - protein, 160 aa, Homo sapiens
MPLKPQQADSAQGIRQGIVSFSLLHNTAVQDCKVIDVSSRPTNYSPPKVPVPHRASPCSGSMWASQRVYGKAIKKTNYFSQGLLPEAMTEFVFEYNLLFPQQEHDGVVCVPERERKRERESAPVERLWNSEIIKFHYLLSRGTAAVNSRVNGYVGRPTDF

SEQ ID NO: 926196 - protein, 142 aa, Homo sapiens
MKVTLKTRPFCWEQKMSRAVSQGRVCGRTGEEMKEEGRADNVGIQQAAFHVVIQGLKHLLPVSPQALGSSVDSDALDADEKKREREREEDHCGRILWVSPKRKNQYFCLQSLTGTITWLHLPVRDWDPQTSHVLSRRRKMML

SEQ ID NO: 926197 - protein, 170 aa, Homo sapiens
MFLINYPQLCGYKLRGEKGMKKPGYWVIAGQGRFRGMLALGHFLLQSGGPRDIRLAGTAQGPPTPLRIGRVMMVSKSKTLVPSLRYKGDKGEACRIHLSVTKSRDPQKERGIDVENPLSSSSSHSSEMEEVWKHVGHWLLRPGPPLSLLISSFGNNQSFAKSNERRLKKS

SEQ ID NO: 926198 - protein, 145 aa, Homo sapiens
MKTTKTHTRKNRQPNIPTYSKFSALPSSNTYSPVHCYGEIMEDDGVTRRGLLEVIKSESSTLMNGLLPYKRGGKEYPSDFVLFPSTSRHVRMQQESPQQTPDLRPGFWTSEPPEFYSQVAQYHCGIPSPPVLQSHETYSETLVEH

SEQ ID NO: 926199 - protein, 144 aa, Homo sapiens
MYVPLKNFLLILVKSVCVFSKICDVATPKFVFVSPPKFRCRAVRSPSHVFRQNTCVSELLPSVTWQESLGKTGRVVPRMRIAAADHDGTLENEEEETAQSVSQLVIDTHLGFPSLRELFRLGFHHGTTVISSIETVYKSIETAA

SEQ ID NO: 926200 - protein, 151 aa, Homo sapiens
MTTPCIALIPSQLCARAITILCQDKHVDQRDRIESRYRPVPIWSTDFQQRFVGCTESITLASDQLLVRLQGAFTHSRKQSGTQFAAVGKRLSWGSYYRNPEFLARSQMYGIRFPLAKQKLVVTVQETGLRSKEIQTPTEKDEMPELGTDVA

SEQ ID NO: 926201 - protein, 218 aa, Homo sapiens
MVRALGQSVAIPDQTEGGAQAVMLPHLLLPPCGAQFLTGHGTVLPVNPCPQIVHDPLLNLLMNLLICPAEVVFTFGALHVIAASILLNADVVFGTVFSVSTTVVGCFRVVCTLLEPFSDGDAVCGCVIYLMTLETEDLVAPIALYSVSSRLLYPNNHEAVCTRAQLELVMTLHIVPEEVAPVFLPQFFIGKQWKHKVLWCMEWDSPEPCKRLPHPHHP

SEQ ID NO: 926202 - protein, 146 aa, Homo sapiens
MQMYDLDIQKNFKIHSHCLRQQNICLPEDLDPKQIATDTKMKGEGIHPISSSKQLLACSREYRCQWPRADGYQALLNAGSSSLYPGAAFLAHWSACSLGYKTLWAGVLLGPGVVTLRHLGECGEISRFPVTCMLNFSVCLSYKLYS

SEQ ID NO: 926203 - protein, 124 aa, Homo sapiens
MMSRARFAECGRRVLLDVGIAFSEFLNSKRALRFLKSEEDRKTWESLELPRDLLNGCDQNVDGDMDNNIQAEVVSYGDEELVGNWSKGHSCCVLAKRLAAFCTSCPRDLWNFELERDDLRDLHK

SEQ ID NO: 926204 - protein, 156 aa, Homo sapiens
MVIPIKYKLVLLLFLFLWESYLAYVWKPKDIADTIPIIKQLRETSPTPQMDNITMHDSSDKTFSSTPGLYFFDAIAPRPHYDNKNVSRHCQLSFRGEIIPDEEPLIQNHLRLGGPLGKEGKSLGPQLLGGAPATDSLPPDFPNRRKKLPTITLSLC

SEQ ID NO: 926205 - protein, 121 aa, Homo sapiens
MYLGRRWLFLYLCPFPSSALPTFCALLHAHTSFCMINGLGHAAHSLAYETFTLSAEGARDPPKATECSICSDCQHPATATTGASVSMDTGNPAPTCTLPQVQVHTGMQQLDFCWYPNPTKA

SEQ ID NO: 926206 - protein, 155 aa, Homo sapiens
MNRSRENSLNWMSITAFHTYDLWDKPLKGFSGSSPSNGDFSPFLTDIILKMSQRDASGKFGDVEKGHRRICGGLTSQKSDSANYNSQEPLAIGLQLESGRREEEEIQGIFPLLCALSGILGGLELFPSGSLSLHGPAPTLLPQQLCSSRGFAYFL

SEQ ID NO: 926207 - protein, 157 aa, Homo sapiens
MSQAGVQVLDTITRKNSGTNRNEAKDKKIFLRSEGTHLREKCGCVPENDLTFLDPPSEIKGESIPHGTVNYINSLPAVLSLFTQVELGPLALNQFEKQTVFHKATSLEGEDSGYRPNALAKMSWLEAMRQKISVTKKMTCPEVKESGNTHINLDRFL

SEQ ID NO: 926208 - protein, 135 aa, Homo sapiens
MCTEYFFDLLYFPWWYIFKPPAPSQNSPPITSYSHSIKKGSKYPSMFSEYELHLWWYNVGGEGVISSQTAVSYLDKCYICQTCRQDKEKDLENDGLWPLKENGARCEKEHCREIQSSLLMDSPGPVKELLCSTKV

SEQ ID NO: 926209 - protein, 145 aa, Homo sapiens
MKRGRESSFREGINGEMAIALIETEGKGEDSEIREKRSWIQEALCLLAKKSLKILTRPIEWEGGENPEGHSPLPTDPPTMGKGPASGGPGQGLPKGASSYPGLRATLTITRPFLLFQCYFKDLRAWGLGLDEAERNGKASFAVTV

SEQ ID NO: 926210 - protein, 170 aa, Homo sapiens
MSLLLLVVSALHILILILLFVATLDKSWWTLPGKESLNLWYDCTWNNDTKTWACSNVSENGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRELRTLDLS

SEQ ID NO: 926211 - protein, 209 aa, Homo sapiens [sequence omitted]

SEQ ID NO: 926212 - protein, 155 aa, Homo sapiens
MGAWPLDIAIPLHLCTCLIVIKLSGPSLVVVPCPFLEIQGIRVQVCDIDILHDAEIWASMDAVTQIVNIAPHRKKIITAGCIDHVLSVSDSQQMQANLTQRTEAEIRKQTQIAPTFPAHSLPGIALTIPEYCTIIYSFQFPLTTQFERAPVIDDA

SEQ ID NO: 926213 - protein, 144 aa, Homo sapiens
MGQGSRTLASLHAFALAAVSAQGRGTGGNVFRQGKPPSIKLPVDHDSLVDARTQQECLELMHIIAQCIAGLWLKPVLPGSLVPDSGTSIPAPHPYLTFHPVSRVSADALYCHCPYSVNLHQEQDMLDEFFCSLILLTSHGSEMQ

SEQ ID NO: 926214 - protein, 168 aa, Homo sapiens
MNRVPQLEVQKSPAFCIGLAGNCRLELLLFGHLACLHRKIAMKEQKQTNSVQAFICSWKKMNVLIFIQCTHLYCVLECKMQCNITQGNFYFSGYCLQSKAKLFGKKKKIFEEHFYKVKRTSFLIIPIECISKEKTISAVECPVIFRQKLISPGWISALPVELLGSGSF

SEQ ID NO: 926215 - protein, 140 aa, Homo sapiens
MNALGTGRSITPCNPAAASRGVPVTLQSPRGHVLTVHYFSFAVHGWLMCLTAQCDSPLYPEPLLRIQEESGHTNELKMVNVGDFIANESGFQHDGELKRKWNGKVAGVWLPQPDSLRGPTIKLFVVEQIAFVSFFFLAQN

SEQ ID NO: 926216 - protein, 179 aa, Homo sapiens
MQEQWQAASPIRSGNGRLTGSGAQRTPCRFWRDGSQRQIPNYITSRCYDEAMSTFVGNYQPPAAWLYQFAFSLTKNYNGAFIVPEDLPVTQNVEVEDSDIDDLDPGKTVKTSEHLVLLAPRIVTTALAELEEIFLIDEKPVLYLGKLVTMTPKIIQNLHTKEGLANHGLKEGDNWMRSW

SEQ ID NO: 926217 - protein, 163 aa, Homo sapiens
MLDNPDLCKHCTTEPALLAIISGRPKDNNTPKLEKQLPGEPSEDPSYLGPLRDPLSIQHLRQIKGDLGQFSNDPDRNIAFQNLTHVFDLSWRDVVLLLSQTLTAAEKQAALQAADQAFGFSLPMHTGKMDNTATHTIEWSKSKTLAIPNADKDVEQQELQVGM

SEQ ID NO: 926218 - protein, 139 aa, Homo sapiens
MKHKSMKSLPVGNSGCARRRRGVGVVRRDERLAEIKSQGAALLGAAAAAQTVAADSGIPARGEPRKTPSPCRLGCWRQTGSWAKEIGPDKSRPSAQGGPEGSGPGCQSPGPEWGLVVPFLAHPWLPMDQSPDTSSSLGP

SEQ ID NO: 926219 - protein, 131 aa, Homo sapiens
MHYIWPYQLSSEYSCRKNLRNILLPLPKFSRICKLFMNILNSWQCGCLHKFKKNLSSFIRGHSWTKWSFSQGCGLNGLVRGSSQANLGQPNVDNDSCCTLCGSELIAYLHKNTIMKTLKLENGRIVICVMQ

SEQ ID NO: 926220 - protein, 144 aa, Homo sapiens
MHVVSAYGIQYKLLRPNSSSCQISPTCCGCLLLGITLSGSFAMVTLVQHSFSNSAHSLDVYSITFLVDWHLCGQRNNTMFSKRLEKIAQVPLLFPFIFIILTNYSKMEGAVESQPSFFKTSQDIVTCTWVENCYSSFSRRPLEG

SEQ ID NO: 926221 - protein, 156 aa, Homo sapiens
MKEIIPVAYAFFIHLHKDAATITYSFTHTPKPDEADISTPHFVHEQIGATEANNLRSGGATAETGFAFQNMFHFCCAAFKSSGSQKVVLRPIVSVSAVNLLEMQILGSHPYLLIRNSGVGPAIYLTSPRGASDECSSLKITALKSSYGNALVVMTA

SEQ ID NO: 926222 - protein, 150 aa, Homo sapiens
MPRCSLSDRRWAPQPRRTRIGRNYGGCGVRRSCWDNPWGGKRYTAAVSPVILQGAGAAAAATAVNQLTPAPTAVTFAATVAKMRGRERLTISLLARPKPAPREPAALRWRPKVEKRPAVGKECTAAILVVGNVQAEIFMDEIVRCLAFAP

SEQ ID NO: 926223 - protein, 289 aa, Homo sapiens
MDSYRKVTSRDNLVVPADWHLFGGFIYGHTVLETYWKVGPAPRTHWGRAFLEVVQLVPTGMQMQRRPTQLLPALSEERGATHSQDSPHPLPRVSLLKASEGGTFQKGIVPVLEMERNQMQISINSINGQCLPAIKIAQRLLVSGSKMDDQWPWRSQRSKMTITLKCNLCRPPALRLAGGAASAAMPQARPLSATAWQRAFLEPQPGRGPSWILGRGVCLSILQSPGLRLLSCPAGMLHFLHPSLLAMMSHRRLQKSRAAVWLSPGKPSPPAALCGCGSFLGIIVFHLSW

SEQ ID NO: 926224 - protein, 140 aa, Homo sapiens
MKKTQNFEFKSLSRFPQCCMLLSGQYCLEVESIALEEGKYHGELVKLNCLLTKRFPGEGRSLQGMNFSGDNDISLEIFTLPGLGIKKTSGKSSIKETSLSFSWNLTSNFLFLNCLSFWHLEPSEQSAEGRIVNFCYEYLL

SEQ ID NO: 926225 - protein, 153 aa, Homo sapiens
MPSFFLSSLGSLFTNRKCSSRASGLARVPVSPFSSFSPNKTLLYSLFKPPASLNFHGRATNKDPTSLAEVRKCPATALCLNLQNFLLFFRLNPSYWRFLAFIPTTKEILCCPPDVSYLGLHRELPGRRALHSISDELREFKDERPNLALNIHT

SEQ ID NO: 926226 - protein, 157 aa, Homo sapiens
MIIFPHQEKCSGQVWGLWNPTDTDPNLALFCYLPIVLYWASYLTPLRFHFVISKAKRIIAPTPCENELKLEDNKFVLFGAKFGAICYSSNGKLIQGDNVVSSVDCSILTFKEYVAKVNFYLKVSVIHSAEIIMFRRKEVSGFHFKDGGGRELEEGQY

SEQ ID NO: 926227 - protein, 139 aa, Homo sapiens
MDWYWSMARELLAQLRLTYLAISDPFSFPTNKLCCVTAILCLCMNVCLWIRSGRVTLVGYDHKKERIMIAKPLVQSEGWEEAHFSLGEVIVCDLQNEISLKTQAKCLVVIKPHPLIFGNPLPVESPRPLTVLTDDILFF

SEQ ID NO: 926228 - protein, 229 aa, Homo sapiens
MLAEMLLWVEGERCFQLPPGVSQAQVTSIDLGRVHSVATWERCHPQDPLVTSIDRGHVHSVTTWECCHPQDPLVTSIDRGHVHSVTTWECCHPQDSLVTSIDCGRVHSSPALTVAMCIVWHLGMLSYSGPATLPSLTTAVCIVWPPGNDVTLGTRCTPDIDHGHVYSVAPGNTVILRTCCLLGIDSGQVHSPVTTVHLYLGLNLCIPTLPREFAVALLQLPDKPKHSPP

SEQ ID NO: 926229 - protein, 211 aa, Homo sapiens
MFHGFEEAAMGKIGILRRFGTQNARNAQNAWNAQNTQNARNSRNTRNTQKAQNFWNIQNSQNIQHAWNVWNTQNAQNSQNTQNSRSTQHAWNTQNAWNAWNTQNAWNTQNAWNTQNAWNAWNTQNAQNSQNTQHAWHTQNAQNSQNAWNTWNTQNAQNSQNTQNSRYTQHAWHTQNVQNPQNTWKAHPEYPEFPNTQHAWHTQNAQHLDHG

SEQ ID NO: 926230 - protein, 475 aa, Homo sapiens
MQKSNHKGKTCSLQMLPLLPGFSLCPPGSRCDTMDVTVACTPRALNSKGVNVGTRFDQREATFTAHPKLEFPIDLKLPLKPQMRVNEAPCALPNGNVLAGTDCDKCPAANINVTRAHGIGAACPTEHDVGQEEDGPEDASPTEHGVDQQEDGPEDASPTEHGVNQEDGPEDASPTEHGVDQQEDGPEDARPTEHGIDQEEDGPEDASLTEHGVDQQEDGPEDASPTEHGIDQEEDGPEDASPTEHGVDQEEDGPEDASPTEHGVDQEEDGPEDASPTEHGVDQEDGPEDASPTEHGVDQQEDGPEDASPTEHGVDQEEDGPEDASPTEHGVDQEEDGPEDASPTEHGVDQEDGPEDARPTEHGVDQEDGPEDARPTEHGVDQEDGPEDASRTEHGVGHRAGRACAAFLSSRRDNLYLSFKKANSAHVTGIISSRSDSAEWRTLLHLAVIKTHGGLTANSPCVFLGSPGRVVVTVL

SEQ ID NO: 926231 - protein, 164 aa, Homo sapiens
MCGWCSCVDGALKWAVLMCGWCSCVDGALVWTVLMCRWCSCVDGALMWTVLMCGCAHVWMVLMCGWCSCVGGAHVWVVVMCEWCSRVNGAHVWAVLMCGRCSRVGGRRPLAPRSYGRSWAGDWSAANATSAQALLGRPGTLLPSKAHNIGGVKRVDFKTKLLVS

SEQ ID NO: 926232 - protein, 166 aa, Homo sapiens
MISIYRDLNYKYGEGVLSSLKLKVHVKFKNPRKIGNYLCKHQAPAAADLGSASDVRGDLRIFLTSPQETVAQVPTFKDMCAKPHHCQTYTGTENQIMRVLTYKWELSDEIQRIQANILGRIMAVLRALTAFEMCPVGVMFPQLGLHARSRFLRNRKREKHSASDLL

SEQ ID NO: 926233 - protein, 136 aa, Homo sapiens
MGESKNQGRLQWVGQVLRAADGHPLLGEVPEGGNAGATKLFGLLAAEGTVLLPSVSAPMKILNVSCLLYHQPHGRVSMHHRPRLNNPQGPSPQAVITLRYPEETVLVKPTTTTKNRNQPKTLPKQVQYYLKDNSNL

SEQ ID NO: 926234 - protein, 173 aa, Homo sapiens
MEWGLLCLCGPYGSWRFSNFISLIIFTGSLSPFPLDFNNGNLCTVTECRAVALRWEAVCHHRMGHGWSCRELCAISAAANSPRSCFLVQFPTPQMLCLVPCGSLQHLLHSWPSPQVPSPDCSGILPQGSLLRMLRLETGPEEREVPSLQQARSRGENHRGNHYFSNSYKKKST

SEQ ID NO: 926235 - protein, 190 aa, Homo sapiens
MLTLGDNVSDRRCPEEGIVVTGGDSSMRVTAPEDLPVGQNVEVKDSDIDNPDPARCLEEGIVVTGGDSSMHGTAPEDLPVEQDVEVEDSDIDNPDPAPMRRYRKVLFPKNTQAVFAVCSHADTTTVNTEDFCHPKICGDFSPSGIKQPILQQTPTACRIPHIELPVPEDCPTLSTSHKSRPPIEFKLGLL

SEQ ID NO: 926236 - protein, 143 aa, Homo sapiens
MRKGHPKELRYEGATLGTLLVGSDVDGSQQPVHASQAKTGDRTKNCFLSLHKALIQTRGLEGADPWTWQEASDPPEPRGCGTDVDIPVRMFRGKKRALMNHRESDKCASVREVLFPNSDLFIFVKLNHSFSHPFGRVMPSATS

SEQ ID NO: 926237 - protein, 166 aa, Homo sapiens
MISIYRDLNYKYGEGVLSSLKLKVHVKFKNPRKIGNYLCKHQAPAAADLGSASDVRGDLRIFLTSPQETVAQVPTFKDMCAKPHHCQTYTGTENQIMRVLTYKWELSDEIQRIQANILGRIMAVLRALTAFEMCPVGVMFLQLGLHARSRFLRNRKREKHSASDLL

SEQ ID NO: 926238 - protein, 156 aa, Homo sapiens
MVLCMAPTLSYSLSELDSHHSRGAPATTCSEKAPHLCGGAGLPTPVLLQDYASSPGPLVSTQGTISVCPLCARPPSPEVPKAGPAPAHPPASGEHHGQPMAVDGHQEDSDSAGQGAGVKRRPNWWVEGWGSGAVTTGAGGYTSCGKVIPAVLDQGW

SEQ ID NO: 926239 - protein, 160 aa, Homo sapiens
MGPTSIPDPSAVLGTGNVMGPTSIPDPSAVLGTGNVMGPTSIPDPSAVLGTGNMPGRGWCRNAGKGPDPGPESRSRGLLCDPGSCTLETESGSRGLLCGPGSCTLEKEGSLVTPPSPAGFSPCLRFAGWFDGMPLNIQGTVTKGYCGQRGLLPLRQFHNH

SEQ ID NO: 926240 - protein, 140 aa, Homo sapiens
MRRARLVRTESVPCDINNPLRKPPRYSDLHISQTLPKTNKINKSNSEYSGHGSSLMMKKTEKEEKEEAGGIGRRKEEERKEEEEEKEKEGGRRGRQSGVDEENGGGGRRRSSNSSICQFLMGPSYNPCTSTSSHQKYHLQ

SEQ ID NO: 926241 - protein, 174 aa, Homo sapiens
MGRNQSRKAENSKNQSASSPPKERSSSPATEQSWTENDFDEWREEGFRRSVITNFSELKEDVRNHREEAKNLEERLDEWLTRINRIEKPLNDLMELKTMAQELRDTCTSFSSRFNQLKERVSVIEDQMNEMKQEEKFREERIKRNEQSLQEIWGYVKRPNLCLIGVPERELSPT

SEQ ID NO: 926242 - protein, 121 aa, Homo sapiens
MKLIWLLQCVKKKKKKKELPGKSKVRQLGVAALGSKAAFLTLPPFFQMYVAPGEFSRALTSTFRDMLSDNDKCSQRALSFSGSTIPSQSSDHEQRQRSSAFRRIFVTWFSWPCPISACAVL

SEQ ID NO: 926243 - protein, 184 aa, Homo sapiens
MAGDGLAPALAAGTELMLISIPLLPKTLLHDWFLNPLWHLPSPLGLESSEMEVFGEIKKSSEGRRRSFQDLGVIISGDILDWRLKFLNRNLELIQKRQIQNVQVSSHFPNLGDNDAGPGIPNTGGCGCGLHLGGVAVPEPCSEGPVPGRDVGELQQPGGSGVSSQQTRCTLQIGTRRRNLHNRR

SEQ ID NO: 926244 - protein, 444 aa, Homo sapiens
MLENYSNLVSLGYQVTKADTLFWLEQGKPWILEEEIQSQVCPEDAWQVNDHTEWHRENQSSLETMDRHHKYHIFGNITSHLSSNLHTPFVLGKHLNPNLEYFIQNRSYARNEGECNGYDKVFLYPKHEKIHAEEKYNEYNERVKAFSHKSQLIKHWKTQKREKQYDCSDCGKAFSQKLDLFKHQRTQRGEKPYGCSRCQTAFRWKSCLILHERTHTEEKPYECNKCGKAFTDKSCLNKHQRTHTGEKCFECHTCQKGFSDKSKLTFHQRTHTGEKPYGCSKCQKSFSNKSQLMIHQRAHTEEKPYGCDECGKTFPLKFNLILHQKIHTGEKSHGCNECGKAFIQRSELSRHQRTHTGEKPYHCSECGKGFSVKSFLNTHWRTHMGEKPYGCNECGKMFSIKFSLILHQRTHTGEKPYECSQCQKTFSQKSHLNIHQRSHTGEKP

SEQ ID NO: 926245 - protein, 121 aa, Homo sapiens
MRLGKGWESNGRPGAIGQQARLQLESASSSVLLQIRQINTGTENQTLHVLTQKCELNNKNTNGHREGNIHTLRPVGLRLNWEAPYKHRSFIYPTNWREGKRWVNRMQRPGCDRSASRKETG

SEQ ID NO: 926246 - protein, 985 aa, Homo sapiens
MNFSVITCPNGGTNQGLLPYLMALDQYQLEEFKLCLEPQQLMDFWSAPQGHFPRIPWANLRAADPLNLSFLLDEHFPKGQAWKVVLGIFQTMNLTSLCEKVRAEMKENVQTQELQDPTQEDLEMLEAAAEKVGSTGGFHYCWPIFTLGYFHISSSMFISGNMQTQGCQDPNQEELDELEEETDHRRKYRENMKAELLETWDNISWPKDHVYIRNTSKDEHEELQRLLDPNRTRAQAQTIVLVGRAGVGKTTLAMRAMLHWANGVLFQQRFSYVFYLSCHKIRYMKETTFAELISLDWPDFDAPIEEFMSQPEKLLFIIDGFEEIIISESRSESLDDGSPCTDWYQELPVTKILHSLLKKELVPLATLLITIKTWFVRDLKASLVNPCFVQITGFTGDDLRVYFMRHFDDSSEVEKILQQLRKNETLFHSCSAPMVCWTVCSCLKQPKVRYYDLQSITQTTTSLYAYFFSNLFSTAEVDLADDSWPGQWRALCSLAIEGLWSMNFTFNKEDTEIEGLEVPFIDSLYEFNILQKINDCGGCTTFTHLSFQEFFAAMSFVLEEPREFPPHSTKPQEMKMLLQHVLLDKEAYWTPEEDFTKKMLGRIFEVDLNILEDEELQALKHCKRLNKLRLSVSSHILERDLEILETSKFDSRMHAWNSICSTLVTNENLHELDLSNSKLHASSVKGLCLALKNPRCKVQKLTQENEIEGTMRRMYLVYSNDINKAIRPSITNSGHVFLSSDMLEPAATTWCKSVTPEWVLQDLIIALQGNSKLTHLNFSSNKLGMTVPLILKALRHSACNLKYLWLESCGLTYQICQLFLKLTENTSLNFLSLGDNDLSDVRSLRESSTLPTCPLKELSLEKCNLSAASCQDLALFLTSIQHVTRLCLGFNRLQDDGIKLLCAALTHPKCALERLELWFCQLAAPACKHLSDALLQNRSLTHLNLSKNSLRDEGVKFLCEALGRPDGNLQSLNFHETGTGFLAHK

SEQ ID NO: 926247 - protein, 644 aa, Homo sapiens
MPITWDQVETASWAEVVHLLIERFPGRRAWDVTSNIFAIMNCDKMCVVVRREINAILPTLEPEDLNVGETQVNLEEGESGKIRRYKSNVMEKFFPIWDITTWPGNQRDFFYQGVHRHEEYLPCLLLPKRPQGRQPKTVAIQGAPGIGKTILAKKVMFEWARNKFYAHKRWCAFYFHCQEVNQTTDQSFSELIEQKWPGSQDLVSKIMSKPDQLLLLLDGFEELTSTLIDRLEDLSEDWRQKLPGSVLLSSLLSKTMLPEATLLIMIRFTSWQTCKPLLKCPSLVTLPGFNTMEKIKYFQMYFGHTEEGDQVLSFAMENTILFSMCRVPVVCWMVCSGLKQQMERGNNLTQSCPNATSVFVRYISSLFPTRAENFSRKIHQAQLEGLCHLAADSMWHRKWVLGKEDLEEAKLDQTGVTAFLGMSILRRIAGEEDHYVFTLVTFQEFFAALFYVLCFPQRLKNFHVLSHVNIQRLIASPRGSKSYLSHMGLFLFGFLNEACASAVEQSFQCKVSFGNKRKLLKVIPLLHKCDPPSPGSGVPQLFYCLHEIREEAFVSQALNDYHKVVLRIGNNKEVQVSAFCLKRCQYLHEVELTVTLNFMNPNNQMQMNWETRESISVTGYTGRRPRNITRPIKNYKVFQSLYAF

SEQ ID NO: 926248 - protein, 132 aa, Homo sapiens
MKTLSISCLSLEILGSSDLPTSAPQIAGTTGMRHHAQVICKTFFNVDGDSLCCPGWSLTLGLKQLSTLTSHSAEITGASHWPGPHCSLSIVLLLAQDVPSPFCTFPAPTVESALSLKILGSFNEERYLENNT

SEQ ID NO: 926249 - protein, 147 aa, Homo sapiens
MNYSLLRFPVLTNQLCLGSGQATFFFLSPGLECNGAISAHCNLRLPGLSDSPASASRVAGITGMHHQAWLLLVFLVETGFHHVGQAGLKLLTSCDPPASASQSAGITEFSDGRRRVVTECGYMKYTRWRKMVNCECEFTFHGPLGCR

SEQ ID NO: 926250 - protein, 176 aa, Homo sapiens
MYAGAIRPPTLIPPPATRTPTDTPPAISPPRATPPSRVVPELYFPIASPPEIHDPQIVPPDYAAPQFPPRLTHTFHAGNLAPQRPHALGPAFVHLGRPTVVSGTVATIPPPNLRLACPLPTRQRNPAGTPPLPPQISPSDRRRSAPYSPVYPPGPAASHTFPHCSPHRSEFCPGEP

SEQ ID NO: 926251 - protein, 176 aa, Homo sapiens
MGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 926252 - protein, 140 aa, Homo sapiens [sequence omitted]

SEQ ID NO: 926253 - protein, 144 aa, Homo sapiens
MSRSLVDSWTLLGCAVPTVRASALGSFPSSSPSSAPLPTPPLLVFCSPWPTFPAFSLGGGPGLIPMHLEDRAGQALTPYAAIGPCGQQGGWNEGSRGRSGGQAQSQPLACCFLGLEEGVREDSAPPPLVEGLTLVRPARSHPEA

SEQ ID NO: 926254 - protein, 260 aa, Homo sapiens
MTLEVGSCGFNSRILPHVYPIRLVKVNEDTMELLRDAQGLCIPCQAGEPGLLVGQINQQDPLRRFDGYVSESATSKKIAHSVFSKGDSAYLSGDVLVMDELGYMYFRDRSGDTFRWRGENVSTTEVEGVLSRLLGQTDVAVYGVAVPGKLGLQGVVLRHGVEGKAGMAAVADPHSLLDPNAIYQELQKVLAPYARPIFLRLLPQVDTTGTFKIQKTRLQREGFDPRQTSDRLFFLDLKQGHYLPLNEAVYTRICSGAFAL

SEQ ID NO: 926255 - protein, 208 aa, Homo sapiens
MGEPAFTSFPSLPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTASESLDRAGAERVRSPLEPTPGRFPAVAGGPTPGMGCQLPPPLSGQLVTPADIRRQARRVKKARERLAKALQADRLARQAEMLTCR

SEQ ID NO: 926256 - protein, 211 aa, Homo sapiens
MRPDPCHRPPEDAAGAPGIDTGSWDLIGLMRKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARQAEMLTCR

SEQ ID NO: 926257 - protein, 134 aa, Homo sapiens
MRQGLHQIESAGPRGSIGFPEPRGNVALPRNLGWAAQGRGNSLYGSLVLLGQTFESEESQLGEESNFLISGPPKPRWYFLDAGPRAPGCAVDLYTDVHQFLGSGQHPLKLEWLLGPPLMSPQDRARNVAGEFCG

SEQ ID NO: 926258 - protein, 452 aa, Homo sapiens
MATFSSSACLTVGQQMHQRQWDHLGTLKGKGLMKDRCSTTFNYPPTDFSSLLRMGLNQGVDLGHIHVIELLHMLFDLVLVGFNVHNEQKCVIVFYLLDGGLSGQRQRDDCRVAKLVSPGGALSRIFGLPPESQCLGLLEDFILVGLFSHSGSRQLLFSLVAVMFVIGLLGNTVLLFLIRVDSRLHTPMYFLLSQLSLFDIGCPMVTIPKMASDFLRGEGATSYGGGAAQIFFLTLMGVAEGVLLVLMSYDRYVAVCQPLQYPVLMRRQVCLLMMGSSWVVGVLNASIQTSITLHFPYCASRIVDHFFCEVPALLKLSCADTCAYEMALSTSGVLILMLPLSLIATSYGHVLQAVLSMRSEEARHKAVTTCSSHITVVGLFYGAAVFMYMVPCAYHSPQQDNVVSLFYSLVTPTLNPLIYSLRNPEAYEKVLNITDHQRNASQNCEEISSYPS

SEQ ID NO: 926259 - protein, 416 aa, Homo sapiens
MDASRPKSSESQSSLEAPRPGPNPSPNVVNKPLQRDFPGMVADRLPPKTGVVVIDMGTGTCKVGFAGQASPTYTVATILGCQPKKPATSGQSGLQTFIGEAARVLPELTLVQPLRSGIVVDWDAAELIWRHLLEHDLRVATHDHPLLFSDPPFSPATNREKLVEVAFESLRSPAMYVASQSVLSVYAHGRVSGLVVDTGHGVTYTVPVFQGYNLLHATERLDLAGNHLTAFLAEMLLQAGLPLGQQDLDLVENIKHHYCYVASDFQKEQARPEQEYKRTLKLPDGRTVTLGKELFQCPELLFNPPEVPGLSPVGLSTMAKQSLRKLSLEMRADLAQNVLLCGGSSLFTGFEGRFRAELLRALPAETHVVVAAQPTRNFSVWIGGSILASLRAFQSCWVLREQYEEQGPYIVYRKCY

SEQ ID NO: 926260 - protein, 130 aa, Homo sapiens
MGILLLHSPKKLLYLGQSLSCKCVRNIVELNLRFDKETGAMLWGRGRQRRRVSQTMKSIPFGIDFKGWPLQNLPFDKKMDNLQNGDNCSSYPPRAVGEVEEVTPTGSVLRPESAASRMMDNCIDVISRKS

SEQ ID NO: 926261 - protein, 153 aa, Homo sapiens
MDSPFGVLQEDPVLTVITQVGLTISLLCLFLAILTFLLCRPIQNTSTSLHLELSLCLFLAHLLFLTGINRTEPEVLCSIIAGLLHFLYLACFTWMLLEGLHLFLTVRNLKVANYTSTGRFKKRFMYPVGYGIPAVIIAVSAIVGPQNYGTFTQ

SEQ ID NO: 926262 - protein, 319 aa, Homo sapiens
MSWTQQGPGYLPLCPLPPPFNHQVYITQLPRCACGVPTSPARLCAPHSSPPACKLREGVQFAGSNPSPEHVPPELWEPFYTDQYAQEHVKPPVTRLLLSAELYCRAWRQALPQLETPPNPSALLALLARRGTVPALPERPVREADLRHQPILMGAHLAVIDALMAAFAFEWTKTLPGPLALTSLEHKLLFWVDTTVRRLQEKTEQEAAQRASPAAPADGAAPAQPSCPTRWYWKLVPHAIAFCLKESGSKPPMIRYRKDRVVARRAPCFPTVTSLQDLASGAALAATIHCYCPQLLRLEGPRDQQRCSGHEGSFRNWQA

SEQ ID NO: 926263 - protein, 183 aa, Homo sapiens
MRLLASDGPPLPCMVTSLVGSNPHPRSPVCQAWTPQPEEEKEEEEEEEEEEEEEEEEEEKEEEKEEEKEDGEEKEEGEEEEGEKEEGEEKEEGEEKGGEEKEEWEEKEEEGEEEDGEEEEKEEEGRRVFPGCLASPWPDGDLQLNGDLKDNLVLVRDQQGRTLEGTAKCRVSGAGGAGVDSGR

SEQ ID NO: 926264 - protein, 187 aa, Homo sapiens
MTGASQNALAQKAHANNLANVSTNGFQRDLEQARSMPVFGDSFPARAFALTERPGTDFSPGAMIETGRDLDVAVSGDGWMAVQNPDGGESYVRSASMNVDALGVLRAGNGMPIMGNGGPIAVPPQQQIEVGQDGTISIRAMGEGPRVMAEVDRIKLVQPDLKNMTKGLDGTSTPRMASRPRPMPPSS

SEQ ID NO: 926265 - protein, 134 aa, Homo sapiens
MRTTRDLVDRKYFCLGLTTTVLCDWSSTEESCDSEDVVNGGHDFPSLGEIPPMSSRRQCWGFQSAPGCRPRAETQPVVVGRYPGDLIITGLIRQTWSLLCLAPPTASSFAARVFEKGEQLPRTAAEVWGPSPYP

SEQ ID NO: 926266 - protein, 171 aa, Homo sapiens
MVPPGWCPLDGIPWKVPPGWYPLDGALWMVPPGWYPLDGIPWMVPPGWYPLEGIPWMVPPGWCPGWCPLDGTSWMVSPGWCPLDGIPWMVPPDEEEEEEEEEEEEEEEEEEEEEEEEEEEEEEEEEEEEEEEEEEEEEEEEEEEEEEERGKREGRERAREQERDARSRQPF

SEQ ID NO: 926267 - protein, 155 aa, Homo sapiens
MTLIDFCSGRLLICWNRSPMRAGIRVFTHVFPVPSKICIPEGESLGDVWVGGVDWPEACGKVIDSGENEVTGRLINLCDLLPLLTVYLPLATEGGSDYHHGNCSWRAESLQALAPTSFMFKYKGALRNGSEVGEAAPLVLWTSPGPTTLLQAPVV

SEQ ID NO: 926268 - protein, 164 aa, Homo sapiens
MAPRALFAGVTQEAPIPPARSCNNTCEMSSAAELIRDSIIIINHYLLSSFVSSFVYALTIDFTPTVVADTLLENGDLAEVSNQGPFCLQRGIRKYFQSAQLEGVLTATHACSLMKKGNTVTAPVSKRILGLFSSVRFQFTLSEFVDFIIYKSQKVGAAQMSIHG

SEQ ID NO: 926269 - protein, 168 aa, Homo sapiens
MIQKSLMIQKLLLTQLRGKFHRAHFLHSWHSLGSSSLVGFWAVSMETVASVSMEKEPAESGIFQALKVTAKTSQHISRTGLPNMAATGHSFKNILFGFLAMTAEWRPRAHFLAPSPVPYSHGASAAPPTQTARALPPPTHTARALPPYSDGTLELECPTEQPQTTDGC

SEQ ID NO: 926270 - protein, 135 aa, Homo sapiens
MTQLPGHFSTFLVSAPHPAAEKPLLHSVLTHRPVHLLATVTLLPAEEAPLMADITAQAILTPQLCSGTLLLAHVAARAHADTNLQHVGIPAGDTTGDMASMTLLPGSDTVDVSPNIYSPFSLSLCLPWSRRECAT

SEQ ID NO: 926271 - protein, 261 aa, Homo sapiens
MREISLNLTVYLHVFPETLTMPQVVPSSLNLVENARSVDLTCQTVNQSVNVQWFLSGQPLLPSEHLQLSADNRTLIIHGLQRNDTGPYACEVWNWGSRARSEPLELTINYGPDQVHITRESASEMISTIEAELNSSLTLQCWAESKPGAEYRWTLEHSTGEHLGEQLIIRALTWEHDGIYNCTASNSLTGLARSTSVLVKVVAASIIIIIIIIIIIIICQASGAIAGIVIGILAVIAVASELGYFLYIRNARRKTTEGPQS

SEQ ID NO: 926272 - protein, 150 aa, Homo sapiens
MASGPRGSCGLGRADCTSRAGLLLPGLTRATPSWTRTHPHFPGPTEPRLALQPNSGKADWWQQRRWRSRLAEPNENRAYPQGPRAGRRPDLAGVGWEAPARGRRLTVPFLSYGSIVGPRSPHGWVHPRAHPSLASHVGGSCAKECPAAGF

SEQ ID NO: 926273 - protein, 254 aa, Homo sapiens
MRQVYTGFISLGCIYTGFAVTNFLLVLRGHGGNPQRGPEAPGTNSQRRRRRRRRRRRRRREEEEEEEEEEEEEEEEEEEEEEEEEEEEKKRKKRKKKEEEKKRKKKKKKKKKKKKKKKKKKKKKKKKTRKKKKKKKTCSTEEFGSHLYWQLLSGACVGSGPCLPSPGLDLPIRKMRDGGPGSEGLLCNSMIPKSSSPGNVAQTHFQPRQDAPQRDIREQQTWNASPMSSTRPGPLKQVTASQPGSQGTPPFQLC

SEQ ID NO: 926274 - protein, 122 aa, Homo sapiens
MENVRVVWIEDQTSHNILLSQSLIQSKAITLFNPVKAERGEEAAEEKLEASRGWFMGLKERSCLHNIKVQGEAAHADGEAASSYPEDLSKIIDEGGYTQQQIFSVDKIATYWKKMPSRTFRA

SEQ ID NO: 926275 - protein, 216 aa, Homo sapiens
MIGFGVIIECIQHPTSSLVIQAEAAVIVPLGHLYALLLHQERVMERDGHLAATFHCSQPYGNLSSWATYMQAALEPQKHRTRFTVSLCNQKLGQDSSGDGLGGGEVGVSGNRFHRLQDPWWLPESGLDPDPKKGFLDLPQERIQGYLFLTCKSMRTSRALWLKPRTGPEALVFKGSSDPLELPCQGGKAHPIFISKRGKRGPETSSCQESSPGFWL

SEQ ID NO: 926276 - protein, 431 aa, Homo sapiens
MPILKNLGVSDPKVPRAGTLPLRSSRNPFEEVSGLEEEEAGELGSLPNGTSCRRRATLEKLAGLAPFRLGWAPGRRAGSPGDGQPRSFLGRVLVPGIRRSSADFGLLARLHGTRAHGDEEAAGEAARRLAFLRLGRGSKPQRASLAERVVPAGEAAPEPPPKVPEPPKMKEPLSVLEILSLIQQRELARADEHILELEAEELAPSRGGAPGPPKAEGAGGGRRARDVALLYEALQRELWALVRETLAGPGPGACAGAGAVAQLGQVLVQEEAADGRRGPGAARKLRARWAEAVARAARERLEAAAPGAPGGLAGQLEALRARLLEDMAVVRGRLAPAYPAGLGAFGVYLRGYHGALAEWLGASARRRLPLADRYALLHWHNQVYPREVLGLVDMAALENGELGPLLSPGTLRGLEDECVTDVKPQKSVNAT

SEQ ID NO: 926277 - protein, 187 aa, Homo sapiens
MRRKWLSSPEALDGIVGTLGAQALALRRMQDEPYQALVAELHRRALVEYVRPLLRGRLRCSSARTRSRVAGRLREDAAQLQRLFRRLLEDTPSIQVEVGVLVRDYPDIRQKHVAALLDIRGLRNTAARQEILAVARDLELSEEGALSPPRDRAFFADIPRDLGPSAEGHPTAGLSDPIYAADKPTSR

SEQ ID NO: 926278 - protein, 167 aa, Homo sapiens
MLPRLVLKTRLTLRRTGQYKGLLDCARQILQREGTRALYRGYLPNMLGIIPYACTDLAVYEMLQCFWVKSGRDMGDPSGLVSLSSVTLSTTCGQMASYPLTLVRTRMQAQDTVEGSNPTMRGVLQRILAQQGWLGLYRGMTPTLLKVLPAGGISYVVYEAMKKTLGI

SEQ ID NO: 926279 - protein, 673 aa, Homo sapiens
MPGGRAKIGGDAATTVNNSTPDFGFGGQKRQLEDGDQPESKKLASQGDFIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQGSQPDYSAAWAEYYRQQAAYYGQTPGPGGPQPPPTQQGQQQASGNCHPPPPPFSFQPPATVHPALGCCGDTMISGLFMSSCCAGSHRPPETGQLPYDPSASALRGPSPLFLLCPSFSIREQRDFSEQPSYLLLCLLRKL

SEQ ID NO: 926280 - protein, 186 aa, Homo sapiens [sequence omitted]

SEQ ID NO: 926281 - protein, 151 aa, Homo sapiens
MAVLWNRKGGSVGEKIEKSDGCRVCVERDLIVKHLIVANFLALRCKGVPQTMAAFGVRYFLNALGCKLVFYLHRVGRGVSIGTTCLLSVFQVITVSSRKSRWAKLKEKAPKHVGFSVLLCWIVCMLVNIIFPMYVTGKWNYTNITVMNKTG

SEQ ID NO: 926282 - protein, 267 aa, Homo sapiens
MLSSLHAFPLCTLKTCSVLYCLKINLLVPLSLCALSPVQYQFPAFTGTLSQRHPFHEPADLPYVTNPCNVTLSVTHSCNVRPSVTHPGNVDPNSPAFLLNALGQISNVHIILYVAHGDVIIMSGAKWKEVYRLNHNRAMTAAILQIGTWCQDTNTCADAASVVFKDLIVKHLIVANFLALRCKGVPQTMAAFGVRYFLNALGCKLVFYLHRVGRGVSIGTTCLLSVFQVITVSSRKSSISCPLDLMVMNAVNFCLSGKDSFLFLFEG

SEQ ID NO: 926283 - protein, 194 aa, Homo sapiens [sequence omitted]
